United States Patent
Nadzan et al.

(10) Patent No.: US 12,043,841 B2
(45) Date of Patent: Jul. 23, 2024

(54) NUCLEOTIDE SEQUENCES AND CORRESPONDING POLYPEPTIDES CONFERRING MODIFIED PHENOTYPE CHARACTERISTICS IN PLANTS

(71) Applicant: CERES, INC., Thousand Oaks, CA (US)

(72) Inventors: Gregory Nadzan, Woodland Hills, CA (US); Richard Schneeberger, Carlsbad, CA (US); Han Suk Kim, Camarillo, CA (US); David Van-dinh Dang, San Diego, CA (US); Kenneth A. Feldmann, Tucson, AZ (US); Roger Pennell, Malibu, CA (US); Shing Kwok, Woodland Hills, CA (US); Hongyu Zhang, Thousand Oaks, CA (US); Cory Christensen, Sherwood, OR (US); Jack Okamuro, Oak Park, CA (US); Fasong Zhou, Oxnard, CA (US); Wuyi Wang, Newbury Park, CA (US); Emilio Margolles-Clark, Miami, FL (US); Gerard Magpantay, Calabasas, CA (US); Julissa Sosa, Northridge, CA (US); Nestor Apuya, Culver City, CA (US); Kerstin Piccolo, Woodland Hills, CA (US); Bonnie Hund, Denver, CO (US); Nickolai Alexandrov, Thousand Oaks, CA (US); Vyacheslav Brover, Simi Valley, CA (US); Peter Mascia, Thousand Oaks, CA (US)

(73) Assignee: Ceres, Inc., Thousand Oaks, CA (US)

( * ) Notice: Subject to any disclaimer, the term of this patent is extended or adjusted under 35 U.S.C. 154(b) by 1005 days.

(21) Appl. No.: 16/991,904

(22) Filed: Aug. 12, 2020

(65) Prior Publication Data
US 2021/0079416 A1  Mar. 18, 2021

Related U.S. Application Data

(60) Division of application No. 15/689,941, filed on Aug. 29, 2017, now Pat. No. 10,815,494, which is a division of application No. 13/644,359, filed on Oct. 4, 2012, now Pat. No. 9,777,287, which is a continuation-in-part of application No. 13/465,846, filed on May 7, 2012, now abandoned, which is a division of application No. 10/572,827, filed on Mar. 7, 2007, now Pat. No. 8,193,409, said application No. 13/644,359 is a continuation-in-part of application No. 11/779,266, filed on Jul. 17, 2007, now abandoned, which is a continuation-in-part of application No. 11/778,060, filed on Jul. 15, 2007, now abandoned, which is a continuation-in-part of application No. 11/248,547, filed on Oct. 12, 2005, now Pat. No. 7,244,879, said application No. 13/664,359 is a continuation-in-part of application No. 12/514,991, filed as application No. PCT/US2007/085007 on Nov. 16, 2007, now abandoned, said application No. 13/644,359 is a continuation-in-part of application No. 12/445,005, filed as application No. PCT/US2007/081301 on Oct. 12, 2007, now abandoned, said application No. 13/644,359 is a continuation-in-part of application No. 12/515,707, filed as application No. PCT/US2007/085439 on Nov. 21, 2007, now abandoned, said application No. 13/644,359 is a continuation-in-part of application No. 12/615,920,
(Continued)

(51) Int. Cl.
*C12N 15/82* (2006.01)
*C07K 14/415* (2006.01)

(52) U.S. Cl.
CPC ........ *C12N 15/8271* (2013.01); *C07K 14/415* (2013.01); *C12N 15/8201* (2013.01); *C12N 15/8241* (2013.01); *C12N 15/8261* (2013.01); *C12N 15/8269* (2013.01); *Y02A 40/146* (2018.01)

(58) Field of Classification Search
None
See application file for complete search history.

(56) References Cited

U.S. PATENT DOCUMENTS 7,696,409 B2   4/2010  Schneeberger et al.
8,471,099 B2   6/2013  Schneeberger et al.
(Continued)

FOREIGN PATENT DOCUMENTS

EP          1033405           9/2000
EP          1033405 A2 *      9/2000  ............ C07H 21/04
WO     WO 2009/105612         8/2009

OTHER PUBLICATIONS

Wells (Biochemistry 29:8509-8517, 1990).*
(Continued)

*Primary Examiner* — Vinod Kumar
(74) *Attorney, Agent, or Firm* — Dentons US LLP

(57) ABSTRACT

Methods and materials for modulating low-nitrogen tolerance levels in plants are disclosed. For example, nucleic acids encoding low nitrogen tolerance-modulating polypeptides are disclosed as well as methods for using such nucleic acids to transform plant cells. Also disclosed are plants having increased$_{[RCL2]}$ low-nitrogen tolerance levels and plant products produced from plants having increased low-nitrogen tolerance levels.

9 Claims, 165 Drawing Sheets
Specification includes a Sequence Listing.

Related U.S. Application Data filed on Nov. 10, 2009, now Pat. No. 8,471,099, which is a division of application No. 11/114,963, filed on Apr. 25, 2005, now Pat. No. 7,696,409, said application No. 13/644,359 is a continuation-in-part of application No. 12/605,261, filed on Oct. 23, 2009, now abandoned, which is a division of application No. 11/298,391, filed on Dec. 8, 2005, now Pat. No. 7,663,027, said application No. 13/644,359 is a continuation-in-part of application No. 12/377,106, filed as application No. PCT/US2007/075747 on Aug. 10, 2007, now abandoned, said application No. 13/644,359 is a continuation-in-part of application No. 12/541,607, filed on Aug. 14, 2009, now abandoned, which is a continuation of application No. 11/140,347, filed on May 27, 2005, now Pat. No. 7,576,260, said application No. 13/644,359 is a continuation-in-part of application No. 13/184,361, filed on Jul. 15, 2011, now Pat. No. 8,962,921, which is a division of application No. 11/140,450, filed on May 27, 2005, now Pat. No. 8,022,273, said application No. 13/644,359 is a continuation-in-part of application No. 11/654,357, filed on Jan. 16, 2007, now abandoned, said application No. 13/644,359 is a continuation-in-part of application No. 13/465,841, filed on May 7, 2012, now Pat. No. 9,765,355, which is a division of application No. 11/858,117, filed on Sep. 19, 2007, now abandoned, which is a continuation-in-part of application No. PCT/US2007/006544, filed on Mar. 14, 2007, said application No. 13/644,359 is a continuation-in-part of application No. 12/922,143, filed as application No. PCT/US2009/037025 on Mar. 12, 2009, now abandoned, said application No. 13/644,359 is a continuation-in-part of application No. 11/241,685, filed on Sep. 30, 2005, now Pat. No. 8,481,814, said application No. 13/644,359 is a continuation-in-part of application No. 12/863,773, filed as application No. PCT/US2009/031609 on Jan. 21, 2009, now abandoned, said application No. 13/644,359 is a continuation-in-part of application No. 12/282,342, filed as application No. PCT/US2007/006544 on Mar. 14, 2007, now Pat. No. 8,324,454, said application No. 13/644,359 is a continuation-in-part of application No. 12/911,698, filed on Oct. 25, 2010, now Pat. No. 9,914,935, which is a division of application No. 11/324,098, filed on Dec. 29, 2005, now Pat. No. 7,884,261, which is a continuation-in-part of application No. 11/172,740, filed on Jun. 30, 2005, now Pat. No. 7,396,979, said application No. 13/644,359 is a continuation-in-part of application No. 13/609,176, filed on Sep. 10, 2012, now abandoned, which is a division of application No. 12/139,269, filed on Jun. 13, 2008, now abandoned, which is a division of application No. 11/172,740, filed on Jun. 30, 2005, now Pat. No. 7,396,979, said application No. 13/644,359 is a continuation-in-part of application No. 12/918,609, filed as application No. PCT/US2009/034638 on Feb. 20, 2009, now abandoned, said application No. 13/644,359 is a continuation-in-part of application No. 12/776,319, filed on May 7, 2010, now abandoned, which is a division of application No. 11/324,093, filed on Dec. 29, 2005, now Pat. No. 7,803,983, which is a continuation-in-part of application No. 11/172,740, filed on Jun. 30, 2005, now Pat. No. 7,396,979.

(60) Provisional application No. 61/036,396, filed on Mar. 13, 2008, provisional application No. 61/030,152, filed on Feb. 20, 2008, provisional application No. 61/022,786, filed on Jan. 22, 2008, provisional application No. 60/860,296, filed on Nov. 21, 2006, provisional application No. 60/859,467, filed on Nov. 16, 2006, provisional application No. 60/851,585, filed on Oct. 12, 2006, provisional application No. 60/837,434, filed on Aug. 11, 2006, provisional application No. 60/782,735, filed on Mar. 14, 2006, provisional application No. 60/778,568, filed on Mar. 1, 2006, provisional application No. 60/758,831, filed on Jan. 13, 2006, provisional application No. 60/635,115, filed on Dec. 8, 2004, provisional application No. 60/635,140, filed on Dec. 8, 2004, provisional application No. 60/615,080, filed on Sep. 30, 2004, provisional application No. 60/584,829, filed on Jun. 30, 2004, provisional application No. 60/584,800, filed on Jun. 30, 2004, provisional application No. 60/583,621, filed on Jun. 30, 2004, provisional application No. 60/575,309, filed on May 27, 2004, provisional application No. 60/575,253, filed on May 27, 2004, provisional application No. 60/564,659, filed on Apr. 23, 2004.

(56) References Cited

U.S. PATENT DOCUMENTS

| | | | |
|---|---|---|---|
| 9,777,287 | B2 | 10/2017 | Nadzan et al. |
| 10,428,344 | B2 | 10/2019 | Nadzan et al. |
| 10,815,494 | B2 | 10/2020 | Nadzan et al. |
| 11,396,659 | B2 | 7/2022 | Nadzan et al. |
| 11,624,075 | B2 | 4/2023 | Nadzan et al. |
| 2002/0160378 | A1 | 10/2002 | Harper et al. |
| 2004/0009476 | A9 | 1/2004 | Harper et al. |
| 2006/0107345 | A1 | 5/2006 | Alexandrov et al. |
| 2011/0061124 | A1 | 3/2011 | Nadzan et al. |
| 2017/0037426 | A1* | 2/2017 | Alexandrov ....... C12N 15/8271 |
| 2020/0048653 | A1 | 2/2020 | Nadzan et al. |
| 2020/0056199 | A1 | 2/2020 | Nadzan et al. |
| 2021/0087576 | A1 | 3/2021 | Nadzan et al. |

OTHER PUBLICATIONS

Guo et al. (PNAS, 101: 9205-9210, 2004 ).*
Ngo et al., (The Protein Folding Problem and Tertiary Structure Prediction, K. Merz., and S. Le Grand (eds.) pp. 492-495, 1994).*
Thornton et al. (Nature structural Biology, structural genomics supplement, Nov. 2000).*
Keskin et al. (Protein Science, 13:1043-1055, 2004).*
Doerks et al., (TIG, 14:248-250, 1998).*
Smith et al. (Nature Biotechnology, 15:1222-1223, 1997).*
Bork et al. (TIG, 12:425-427, 1996).*
U.S. Appl. No. 16/991,897 filed Aug. 12, 2020, Nadzan et al.
Falcon-Perez et al., Functional Domain Analysis of the Yeast ABC Transporter Ycf1p by Site-Directed Mutagenesis, The Journal of Biological Chemistry 274(33):23584-23590, 1999.
Hill and Preiss, Functional Analysis of Conserved Histidines in ADP-Glucose Pyrophosphorylase from Escherichia coli, Biochemical and Biophysical Research Communications 244:573-577, 1998.
Guo et al., Protein Tolerance to Random Amino Acid Change, PNAS 101(25):9205-9210, 2004.
Lazar et al., Transforming Growth Factor alpha: Mutation of Aspartic Acid 47 and Leucine 48 Results in Different Biological Activities, Molecular and Cellular Biology 8(3):1247-1252, 1988.
Sweetlove et al., Starch Metabolism in Tubers of Transgenic Potato (Solanum tuberosum) with Increased ADPglucose Pyrophosphorylase, Biochemical Journal 320:493-498, 1996.
Fourgoux-Nicol et al., Isolation of Rapeseed Genes Expressed Early and Specifically During Development of the Male Gametophyte, Plant Molecular Biology 40:857-872, 1999.

(56) References Cited

OTHER PUBLICATIONS

USPTO: Corrected Notice of Allowability for U.S. Appl. No. 15/689,941, dated Aug. 25, 2020.
Forde, "Local and long-range signaling pathways regulating plant responses to nitrate," Annu Rev Plant Biol, 53:203-224, 2002.
Gazzarrini et al., "Three functional transporters for constitutive, diurnally regulated, and starvation-induced uptake of ammonium into Arabidopsis roots," Plant Cell, 11:937-948, 1999.
GenBank Gene ID: 4914437, CD630_27000 sigma-54 dependent transcriptional regulator [Clostridioides difficile 630], Available at https://www.ncbi.nlm.nih.gov/gene/?term=4914437, Retrieved Jan. 12, 2017.
GenBank Gene ID: 7981380, DMR_t00510 [Desulfovibrio magneticus RS-1], Available at https://www.ncbi.nlm.nih.gov/gene/7981380, Retrieved Jan. 12, 2017.
Huber et al., "Regulation of maize leaf nitrate reductase activity involves both gene expression and protein phosphorylation," Plant Physiol, 106:1667-1674, 1994.
Hwang et al., "Sequences necessary for nitrate-dependent transcription of *Arabidopsis nitrate* reductase genes," Plant Physiol, 113:853-862, 1997.
Okamoto et al., "Regulation of NRT1 and NRT2 gene families of *Arabidopsis thaliana*: responses to nitrate provision," Plant Cell Physiol, 44:304-317, 2003.
Redinbaugh et al., "Higher plant responses to environmental nitrate," Physiol Plant, 82:640-650, 1991.
Good et al., "Can less yield more? Is reducing nutrient input into the environment compatible with maintaining crop production?," *Trends in Plant Science* 9(12):597-605, 2004.
Guerois et al., "Predicting Changes in the Stability of Proteins and Protein Complexes: A Study of More Than 1000 Mutations," *J. Mol. Biol.* 320:369-387, 2002.
Kumar et al., "Predicting the effects of coding non-synonymous variants on protein function using the SIFT algorithm," *Nature Protocols* 4(8):1073-1082, 2009.
Ng et al., "Predicting the Effects of Amino Acid Substitutions on Protein Function," *Annu. Rev. Genom. Hum. Genet.* 7:61-80, 2006.
Reva et al., "Predicting the functional impact of protein mutations: application to cancer genomics," *Nucleic Acids Research* 39(17):e118, 2011.
Sandhya et al., "CUSP: an algorithm to distinguish structurally conserved and unconserved regions in protein domain alignments and its application in the study of large length variations," BMS Structural Biology; 14 pages; May 31, 2008.
Bowie et al., Science 247:1306-1310, 1990.
McConnell et al., Nature 411 (6838): 709-713, 2001.
Kano-Murakami et al., (1993, FEBS 334:365-368).
Eddy, 2004, Nature Biotechnology 22(10):1315-1316.
UniProt Accession No. Q9C9V8_ARATH, dated Jun. 1, 2001.

\* cited by examiner

Figure 1

```
SEQ_ID_NO_21   - - - - - - - - - - - - - - MTNLYLT  L- - - - - - - - - - - - - - - - - - - - - - - - - - - - - -   8
SEQ_ID_NO_36   - - - - - - - - - - - - - - MNPLA- -  - - - - - - - - - - - - - - - - - - - - - - - - - - - - - - -   5
SEQ_ID_NO_47   - - - - - - - - - - - - - - MSLM  IV  F- - - - - - - - - - - - - - - - - - - - - - - - - - - - - - -   8
SEQ_ID_NO_4    - - - - - MENRR  SSGGSGWWVC  VLP- - - - - -L  FTKDGPAYFL  HSSSDDVSAW    39
SEQ_ID_NO_46   - - - - - - - - - - - - - - - - - - - -  - - - - - - - - - - - - - - - - - - - - - - - - - - - - -   0
SEQ_ID_NO_39   - - MDSSPST  DCGGWL LYVS  LAAKC- - - -G  GDPCRVVGFV  - - - - - - - - - -  34
SEQ_ID_NO_40   MDMDSSPST  DCGGWL LYVS  LAAKC- - - -G  GDPCRVVGFV  - - - - - - - - - -  36
SEQ_ID_NO_27   - - - - -MAPSE  KC- GWL LYVS  LAAKCCGNGD  GKPYRVVGFV  - - - - - - - - - -  34
SEQ_ID_NO_29   - - - - -MAPPTE  DC- GWL LYLS  LAAKC- - - -    GDPQRLLGFA  - - - - - - - - - -  30
SEQ_ID_NO_38   - - - - -MAPSE  DC- GWL LYLS  LAAKC- - - -    GDPHRL LGFA  - - - - - - - - - -  29
SEQ_ID_NO_3    - - - - - - -MAT  KLDTSSL LLA  LLSKC- - SL  LTQTNLALSL  - - - - - - - - - -  30
SEQ_ID_NO_25   - - - - - - -MST  NI- DNL MFA  LASKC- - - -   - TQENL AYSL  - - - - - - - - - -  26
SEQ_ID_NO_22   - - - - - - -MTS  HI DDNLMLA  LTSKC- - - -   - TQENL AWVL  - - - - - - - - - -  27
SEQ_ID_NO_6    - - - - - - -MGS  DI- ESVMLFA  LASKC- - KA  FSQQNTAWPI  - - - - - - - - - -  29
SEQ_ID_NO_10   - - - - - - -MRT  DI- DSFWIFA  LASKC- - RA  FTQENLAWSL  - - - - - - - - - -  29

SEQ_ID_NO_21   - - - - - -LLPT  FIFLIVLVLS  - - - - - - - - - -  - - - - - - - - - -  - - - -RRRNNR  28
SEQ_ID_NO_36   - - - - - -LIFC  TALFCILLYH  FL- - - - - - - -  - - - - - - - - - -  - - - -TRRSVR  27
SEQ_ID_NO_47   - - - - -VTIV  AAI LINRLLN  LI- - - - - - - -  - - - - - - - - - -  - - - -KKPTLP  30
SEQ_ID_NO_4    RQWPLYIALL  IVAVCAVLVS  MLSPGGCAWA  GRH- - - - - - -  - - - -KRGRVA  78
SEQ_ID_NO_46   - - - - - - - - - - - - - - - - - - - -  - - - - - - - - - -  - - - - - - - - - -  - - - - - - - - - -   0
SEQ_ID_NO_39   - - - - - -AVAV  VAFAVTSLLH  MLSPGGPAWG  RYWW- - - - - -  - - -NRRGGLG  69
SEQ_ID_NO_40   - - - - - -AVAV  VAFAVTSLLH  MLSPGGPAWG  RYWW- - - - - -  - - -NRRGGLG  71
SEQ_ID_NO_27   - - - - - -VVLL  AAFVVTSLLH  MASQGGAAWG  RYWW- - - - - -  - - -RRKGLG  68
SEQ_ID_NO_29   - - - - - -AVFV  AACVVTSLLH  MASPGGAAWG  WYWW- - - - - -  - - -TRRAGLG  65
SEQ_ID_NO_38   - - - - - -AVLA  TAFVVTALLH  MASPGGPAWG  RYWW- - - - - -  - - -TRRAGLG  64
SEQ_ID_NO_3    - - - - - -LVAS  LASLALSLFF  MSHPGGPAWG  KYFL- - - - - -  - - -HRRRQTT  65
SEQ_ID_NO_25   - - - - - -LIMA  LLWITMTFFY  MSHPGGPAWG  KYYYSSNYST  TKTNNKNNLN  70
SEQ_ID_NO_22   - - - - - -LIMG  SLMLTMTFYY  MSHPGGPAWG  KYYT- - - - - -  - - - - -YSPPLS  61
SEQ_ID_NO_6    - - - - - -LIIA  LAWLVMTIVY  MVHPGGPAWS  KYRF- - - - - -  - - - -KKCAIT  63
SEQ_ID_NO_10   - - - - - -LIIG  LAWIVVTLIY  MAYPGGPAWG  KYKL- - - - - -  - - - -KNTSLT  63
```

Figure 1 (continued)

```
SEQ_ID_NO_21  L---------  ----PPGPNP  WPIIGNLPHM  -GPKPHQTLA  AMVTT---YG   61
SEQ_ID_NO_36  L---------  ----PPGPKP  WPIVGNLPHL  -GPVPHHSIA  ALAKT---YG   60
SEQ_ID_NO_47  L---------  ----PPGPSP  WPIVGNLPHM  -GPVPHHALA  ALALK---HG   63
SEQ_ID_NO_4   ----------  ----IPGPKG  WPIIGSLMDM  SVGLPHRKLE  SLARL-HGAK  113
SEQ_ID_NO_46  ----------  ----------  ----------  ----------  ----------    0
SEQ_ID_NO_39  IAAA------  ----IPGPRG  LPVLGSMSLM  -AGLAHRKLA  AAAGGSPARR  108
SEQ_ID_NO_40  IAAA------  ----IPGPRG  LPVLGSMSLM  -AGLAHRKLA  AAAGGSPARR  110
SEQ_ID_NO_27  IGEAR-----  ----IPGPRG  FPVIGSMGLM  -TGLAHRKLA  AAAAGNVRRR  108
SEQ_ID_NO_29  IVRAA-----  ----IPGPRG  LPVVGSMGLM  -TGLAHRKLS  AAAEROASRR  105
SEQ_ID_NO_38  IGAA------  ----IPGPRG  LPVLGSMGLM  -TGLAHRKLA  AAAGK--ARR  101
SEQ_ID_NO_3   V---------  ----IPGPRG  LPEVGSMSLM  SNTLAHRCIA  ATAEK-FRAE  101
SEQ_ID_NO_25  SSTKPSTTTS  SSIFIPGPKG  YPLFGSMNLM  SSSLAHHRIA  STAKT-CKAT  119
SEQ_ID_NO_22  I---------  ----IPGPRG  FPLIGSMGLM  -TSLAHHRIA  AAAAT-CRAK   96
SEQ_ID_NO_6   TINKP-----  ----IPGPRG  LPLIGSMNMV  ANSLAHHLIA  TIAKT-CKAK  103
SEQ_ID_NO_10  ISNP------  ----IPGPRG  FPITGSMKLM  -TSLAHHKIA  AAADA-CKAR  101

SEQ_ID_NO_21  PILHLRLGFA  DVVVAASKSV  AEQFLKVHDA  NFASRPPNSG  AKHMAYNYQD  111
SEQ_ID_NO_36  PLMHLRMGFV  DVVVAASASV  AADFLKTHDA  NFSNRPPNSG  AKHIAYNYQD  110
SEQ_ID_NO_47  PLMHLQLGFV  DVIVAASASM  AEQFLKVHDA  NFSSRPPNSG  AKYIAYNYQD  113
SEQ_ID_NO_4   QLMSFSLGCT  PAVITSDPEV  ARELL-TSP   HFANRPLKQS  AQQLLFG-RA  160
SEQ_ID_NO_46  --MAFSVGLT  REIVSSHPKT  AKEILL-SBP  AFADRPIKES  AYELLFN-RA   45
SEQ_ID_NO_39  RLMALSLGET  RVVVTADPGV  ARELL-ABA   AFADRPVKES  AYGMLFH-RA  155
SEQ_ID_NO_40  RLMALSLGET  RVVVTADPGV  ARELL-ABA   AFADRPVKES  AYGMLFH-RA  157
SEQ_ID_NO_27  RLMSFSMGET  RVVVTADPDV  ARELL-ABP   AFADRPVKES  AYGLMFH-RA  155
SEQ_ID_NO_29  RLMAFSLGET  RVVVTADLDV  ARELL-ABA   AFADRPVKES  AYGLLFH-RA  152
SEQ_ID_NO_38  RLMAFSLGET  RVVVTADPDV  ARELL-ABA   TFADRPVKES  AYGLLFH-RA  148
SEQ_ID_NO_3   RLMAFSLGET  RVIVTCNPDV  AKEIL-NSP   VFADRPVKES  AYSLMFN-RA  148
SEQ_ID_NO_25  RLMAFSLGDT  RAMVTCNPDV  AKEIL-HSS   AFADRPIKES  AYSLMFN-RA  166
SEQ_ID_NO_22  RLMAFSLGDT  RVIVTCHPDV  AKEIL-NSS   VFADRPVKES  AYSLMFN-RA  143
SEQ_ID_NO_6   RLMAFSLGDT  RVIVTCNPEV  AKEIL-NSS   VFADRPVKES  AYSLMFN-RA  150
SEQ_ID_NO_10  RLMAFSLGDT  RVIVTCNPDV  AKEILL-NSS  VFADRPVKES  AYSLMFN-RA  148
```

Figure 1 (continued)

| | | | | | | | | |
|---|---|---|---|---|---|---|---|---|
| SEQ_ID_NO_21 | LVFAPYGQRM | RMLRKISSVH | LFSAKALEDF | KHVRQEEVGT | LMRE---LARA | | | 159 |
| SEQ_ID_NO_36 | LVFAPYGPRM | RMLRKICSVH | LFSGQALDDF | RHIRQEEVLA | LMRA---LARE | | | 158 |
| SEQ_ID_NO_47 | LVFAPYGPRM | RLLRKISYVH | MFSSKALDDF | RHIRQDEVAR | LIRN---LSNS | | | 161 |
| SEQ_ID_NO_4 | IGFAPNGGYW | RLLRRIASAH | LFAPRRIAAH | EAGRQADVVA | MLDD---QKE | | | 208 |
| SEQ_ID_NO_46 | MGFAPFGDYW | RNLRRISSTY | LFSPRRVSSF | EKQRSEIGEG | MVRD---MKRM | | | 93 |
| SEQ_ID_NO_39 | IGFAPYGTYW | RALRRVASTH | LFSPRQVSAS | AAQRAVIARQ | MVEAMRSAAA | | | 205 |
| SEQ_ID_NO_40 | GFAPYGTYW | RALRRVASTH | LFSPRQVSAS | AAQRAVIARQ | MVEAMRSAAA | | | 207 |
| SEQ_ID_NO_27 | IGFAPYGAYW | RTLRRVSSSH | LFSPRQVAAS | AAQRAVIAHQ | MVDA---MRPV | | | 203 |
| SEQ_ID_NO_29 | IGFAPHGAYW | RALRRVASAH | LFSPRQIAAS | AAQRAAIARQ | MVDA---TTTA | | | 200 |
| SEQ_ID_NO_38 | IGFAPHGAYW | RALRRVASAH | LFSPRQIAAS | AAQRAVIARQ | MVDAMMMEQG | | | 198 |
| SEQ_ID_NO_3 | IGFAPYGVYW | QTLRKIASNH | LFSPKQIKRS | ETQRSVIANQ | IVKC---LTKQ | | | 196 |
| SEQ_ID_NO_25 | IGFAPYGVYW | RTLRKISTNH | LFSPMQIKSS | GPQRSEIATQ | MIDL---FRNR | | | 214 |
| SEQ_ID_NO_22 | IGFASYGVYW | RSLRRIASNH | LFCPRQIKAS | ELQRSQIAAQ | MVHI---LNNK | | | 191 |
| SEQ_ID_NO_6 | IGFAPYGVYW | RELRRIAATH | LFCPKQIKNS | EEQRRFIADE | MVNL---FGRH | | | 198 |
| SEQ_ID_NO_10 | IGFAPYGVYW | RTLRKIASTH | LFCPKQIKAA | ESQRLQLASQ | MVST---FNDR | | | 196 |

| | | | | | | | |
|---|---|---|---|---|---|---|---|
| SEQ_ID_NO_21 | NTKP---VNL | GQLVNMCVLN | ALGREMIGRR | LFGAD----- | ADIKAEEFRS | | 201 |
| SEQ_ID_NO_36 | GQTP---VKL | GQLLNVCTTN | ALGRVMLGRR | VFGDGSGG-- | EDPKADEFKE | | 203 |
| SEQ_ID_NO_47 | GSKA---ANL | GQMLNVCTTN | ALARVMIGRR | VFNEGNGGCE | CDPRADEFKS | | 208 |
| SEQ_ID_NO_4 | YHSK-GVVRV | RRHLQGAALN | NIMGSVFGRR | FDMSH----- | ENEEVKKLRE | | 252 |
| SEQ_ID_NO_46 | MERN-GVVEV | RRMLHYGSLN | NIMLTVFGKK | FDF------- | AKDEGLELEL | | 135 |
| SEQ_ID_NO_39 | AAAG-GGVAA | RPFLKRASLH | NVMASVFGRK | YELAAP---- | ESEETAELRS | | 250 |
| SEQ_ID_NO_40 | AAAG-GGVAA | RPFLKRASLH | NVMASVFGRK | YELAAP---- | ESEETAELRS | | 252 |
| SEQ_ID_NO_27 | GGAGVKHVEA | RRFLKRASLH | NVMASVFGRR | YELDEA---- | GSGEAAELKS | | 249 |
| SEQ_ID_NO_29 | AAHA-PVVVA | RRFLKRASLH | NVMASVFGRR | YDLMA----- | DSREAEELKA | | 244 |
| SEQ_ID_NO_38 | AAAP-GVVTA | RRFLKRASLH | SVMASVFGRR | YELLQAAD-- | GGEEAAELQS | | 245 |
| SEQ_ID_NO_3 | SNIK-GLCFA | RDLIKTASLN | NMMCSVFGKE | YELEE----- | EHEEVSELRE | | 240 |
| SEQ_ID_NO_25 | HLHG-GFC-V | RDVLKKASLN | NMMCSVFGQR | FKIDE----- | VNERMMELSG | | 257 |
| SEQ_ID_NO_22 | RHRS---LRV | RQVLKKASLS | NMMCSVFGQE | YKLHD----- | PNSGMEDLGI | | 233 |
| SEQ_ID_NO_6 | GHER--SFIV | REVVKRASLN | NMMVSIFGRK | YKLDC----- | DNNEVDELRG | | 241 |
| SEQ_ID_NO_10 | EKSS---FSV | REVLKRASLN | NMMCSVFGRE | YKLDS----- | FNNEVEELRA | | 238 |

Figure 1 (continued)

| | | | | | | | |
|---|---|---|---|---|---|---|---|
| SEQ_ID_NO_21 | MVTEMMALAG | VFNLGDFVPA | IDCLDLQGVA | GKMKRLHKRF | DAFLSSLEE | 251 |
| SEQ_ID_NO_36 | MVVELMVLAG | VFNLGDFVPA | LEWLDLCGVA | SKMKKLHARF | DAFLGAVEE | 253 |
| SEQ_ID_NO_47 | MVVELMVLAG | VFNLGDFVPS | LEWLDIQGVQ | SKMKKLHKRF | DSFLTSIED | 258 |
| SEQ_ID_NO_4 | MVDEGFQLLG | AFNWADHLPW | LRPLDPLRIH | ARCARLVPRV | TTFVSNIEQ | 302 |
| SEQ_ID_NO_46 | ILKEGYELLG | IFNWGDHLPL | LGWLDLQGVR | RRCRTLVAKV | NVFVKKIDE | 185 |
| SEQ_ID_NO_39 | MVDEGYDLLG | QLNWSDHLPW | LAPFDLQKTR | SRCSSLVPRV | NRFVTRIDE | 300 |
| SEQ_ID_NO_40 | MVDEGYDLLG | QLNWSDHLPW | LAPFDLKKTR | SRCSSLVPRV | NRFVTRIDE | 302 |
| SEQ_ID_NO_27 | LVDEGYDLLG | QLNWSDHLPW | LARFDLQKIR | SRCSALVPRV | NRFVGRIDE | 299 |
| SEQ_ID_NO_29 | LVDEGYDLLG | QLNWSDHLPW | LARFDLQKTR | ARCCALVPRV | NRFVGNIGE | 294 |
| SEQ_ID_NO_38 | LVDQGYDLLG | QLNWSDHLPW | LARFDLQRTR | ARCAALVPRV | NRFVGRIDE | 295 |
| SEQ_ID_NO_3 | LVEEGYDLLG | TLNWTDHLPW | LSEFDPQRIR | SRCSNLVPKV | NRFVNRISD | 290 |
| SEQ_ID_NO_25 | LVEQGYDLLG | GLNWGDHLPF | LKDFDVQKIR | FSCSELVPKV | NRFVGSISD | 307 |
| SEQ_ID_NO_22 | LVDQGYDLLG | LFNWADHLPF | LAHFDAQNIR | FRCSNLVPMV | NRFVGTIAE | 283 |
| SEQ_ID_NO_6 | LVDEGYDLLG | TLNWSDHLPW | LAQFDPQNIR | VRCSNLVPKV | NGFVGGIAQ | 291 |
| SEQ_ID_NO_10 | LVEEGYDLLG | TLNWSDHLPW | LADFDPQKIR | FRCSNLVPKV | NRFVBRIAE | 288 |

| | | | | | | |
|---|---|---|---|---|---|---|
| SEQ_ID_NO_21 | HEAMK----N | GQDQKHTDML | STLISLK--- | --GTDFDGEG | GTLTDTEIKA | 292 |
| SEQ_ID_NO_36 | HKISG----S | AGSERHVDLL | STLISLKDNA | DGEGG----- | -KLTDVEIKA | 293 |
| SEQ_ID_NO_47 | HMVSK----- | --SEKHNDLL | STLLSLKEKV | DEDGD----- | -KLNDTEIKA | 295 |
| SEQ_ID_NO_4 | HRREE---QR | RESGDQCDFV | DVLLSLC--- | --GED----- | -KLDEEDMIA | 338 |
| SEQ_ID_NO_46 | HKRRA-NGVG | IDEGEGEDFV | DVLLSLE--- | --EKD----- | -RLSESDMVA | 223 |
| SEQ_ID_NO_39 | HRARL----S | LAVDAAVDFT | DVLLSLH--- | --GGD----- | -KLSDADMVA | 335 |
| SEQ_ID_NO_40 | HRARL----S | LAVDAAVDFT | DVLLSLH--- | --GGD----- | -KLSDADMVA | 337 |
| SEQ_ID_NO_27 | HRAAL----N | DDDDAVVDFT | DVLLSLC--- | --GSD----- | -KLSDADMIA | 334 |
| SEQ_ID_NO_29 | HRARL---GR | GGDTAVMDFT | DVLLSLC--- | --GDD----- | -KLSDADMIA | 330 |
| SEQ_ID_NO_38 | HRAARLHLGG | DGAAAVVDFT | DVLLSLC--- | --GSD----- | -RLSDADMIA | 334 |
| SEQ_ID_NO_3 | HREQT----- | --RDSPSDFV | DVLLSLD--- | --GPD----- | -KLSDPDIIA | 322 |
| SEQ_ID_NO_25 | HRADK----- | --NQTNKDFV | HVLLSLQ--- | --EPD----- | -KLSDSDMIA | 339 |
| SEQ_ID_NO_22 | HRASK----- | --TETNRDFV | DVLLSLP--- | --EPD----- | -QLSDSDMIA | 315 |
| SEQ_ID_NO_6 | HRART----- | --NEEARDLV | DVLLSLC--- | --GAD----- | -KLSDSDMIA | 323 |
| SEQ_ID_NO_10 | HRALT----- | --RSENPDFV | DVLLSLQ--- | --GHD----- | -KLSDSDMIA | 320 |

Figure 1 (continued)

| | | | | | | | |
|---|---|---|---|---|---|---|---|
| SEQ_ID_NO_21 | LLLNMFTAGT | DTSASTVDWA | AELIRHPEI | MRKAQEELDS | VV- GRGRP N | 341 |
| SEQ_ID_NO_36 | LLLNLFTAGT | DTSSSTVEWA | AELIRHPEM | MAQAQQELDA | VV- GRGRL VT | 342 |
| SEQ_ID_NO_47 | LLLNMFTAGT | DTSSSTTEWA | AELIKNPKL | MIRIQNELDT | VV- GRDRL VT | 344 |
| SEQ_ID_NO_4 | VLWEMIFRGT | DTTALLTEWT | MAELVLHPEA | QKKAQAELDA | VV- GHDRSVK | 387 |
| SEQ_ID_NO_46 | VLWEMIFRGT | DTVAILLEWT | LARMVLHPDI | QSKAQVEIDS | VV- DSSRPVL | 272 |
| SEQ_ID_NO_39 | VLWEMIFRGT | DTVAVLIEWV | AARLVLHQDV | QARVHDELDR | VV- GSDRAVT | 384 |
| SEQ_ID_NO_40 | VLWEMIFRGT | DTVAVLIEWV | AARLVLHQDV | QARVHDELDR | VV- GSDRAVT | 386 |
| SEQ_ID_NO_27 | VLWEMIFRGT | DTVAVVIEWV | LARLMLHQDV | QARVHEELDR | VV- GPNRAVT | 383 |
| SEQ_ID_NO_29 | VLWEMIFRGT | DTVAVLIEWV | LARLVLHQDV | QSKVQEELDR | VV- GL GQAVT | 379 |
| SEQ_ID_NO_38 | VLWEMIFRGT | DTVAVLMEWV | LARLVLHQDV | QRRVQEELDR | VV- GPGRAVT | 383 |
| SEQ_ID_NO_3 | VLWEMIFRGT | DTVAVLIEWI | LARMVLHPDI | QSTVHNELDQ | I V- GRSRAVE | 371 |
| SEQ_ID_NO_25 | VLWEMIFRGT | DTVAVLIEWI | LARLVIHPDV | QKKVQTELDE | VASGESCAIT | 389 |
| SEQ_ID_NO_22 | VLWEMIFRGT | DTVAVLIEWI | LARMAL HPHV | QSKVQEELDA | VV- GKARAVA | 364 |
| SEQ_ID_NO_6 | VLWEMIFRGT | DTVAVLIEWI | LARIVVHPDV | QSRVHDELDK | VV- GKSKAVY | 372 |
| SEQ_ID_NO_10 | VLWEMIFRGT | DTVAVLIEWI | LARMVLHPDV | QSKVHDELYK | VV- GRSRAVA | 369 |

| | | | | | | | |
|---|---|---|---|---|---|---|---|
| SEQ_ID_NO_21 | ESDLSQLPYL | QAVIKENFRL | HPPTPLLSLP | HI ASESCE - | NGYHI PKGST | 389 |
| SEQ_ID_NO_36 | DLDLPKLTYL | QAIVKEITFRL | HPSTPLLSLP | RMAAESCE - | NGYHI PKNAT | 390 |
| SEQ_ID_NO_47 | EQDLTHLPYL | EAVIKETFRL | HPSTPLLSLP | RVATNSCE - | FNYHI PKGAT | 392 |
| SEQ_ID_NO_4 | DSDIPKLPYI | QAVVKEALRM | HPPGPLLSWA | RLSTEDVNMG | DGMCVPAGTT | 437 |
| SEQ_ID_NO_46 | DSDIQRLPYL | QSIVKEILRM | HPPGPLLSWA | RLAIHDVPV- | DGHMPAGTT | 321 |
| SEQ_ID_NO_39 | ESDASKLVYL | QAVIKEVLRL | HPPGPLLSWA | RLATSDVHV- | GGFL PSGTT | 433 |
| SEQ_ID_NO_40 | ESDASKLVYL | QAVIKEVLRL | HPPGPLLSWA | RLATSDVHV- | GGFL PSGTT | 435 |
| SEQ_ID_NO_27 | ESDAASLVFL | QAVVKEVLRL | HPPGPLLSWA | RLATSDVHV- | DGLHVPAGTT | 432 |
| SEQ_ID_NO_29 | ESDIASLPYL | QAVIKEVLRL | HPPGPLLSWA | RLATSDVYV- | SGYLVPAGTT | 428 |
| SEQ_ID_NO_38 | EPDGASLAYL | HAVIREVLRL | HPPGPLLSWA | RLATSDVHV- | GGYLVPAGTT | 432 |
| SEQ_ID_NO_3 | ESDVVSLVYL | TAVVKEVLRL | HPPGPLLSWA | RLAITDTI - | DGRRVPAGTT | 420 |
| SEQ_ID_NO_25 | EEDVAAMVYL | PAVIKEVLRL | HPPGPLLSWA | RLAITDTT - | DGYHVPAGTT | 438 |
| SEQ_ID_NO_22 | EDDVANMTYL | PAVVKEVLRL | HPPGPLLSWA | RLSINDTT - | DGYHVPAGTT | 413 |
| SEQ_ID_NO_6 | ESDVMNLTYL | MAVIKEVLRL | HPPGPLLSWA | RLAITDTTV- | DGYHVPKGTM | 421 |
| SEQ_ID_NO_10 | ESDITAMVYL | QAVVKEVLRL | HPPGPLLSWA | RLAITDTT - | DGYHVPKGTT | 418 |

Figure 1 (continued)

| | | | | | | | |
|---|---|---|---|---|---|---|---|
| SEQ_ID_NO_21 | LLINIWAIAR | DPDQMSDPLI | FRPERFLPGG | EKA-G---- | VDVKGNDFEL | 433 |
| SEQ_ID_NO_36 | LLVNVWAIAR | DPEVWEEPLE | FRPNRFLPGG | ERP-N---- | ADVRGNDFEV | 434 |
| SEQ_ID_NO_47 | LLVNVWAISR | DPKEMTNPLE | FKPERFLPGG | EKF-D---- | VDIRGNDFEV | 436 |
| SEQ_ID_NO_4 | AMVNMWSITH | DPNIWESPYE | FRPERFVVFE | GGE-E---- | VDVRGNDLRL | 481 |
| SEQ_ID_NO_46 | AMVNMWAITH | DECNMAEPNK | FNPDRFIDED | ---------- | VNILGSDLRL | 361 |
| SEQ_ID_NO_39 | AMVNMWAITH | DPAVWPDPNE | FKPERFVAGP | SSDQA---AE | FPIMGSDLRL | 480 |
| SEQ_ID_NO_40 | AMVNMWAITH | DPAVWPDPNE | FKPERFVAGP | SSDQA---TE | FPIMGSDLRL | 482 |
| SEQ_ID_NO_27 | AMVNMWAITH | DPTVWKPAE | FKPERFLGGS | SSDHAAAGAE | FSVTGSDLRL | 482 |
| SEQ_ID_NO_29 | AMVNMWAITH | DPSLWPEPME | FRPERFMGPA | AED------ | VPIMGSDLRL | 471 |
| SEQ_ID_NO_38 | AMVNMWAITH | DPAVWPDPAE | FKPERFAAGS | PGDEA----- | FPVMGSDLRL | 477 |
| SEQ_ID_NO_3 | AMVNMWAIAH | DPHVWENPLE | FKPERFVAKE | GEV-E---- | FSVLGSDLRL | 464 |
| SEQ_ID_NO_25 | AMVNMWAISR | DPDVWRNPLE | FNPERFVSEG | AE-------- | FSVLGSDLRL | 480 |
| SEQ_ID_NO_22 | AMVNTWAICR | DPHVWKDPLE | FMPERFVTAG | GDA-E---- | FSILGSDPRL | 457 |
| SEQ_ID_NO_6 | AVVNMWAIAR | DPQEMADPTE | FVPDRFVAKT | GEV-E---- | FSVLGSDLRL | 465 |
| SEQ_ID_NO_10 | AMVNMWAISR | DPEFMEDPLE | FMPERFVVTK | EDVLE----- | FSVLGSDLRL | 463 |

| | | | | | | | |
|---|---|---|---|---|---|---|---|
| SEQ_ID_NO_21 | IPFGAGRRID | AGLSLGLRTI | QLLTATLVHG | FEWELAGGVT | -PEKLNMEET | 482 |
| SEQ_ID_NO_36 | IPFGAGRRIC | AGMSLGLRMV | HLLTATLVHA | FNWELPEGQV | -AEKLNMDEA | 483 |
| SEQ_ID_NO_47 | IPFGAGRRIC | AGMSLGLRMV | QLLTATLAHA | YDWELENGLS | -PEKLNMDFA | 485 |
| SEQ_ID_NO_4 | APFGAGRRVC | PGKALGLATV | NLWVAKLLHH | FEWLPHAEI | --HPVDLSEV | 527 |
| SEQ_ID_NO_46 | APFGSGKRVC | PGKTMALAAV | HLMLAQLLKS | FKLLPSR-- | --NSVDLSEC | 406 |
| SEQ_ID_NO_39 | APFGSGRRSC | PGKSLAIATV | GFWVATLLHE | FDWLPLSDK | -SRGVDLSEV | 528 |
| SEQ_ID_NO_40 | APFGSGRRSC | PGKSLAIATV | GFWVATLLHE | FDWLPLSDK | -SRGVDLSEV | 530 |
| SEQ_ID_NO_27 | APFGSGRRSC | PGKSLAIATV | GFWVATLLHE | FEWIPPSSDG | -SGGVDLSEV | 531 |
| SEQ_ID_NO_29 | APFGSGRRSC | PGKSLAVATV | GFWVATLLYE | FKWLPPSDEP | RGGGVDLSEV | 521 |
| SEQ_ID_NO_38 | APFGSGRRVC | PGKSLAMATV | AFWVATLLHE | FEWLPASSDE | PPRGVDLSEV | 527 |
| SEQ_ID_NO_3 | APFGSGRRVC | PGKNLGLTTV | TFWTATLLHE | FEWLTPSDE | --KTVGLSEK | 511 |
| SEQ_ID_NO_25 | APFGSGRRSC | PGKNLGLATV | TFWAKLLHE | FEWL-PLDE | -VNGVDLTEV | 527 |
| SEQ_ID_NO_22 | APFGSGRRAC | PGKTLGMATV | NFWVASLLHE | FEWL-PSDE | --KGVDLTEV | 503 |
| SEQ_ID_NO_6 | APFGSGRRTC | PGKNLGLTTV | SFWVATLLHE | FEWL-PSDQ | --NSVDLSEV | 511 |
| SEQ_ID_NO_10 | APFGSGRRTC | PGKTLGITTV | TFWVASLLHE | YEWL-PGEE | --NNVDLSEV | 509 |

Figure 1 (continued)

| | | | | |
|---|---|---|---|---|
| SEQ_ID_NO_21 | YGITLQRAVP | LVVHPKLRLD | MSAYGLGSA | 511 |
| SEQ_ID_NO_36 | YGLTLQRAAP | LMVHPRPRLS | PQVFGK--- | 509 |
| SEQ_ID_NO_47 | YGLTLQRAVP | LAHPRPRLS | PHLYL---- | 510 |
| SEQ_ID_NO_4 | LKLSCEMARP | LHCVPVTRVP | FAKFSD--- | 553 |
| SEQ_ID_NO_46 | LKMSLEMKNP | LVCVAVPRFE | -------- | 426 |
| SEQ_ID_NO_39 | LKLSCEMATP | LEARLRPRRK | VMSV----- | 552 |
| SEQ_ID_NO_40 | LKLSCEMATP | LEARLRPRRK | V-------- | 551 |
| SEQ_ID_NO_27 | LRLSCEMAAP | LEARLRPRRA | V-------- | 552 |
| SEQ_ID_NO_29 | LRLSCEMAAP | LEARVMPRHA | VC------- | 543 |
| SEQ_ID_NO_38 | LRLSCEMAAP | LEARLMPRRA | V-------- | 548 |
| SEQ_ID_NO_3 | LRLSCEMANP | LAAKLRPRRS | FSV------ | 534 |
| SEQ_ID_NO_25 | LRLSCEMANP | LTVQVRPRR- | -------- | 546 |
| SEQ_ID_NO_22 | LKLSSEMANP | LTVKVRPRRG | -------- | 523 |
| SEQ_ID_NO_6 | LKLSCEMANP | LKVRIRPRRK | LT------ | 533 |
| SEQ_ID_NO_10 | LRLSCEMANP | LTVKVRPRRS | SQSPLY--- | 535 |

Figure 2

```
SEQ_ID_NO_67  ---------- MQLQPAVAN- --------P NTPSGAA--- ---------     17
SEQ_ID_NO_65  MDTSHWPQGI GLVKAVEPS- -----KPVPT ERKPRPQ--- ----KEQ---   34
SEQ_ID_NO_63  MGMDSSSGQQ QQMSNQSLES MLTCSKGE-Q DKKPKPP--- ----QPE---   39
SEQ_ID_NO_73  -----MDQQQ QEMSSQTLES MLVCTKPDQD QKKPRPA--- ----EQQ---   35
SEQ_ID_NO_69  -------MQEE PGRRPVPPF- -----AGVDL RRPKGYP--- -VAVAKEERP   34
SEQ_ID_NO_70  -------MQE AGRRPAPQF- -----AGVDL RRPKGYPAAA QLTPAAEEAA   37
SEQ_ID_NO_71  -------MQE AGRRPAPQF- -----AGVDL RRPKGYPAAA QLTPAAEEAA   37
SEQ_ID_NO_64  -----MPSSD SGESRRSK- --------P QNRPGAP--- --APEQE---   27
SEQ_ID_NO_75  -------MEA GQVPDGRAL- -----MAAVT TTGGGGR--- ----EPE---   27
SEQ_ID_NO_51  -------MQD ----PTGFH- ---------Q MKAPAFQ--- ----EQEQQ-   21
SEQ_ID_NO_53  -------MQD ----PSTAF- ---------H TIKPQFP--- ----EQE---   19
SEQ_ID_NO_60  -------MQD ----PLTLF- ---------Q PMKPHFP--- ----EQE---   18
SEQ_ID_NO_58  -------MQE DLTSAAAYYH HQSMI MTAKQ QQQPELP--- ----EQE---   33
SEQ_ID_NO_49  -------MQD ----PAAYY- -QTMMAKQQQ QQQPQFA--- ----EQE---   27

SEQ_ID_NO_67  ---REQCPRC ASHDTKFCYY NNYNLSQPRH FCRACRRYWT LGGSLRNVPI   64
SEQ_ID_NO_65  ---ALNCPRC NSTNTKFCYY NNYSLSQPRY FCKTCRRYWT EGGSLRNVPV   61
SEQ_ID_NO_63  ---ALKCPRC DSNNTKFCYY NNYSLSQPRY FCKSCRRYWT KGGTLRNVPV   86
SEQ_ID_NO_73  ---PQKCPRC DSANTKFCYY NNYSLTQPRY FCKSCRRYWT KGGTLRNVPV   62
SEQ_ID_NO_69  APGGDPCPRC GSRDTKFCYY NNYNLSQPRH LCKSCRRYWT KGGSLRNVPV   84
SEQ_ID_NO_70  AGVGDPCPRC ESRDTKFCYY NNYNLSQPRH FCKSCRRYWT KGGSLRNVPV   87
SEQ_ID_NO_71  AGVGDPCPRC ESRDTKFCYY NNYNLSQPRH FCKSCRRYWT KGGSLRNVPV   87
SEQ_ID_NO_64  ---NLPCPRC DSTNTKFCYY NNYNYSQPRH LCKACRRYWT HGGTLRDIPV   74
SEQ_ID_NO_75  ---GLPCPRC ESVNTKFCYY NNYNLSQPRY FCKTCRRYWT RGGALRNVPV   74
SEQ_ID_NO_51  ---QLKCPRC DSTNTKFCYY NNYNLSQPRH FCKNCRRYWT KGGALRNIPV   68
SEQ_ID_NO_53  ---QLKCPRC DSNNTKFCYY NNYNLSQPRH FCKNCKRYWT KGGALRNIPV   66
SEQ_ID_NO_60  ---QLKCPRC DSTNTKFCYY NNYNLSQPRH FCKNCRRYWT KGGALRNIPV   65
SEQ_ID_NO_58  ---QLNCPRC ASPNTKFCYY NNYNLSQPRH FCKNCRRYWT KGGSLRNIPV   80
SEQ_ID_NO_49  ---QLKCPRC DSPNTKFCYY NNYNLSQPRH FCKSCRRYWT KGGALRNVPV   74
```

Figure 2 (continued)

| | | | | | | | |
|---|---|---|---|---|---|---|---|
| SEQ_ID_NO_67 | GGSTRKRLRP | APQQTMRRPP | VHFGAP- -P | PPPMPA- - - | - - - - - - - - - | | 97 |
| SEQ_ID_NO_65 | GGGSRKNKRS | SSSSNNSSSS | - - -TSS- - -S | YKKIPDLT- - | - - - - - - - - - | | 113 |
| SEQ_ID_NO_63 | GGGCRKNKRS | SSASSKRSQD | - - - -QPFQTN | PNPLTCFPSL | SYDSNDLTLA | | 132 |
| SEQ_ID_NO_73 | GGGCRKNKKL | SSTTSAKRSS | QDNISPNISN | PIPSYDSSTD | LSLAFARLQK | | 132 |
| SEQ_ID_NO_69 | GGGTRKSSSS | SSSSSAAAAA | - - - -TTTTTS | TSPGAAPK- - | -ATKRSKNSK | | 127 |
| SEQ_ID_NO_70 | GGGSRKSSTS | SSSSSSAAAA | - - - -SS- - -S | SSPSSPAK- - | -SPKRSKNSK | | 127 |
| SEQ_ID_NO_71 | GGGSRKSSTS | SSSAAAAAAS | - - - - -S- - -S | SSPSSPAK- - | -SPKRSKNSK | | 126 |
| SEQ_ID_NO_64 | GGGTRKNAKR | SRTHHVAVTS | - - - -SS- - -S | SSAVT- - - - | - - - - - - - - - | | 102 |
| SEQ_ID_NO_75 | GGNTRKATPA | TGRRKRSTPA | - - - - -P- - -V | NVTVPAP- - - | - - - - - - - - - | | 103 |
| SEQ_ID_NO_51 | GGGTRKGTKR | SSSSTNKPKR | - - - -QP- - -N | PSPDPTPNQK | -IPDPSPPPP | | 110 |
| SEQ_ID_NO_53 | GGGSRKNTKR | SSNTKRANPD | - - - - -P- - -N | PDPVKPTR- - | - - - - - - - - - | | 96 |
| SEQ_ID_NO_60 | GGGSRKNTKR | SSSSNNNTKR | - - - - - - - - - | ASPSPPVS- - | - - - - - - - - - | | 93 |
| SEQ_ID_NO_58 | GGGTRKNSSK | RSSVGSSSSA | - - - -PS- - -S | SSPKSKTV- - | - - - - - - - - - | | 111 |
| SEQ_ID_NO_49 | GGGSRKNATK | RSTSSSSSAS | - - - -SP- - -S | NSSQNKKT- - | - - - - - - - - - | | 105 |

| | | | | | | |
|---|---|---|---|---|---|---|
| SEQ_ID_NO_67 | -QSHSQQAPQ | GGLLSSLFAF | GAAPLFEGRV | GE- - - -D- - | LGLGLPGLSQ | 139 |
| SEQ_ID_NO_65 | -IPTSSQNPK | IINEPHDLNL | AFNPSATSNF | SNISEFMA- - | LPLMNPNSTT | 160 |
| SEQ_ID_NO_63 | LARLQKGHLG | FDHEHDFSIL | GNQTNTSCG | LNN- - - - - - | HGMNHSSNNQ | 175 |
| SEQ_ID_NO_73 | QTNAHLEIDQ | EHDNNNMSMM | YNTGNNCTST | TELDALRGG- | FLENAPNHPG | 181 |
| SEQ_ID_NO_69 | RRRVAPAPDP | AAPGTDASTA | DVASTAPSTV | - - - - - - - - - | AASEKPSATE | 167 |
| SEQ_ID_NO_70 | RRRVSPPPPQ | PAP- - - - - - - | APPPPTTADA | - - - - - - - - - | ADVAAPTAPE | 160 |
| SEQ_ID_NO_71 | RRRVSPPPPQ | PVP- - - - - - - | APPPPTTADA | - - - - - - - - - | ADVAAPTAPE | 159 |
| SEQ_ID_NO_64 | -SAPEQNYP- | - - - - - - - - - - | SMTP1OGGSF | PY- - - - - - - | GGVDGEGKQN | 132 |
| SEQ_ID_NO_75 | -ATASPPPPP | ALHGGSLLRP | YGGGGGSGLL | SFAAPALASP | LAAADPDRRL | 152 |
| SEQ_ID_NO_51 | KSSSSSMFPQ | QIVLNSGAQN | SDSDIDSTRM | -Y- - - -L- - | LPVDHQDGKM | 152 |
| SEQ_ID_NO_53 | -RVADSSSSS | ATSSTSGQQL | AGNGNQDPTR | VY- - - - - - - | GVEADPDRKI | 137 |
| SEQ_ID_NO_60 | -SAPAPEPDP | TRI- - - - - - - | - - - - - - - - - | - - - - - - - - - | GPTPVVG- - - | 112 |
| SEQ_ID_NO_58 | -AVSDQESRT | TGN- - - - - - | SGQEMDPTRM | LY- - - -G- - | LPVGDPS- - | 143 |
| SEQ_ID_NO_49 | -KNPDPDPDP | RNS- - - - - - | QKPDLDPTRM | LY- - - -G- - | FPLSDQDVKG | 140 |

Figure 2 (continued)

| SEQ_ID_NO_67 | VGLGGGAG- - | - - E - - - - - - - | - - FGLHSLGL | RGGHAGT- - - | - - - - - SA- - - | 165 |
|---|---|---|---|---|---|---|
| SEQ_ID_NO_65 | SFMSSIMP- - | - - QLSDSNNI | M- YSSSSTGL | PNLHDLK- - - | - - - - - PTLNF | 197 |
| SEQ_ID_NO_63 | GFFEALMG- - | - - SQNNVQNL | YYMGEVDNGN | ANGNGNGEMM | LPYDHEMSIA | 221 |
| SEQ_ID_NO_73 | LFHHNMYNYA | NMGQLVENGE | MGMSYQQDQM | SIGTSTTMMT | TIVKQEMCNM | 231 |
| SEQ_ID_NO_69 | HAAAAVAT- | - - EKPPAAPP | VSVGAFADTS | PAPDAGS- - - | - - - - - - - - - - | 200 |
| SEQ_ID_NO_70 | DTTKKAPE- - | - - DLTAAAAT | QPAVALGLGV | ADGGGGG- - - | - - - - - K- - - - | 194 |
| SEQ_ID_NO_71 | ATTKKAPE- - | - - DLTAAAAT | QPAVALGLGV | ADGGGGG- - - | - - - - - - - - - - | 192 |
| SEQ_ID_NO_64 | MSVCGSFT- | - - SLLNNNPQ | QNSGFLALGG | FGLGLGH- - - | - - - - - GL- - - | 167 |
| SEQ_ID_NO_75 | LDFGGSFT- | - - SLIAPGVA | DVGVHFSAGF | LMGGLAP- - - | - - - - - AALPR | 190 |
| SEQ_ID_NO_51 | MDIGGSFS- | - - SLLASTGQ | - - FGNLLEGF | NSNGSGL- - - | - - - - - KT- - L | 186 |
| SEQ_ID_NO_53 | LDMGGSFS- | - - SLLASSGQ | - - FGSIFEGL | DSGGSGL- - - | - - - - - KMVRM | 173 |
| SEQ_ID_NO_60 | - - - GGSFS- | - - SLLASSGH | LGLGNLLEGL | NSSGSNL- - - | - - - - - KTVQM | 147 |
| SEQ_ID_NO_58 | - - - GGRFS- | - - SLLVSNMQ | QIRGVNYET- | - - - GSG- - - | - - - - - - - - - - | 168 |
| SEQ_ID_NO_49 | MEIGGSFS- | - - SLLANNMQ | - - LGLGGGGI | MLDGSG- - - | - - - - - - - - - - | 170 |

| SEQ_ID_NO_67 | - - - - - - - - - - | - - - - - - - - - - | PMLH PTAFL | D- - - - - - - - - | - NGNVDTMKV | 184 |
|---|---|---|---|---|---|---|
| SEQ_ID_NO_65 | SL- - DGFDNN | - - - - - NGYGS | LQGE- TAGKK | LFFPLDDLKN | VSTPNDDHEF | 239 |
| SEQ_ID_NO_63 | TTQAVTVTTM | KQEMCNVREQ | NENRVLLGFP | WQFNNGDTNM | AEMDII- - - - - | 266 |
| SEQ_ID_NO_73 | ARSTEGHDLN | - - - - NSNNN | NKV- - LCGFP | WQQMNGDHHV | NNMNTNDFEY | 274 |
| SEQ_ID_NO_69 | - - - - GGVREL | - - - - - LPHPS | RFEM PSGCN | LG- - - - - - - - | - - - - - - - - - - | 222 |
| SEQ_ID_NO_70 | - - - - EHLDTS | - - - - - P- - - - | - FEM PSGCD | L| - - - - - - - - - | - - - - - - - - - - | 210 |
| SEQ_ID_NO_71 | - - - KEHLDTS | - - - - - P- - - - | - FEM PSGCD | L| - - - - - - - - - | - - - - - - - - - - | 209 |
| SEQ_ID_NO_64 | - - - - GDMGFG | - - - - - IGR- - | - - EMSFPGMM | DGSNMGVPVV | SSGIGNSMQL | 204 |
| SEQ_ID_NO_75 | AP- - GSVAAL | - - - - - PPPPP | QQQP- TVSQA | L| - - - - - - - - | - - - - - - - - - - | 213 |
| SEQ_ID_NO_51 | NHFGGNFDSG | - - - - - CEMDQ | NSGR- DPLFG | E- - - - - - - - - | SSKNGESYLD | 221 |
| SEQ_ID_NO_53 | GGFGEDLNAG | - - - - - PSR- - | - - - - - NPGLD | LQGSSNNNTT | NDGGGESY- | 209 |
| SEQ_ID_NO_60 | EEFGENVSSG | - - - - - PVADP | DSGR- NPGLE | MD- - - - - - - - | SNGNAENFLS | 183 |
| SEQ_ID_NO_58 | - - - - - - - - - - | - - - - - - - - - - | - - - M YPGME | LG- - - - - - - - | - - - - - - - - - - | 176 |
| SEQ_ID_NO_49 | - - - - - - - - - - | - - - - - - - - - - | - - - MDHPGMG | LGL- - - - - - - | - - - - - - - - - - | 180 |

Figure 2 (continued)

| | | | | | | | |
|---|---|---|---|---|---|---|---|
| SEQ_ID_NO_67 | ----SGGGA A | AMWAPEFSPA | PTVADVGGNG | MFHGGAQI MG | QL | | 222 |
| SEQ_ID_NO_65 | D------EQN | RGQAAESHGF | WNG------ | M GGGS---- | -- | | 262 |
| SEQ_ID_NO_63 | ------LGR | AGWNGLTSSW | GHGL------ | LNSPLM---- | -- | | 289 |
| SEQ_ID_NO_73 | STN----KQS | WNGFGGSSNW | HGL------- | NSPLM---- | -- | | 299 |
| SEQ_ID_NO_69 | -------PPY | WGWGTSVFAD | TDPA------ | LFLNLP---- | -- | | 245 |
| SEQ_ID_NO_70 | ---------G | PYWPTGVFAD | TDPS------ | LFLNLP---- | -- | | 231 |
| SEQ_ID_NO_71 | ---------G | PYWPTGVFAD | TDPS------ | LFLNLP---- | -- | | 230 |
| SEQ_ID_NO_64 | EGGE---TGF | VGGGGDCFSW | PGLA------ | STPGNGLK- | -- | | 234 |
| SEQ_ID_NO_75 | ------PEG | MVW---SNGW | PDLS------ | ---------- | | | 228 |
| SEQ_ID_NO_51 | V---QGGRDT | SCWSGDSNGW | PDLS------ | YTPGSSLRR | -- | | 252 |
| SEQ_ID_NO_53 | ------LQG | GEWGNSNNGW | PGLA------ | YTPGSSFQ- | -- | | 235 |
| SEQ_ID_NO_60 | LQN----GDS | SCW NGTSGW | SHLA------ | FTPGSSFQ- | -- | | 211 |
| SEQ_ID_NO_58 | ------LGS | GI RRNDDAAL | TDLA------ | MNRVEKN-- | -- | | 200 |
| SEQ_ID_NO_49 | ------RRT | EPGNNNNNPW | TDLA------ | MNRAEKN-- | -- | | 204 |

Figure 3

| | | | | | | | |
|---|---|---|---|---|---|---|---|
| SEQ_ID_NO_88 | MAST----- | ---------- | -----RRVQ | C--LMRRFYR | ---GSRTFGV | | 23 |
| SEQ_ID_NO_95 | MTSL----- | ----QSFLAV | KPAAAGWAAG | ARPAAAPDSR | RARVSACLAA | | 40 |
| SEQ_ID_NO_90 | MNSL----- | ----QSFLAV | APVK--PAAA | A--ARLPSSR | RARVSACLAT | | 36 |
| SEQ_ID_NO_93 | MNSL----- | ----QSFLAL | NPPAAAAALG | G--ARLRPSR | ---VTACLAT | | 35 |
| SEQ_ID_NO_80 | MGSL----- | ----KLFPSF | SLSV--SPAT | N--LRRPLNN | GR-VNASLNM | | 35 |
| SEQ_ID_NO_87 | MGAVYFSQSC | YKPRQFNLE | RESTLVGRCP | V--VQFRCRR | V--VSACLNV | | 46 |
| SEQ_ID_NO_77 | MASL----- | ---GQTLPR | APS---SEIG | L--LRRRFER | PI-IRTRIGF | | 35 |
| SEQ_ID_NO_92 | MASL----- | ---GQTLPR | APS---LQKG | L--LRRP--- | ---IRTPIRF | | 30 |
| SEQ_ID_NO_78 | MTSL----- | ----QYFSLN | RPV---FPAT | H--LHRPGIR | HLQVSACANV | | 35 |
| SEQ_ID_NO_82 | MGSL----- | ----QHFLNS | PISVPFSPNL | N--HRRSFF- | ---LRACLNL | | 34 |
| | | | | | | | |
| SEQ_ID_NO_88 | ATQPNA--- | ---------- | ----SSSSQT | IDKEFQHSA | HNYHPLPIVF | | 55 |
| SEQ_ID_NO_95 | PPPPPT--- | -TAASAVGPA | RRELSAASRA | VMDDEARYLV | GTYKRSRVVF | | 85 |
| SEQ_ID_NO_90 | PAPAPT--- | -----APAAA | RRELSAASRA | VMADEAKYIV | GTYKRAQVVE | | 77 |
| SEQ_ID_NO_93 | PTPTPPPPTS | APLAPAAAAA | RRELSAASRA | VVEDEARYIV | GTYNRSRVVL | | 85 |
| SEQ_ID_NO_80 | DVEAPN--- | --------P | LKLKSNGSNE | VIEKDAKFIV | GTYARAPVVL | | 72 |
| SEQ_ID_NO_87 | DVDAPN--- | --------TGN | TTSEKKKTKD | VIEMEGMYLV | GTYARTPVVL | | 85 |
| SEQ_ID_NO_77 | NGRAS---- | -VLTNAGDQA | VSVKASVSQK | VIEEEAKNV | GTYARAPVVL | | 80 |
| SEQ_ID_NO_92 | NGRAS---- | -VLTNAG--- | -SVKASVSQK | VIEEEAKVLV | GTYARAPVVL | | 71 |
| SEQ_ID_NO_78 | EVQAPS--- | ---------- | SVKKDGVSKE | VMEAAGRVLV | GTYARVPVVL | | 71 |
| SEQ_ID_NO_82 | DVHAPD--- | --------SV | KPKTHLKSRE | VMEMEGKVLV | GTYARNPVVI | | 72 |
| | | | | | | | |
| SEQ_ID_NO_88 | AHAKGSAVWD | PEGNKYIDFL | SGYSAVNQGH | CHPKILKALK | NQAGRLTVSS | | 105 |
| SEQ_ID_NO_95 | EYGRGCKLYD | VDGREYLDMS | AGIAVTALGH | ADPDVCATLA | EQSGKIVHVS | | 135 |
| SEQ_ID_NO_90 | VAGRGCKLYD | IDGREYLDMA | AGIAVNALGH | GDPDVDAAAA | DQRGRLVHAS | | 127 |
| SEQ_ID_NO_93 | VAGRGCKLYD | ADGREYLDMA | AGIAVNALGH | ADPDWAAVS | AQAATLVHAS | | 135 |
| SEQ_ID_NO_80 | SSGKGCKLYD | PEGREFLDCA | AGIAVNALGH | GDPDWLRAVT | EQASILTHVS | | 122 |
| SEQ_ID_NO_87 | ERGEGCKLYD | VEGNEYLDLS | AGIAVNALGH | GDADWLKAVV | EQAGTLTHTS | | 135 |
| SEQ_ID_NO_77 | SSGKGCKLFD | PEGKEYLDCA | SGIAVNALGH | GDPDWLRAVT | EQAGVLAHVS | | 130 |
| SEQ_ID_NO_92 | SSGKGCKLMD | AEGKEYLDCA | SGIAVNALGH | GDPDWLQAVT | DQASVLSHVS | | 121 |
| SEQ_ID_NO_78 | SRGKGCKLYD | PEGREYLDLS | AGIAVNMLGH | ADSDWLRAVT | EQAATLTHVS | | 121 |
| SEQ_ID_NO_82 | SSGKGCKLYD | PEGREYLDCT | SGIAVNALGH | GDPDWKAVV | EQANLLTHVS | | 122 |

Figure 3 (continued)

| | | | | | | | |
|---|---|---|---|---|---|---|---|
| SEQ_ID_NO_88 | RAFYNDRFPV | FAEYSTALFG | YDMVLPINTG | AEGVETALKL | ARKAGYDKKK | | 155 |
| SEQ_ID_NO_95 | NVFYTTPQVE | LAKRLVEVSF | ADRAFFASTG | TEANEAAIKF | SRK--FQRVA | | 183 |
| SEQ_ID_NO_90 | NVGYTVPQVE | LAKRLVEASF | ADRAFFANSG | TEANEAAIKF | ARK--YQRVA | | 175 |
| SEQ_ID_NO_93 | NVQYTVPQVA | LAKRLVEASF | ADRVFFANTG | TEANEAAIKF | ARK--FQRVA | | 183 |
| SEQ_ID_NO_80 | NAYYSIPQ- | ---------- | ---------- | ---------- | ---------- | | 130 |
| SEQ_ID_NO_87 | NIFHTIPQVE | LAKRLVASSF | ADRVFFANSG | TEANEAAIKF | ARK--YQRHT | | 183 |
| SEQ_ID_NO_77 | NVYYTIPQIE | LAKRLVASSF | ADRVFFCNSG | TEANEAAIKF | SRK--FQRFT | | 176 |
| SEQ_ID_NO_92 | NVYYTIPQIE | LAKRLVASSF | ADRVFFCNSG | TEANEAAIKF | SRK--FQRFT | | 169 |
| SEQ_ID_NO_78 | NVFYSIPQVE | LAKRLVASSF | ADRVFFSNSG | TEANEAAIKF | ARK--FQRFT | | 169 |
| SEQ_ID_NO_82 | NVFYSVPQVE | LAKRLVACSF | ADRVFFTNSG | TEANEAAIKF | ARK--YQRFT | | 170 |
| | | | | | | | |
| SEQ_ID_NO_88 | IPNDEAL--- | IVSCCGCFNG | RTLGVI3MSC | DNEATRGFGP | LIPGHLKVDF | | 202 |
| SEQ_ID_NO_95 | HPDSDDPPME | FLAFSSSFHG | RTMGAVALTS | KSDYREPFAP | VMPGVTFVDY | | 233 |
| SEQ_ID_NO_90 | HPNGDAPL-TE | FMSFTNCFHG | RTIGSLALTS | KVQYREPFEP | VMPGSTFVEY | | 224 |
| SEQ_ID_NO_93 | RPDGDAPL-TE | FMSFTNCFHG | RTMGSLALTS | KVQYREPFAP | VMPGATFAEY | | 232 |
| SEQ_ID_NO_80 | ---------- | ---------- | ---------- | ---------- | ---------- | | 130 |
| SEQ_ID_NO_87 | TSNGKVPATE | FIAFSNCFHG | RTLGALALTS | KVQYRMPFEP | VMPGVTFLEY | | 233 |
| SEQ_ID_NO_77 | HPEDKEVATG | FIAFTNSFHG | RTLGALALTS | KEQYRTPFEP | IMPGVTFLEY | | 228 |
| SEQ_ID_NO_92 | HPEDKEVATS | FIAFTNSFHG | RTLGALALTS | KEQYRTPFEP | IMPGVTFLEY | | 219 |
| SEQ_ID_NO_78 | RPDEKQPATE | FVSFSNSFHG | RTMGSLALTS | KENYRSPFEP | VMPGVTFLEY | | 219 |
| SEQ_ID_NO_82 | NPEKQQA-TE | FISFSNSFHG | RTMGALALTS | KEQYRFPFEP | VMPGVNFLEY | | 219 |
| | | | | | | | |
| SEQ_ID_NO_88 | GDAEALEKIL | KEKGDAIAAF | ILEPIQGEAG | VKIPPDGYLK | AVRDLCSKYN | | 252 |
| SEQ_ID_NO_95 | GDLEAAKKF | --QSGRVAAV | FVEPVQGEGG | HSATQEFLQ | GLREACDEAG | | 281 |
| SEQ_ID_NO_90 | GNLEEAKKVI | --QSGKIAAV | FVEPVQGEGG | HSATNEFLQ | GLRDACDEAG | | 272 |
| SEQ_ID_NO_93 | GNLEEAKKVI | --QSGKIAAV | FVEPVQGEGG | HSATKEFLQ | GLRDACDEAG | | 280 |
| SEQ_ID_NO_80 | ---------- | ---------- | ---------- | ---------- | ---------- | | 130 |
| SEQ_ID_NO_87 | GNADAAVELI | --KQGKIAAV | FVEPIQGEGG | YSATKEFLQ | SLRNACDETG | | 281 |
| SEQ_ID_NO_77 | GNIQAATDLI | --RSGKIAAV | FVEPIQGEGG | YSATKEFLQ | SLRSACDAAG | | 276 |
| SEQ_ID_NO_92 | GNTDAATDLI | --RSGKIAAV | FVEPIQGEGG | VYSATKEFLQ | SLRSACDAAG | | 267 |
| SEQ_ID_NO_78 | GNIEAATQLI | --QRRKIAAV | FVEPIQGEGG | VYSATKEFLY | ALRKACDDSG | | 267 |
| SEQ_ID_NO_82 | GDVQAATELI | --KSGRIAAV | FVEPIQGEGG | YSATKEFLQ | SLRSACDDAG | | 267 |

Figure 3 (continued)

| | | | | | | | |
|---|---|---|---|---|---|---|---|
| SEQ_ID_NO_88 | VLMIADEIQT | GLARTGKMLA | CEWEEVRPDV | VVLGKALGGG | I PVSAVLAD | 302 |
| SEQ_ID_NO_95 | ALLVFDEVQC | GFGRTGYLWA | HEAYGVEPDI | MTLAKPLANG | -L PIGVVLVK | 330 |
| SEQ_ID_NO_90 | ALLVFDEVQC | GLGRTGYLWA | HEVYGVLPDI | MTLAKPLANG | -LPIGVALVT | 321 |
| SEQ_ID_NO_93 | ALLVFDEVQC | GLGRTGYLWA | YEAYGVLPDI | MTLAKPLAGG | -LPIGVVLVT | 329 |
| SEQ_ID_NO_80 | -------VQC | GLGRTGYLWA | HEAYGVFPDM | MTLAKPLAGG | -LPIGATLVS | 172 |
| SEQ_ID_NO_87 | ALLVFDEVQC | GLGRSGFLWA | HEAYGVFPDM | MTLAKPLAGG | -LPIGALLVT | 330 |
| SEQ_ID_NO_77 | SLLVFDEVQC | GLGRTGLMWA | YEAFGVTPDI | MTVAKPLAGG | -LPIGAVLVT | 325 |
| SEQ_ID_NO_92 | SLLVFDEVQC | GLGRTGNLWA | YEAFGVTPDI | MTVAKPLAGG | -LPIGAVLVT | 316 |
| SEQ_ID_NO_78 | TLLVFDEVQC | GLGRTGYLWA | HEIYDVFPDI | MTLAKPLAGG | -LPIGAVLVT | 316 |
| SEQ_ID_NO_82 | SLLVFDEVQC | GLGRTGYLWA | HEAYGVVPDI | MTLAKPLAGG | -LPIGAALVS | 316 |

| | | | | | | | |
|---|---|---|---|---|---|---|---|
| SEQ_ID_NO_88 | KEVMLCIKPG | QHGSTFGGNP | LASAVAIABL | EVIKEERLAE | RSTKLGGELL | 352 |
| SEQ_ID_NO_95 | EKVAAAINYG | DHGTTFGGGP | LACQTAITVF | DKIMKPGFLA | EVSKKGENFK | 380 |
| SEQ_ID_NO_90 | EKVAAAIHYG | DHGTTFGGGP | FVCHAALATL | DKIQKPGFLA | EVTKKGEYFK | 371 |
| SEQ_ID_NO_93 | EKVASAINFG | DHGTTFGGGP | LVCQAALTTL | DKIQKPGFLA | EVAKKGENFK | 379 |
| SEQ_ID_NO_80 | ERVASAIAHG | DHGSTFAGSP | FVCSAAICVF | NKISNPSFLS | SVLKKGDYMK | 222 |
| SEQ_ID_NO_87 | ERVASAINYG | DHGSTFAGSP | LVCSAALAVL | DKISKPDFLS | SVSKKGLYFK | 380 |
| SEQ_ID_NO_77 | EKVAETINYG | DHGSTFAGSP | LVCSAAIAVM | DKVSKPSFLS | SVSNKGRYFR | 375 |
| SEQ_ID_NO_92 | EKVAETIKYG | DHGSTFAGNP | LVCSAAIAVF | DKVSKSSFLA | SVSSKGLYFK | 366 |
| SEQ_ID_NO_78 | ERVASAITYG | DHGTTFAGGP | LVCKAALTVL | DKILRPGFLA | SVSKKGHYFK | 366 |
| SEQ_ID_NO_82 | EKVAAAIKYG | DHGSTFAGGP | LVCNAAIAVL | DKISKPGFLA | SVSEKGQYFK | 366 |

| | | | | | | | |
|---|---|---|---|---|---|---|---|
| SEQ_ID_NO_88 | GLLEKIQKQY | PDHVKEVRGR | GLFIGVELNS | ESLSPVSFFE | LSEKLKDRGV | 402 |
| SEQ_ID_NO_95 | QLLRTKLSGN | P-HVKEVRGV | GLLVGIELD- | -----VPAGP | LVDACLDAGV | 423 |
| SEQ_ID_NO_90 | QLLKTKLGGN | P-HVKEIRGA | GLIVGIELD- | -----VPAGP | LVDACLDAGV | 414 |
| SEQ_ID_NO_93 | QLLSTKLSGN | A-HVKEIRGI | GLIVGIELD- | -----VPAGP | LVDACLDRGV | 422 |
| SEQ_ID_NO_80 | ELLNQKLGGN | P-HVKEIRGW | GLMIGIELD- | -----VSASP | LVDACRNSGL | 265 |
| SEQ_ID_NO_87 | ELLREKLGEN | R-HVKEIRGV | GLIIGIDLD- | -----VPASP | LVDACRSSGL | 423 |
| SEQ_ID_NO_77 | DLLVKKLGGN | S-YVKEVRGE | GLIIGVELD- | -----VPASS | LVDACRDSGL | 418 |
| SEQ_ID_NO_92 | DLLVKKLGGN | L-HVKEVRGE | GLIIGVELD- | -----VPAGP | LVDACRDSGL | 409 |
| SEQ_ID_NO_78 | EMLINKLGGN | S-HVREVRGV | GLIVGIELD- | -----VSASP | LVNACLNSGL | 409 |
| SEQ_ID_NO_82 | ELLIHKLGGN | S-HVREVRGL | GLIIGIELD- | -----VSASP | LVDACRDSSL | 409 |

Figure 3 (continued)

| | | | | | | | |
|---|---|---|---|---|---|---|---|
| SEQ_ID_NO_88 | LAKST-HDT | RFTPPLCIS | ADEIQQGSKA | LADVLEIDLP | MLKKMKPKDA | | 451 |
| SEQ_ID_NO_95 | LVLTAGKGNV | VRLVPPLIIS | EKELEHA--- | -ADVIRDCLP | VLDVAAA--- | | 466 |
| SEQ_ID_NO_90 | FLLTAGKGNV | VRLVPALIVS | EKELEQA--- | -AEVIRECLP | ALEASTS--- | | 457 |
| SEQ_ID_NO_93 | IVLTAGKGNV | VRLVPPLIIS | EKELEQA--- | -AEVIRDCLP | ALDASTS--- | | 465 |
| SEQ_ID_NO_80 | LVLTAGKGNV | VRLVPPLIIS | EEELKHA--- | -AEILHECLP | ALDNSN---- | | 307 |
| SEQ_ID_NO_87 | LVLTAGKGNV | VRLVPPLIIT | EKELEQA--- | -AEILCDTLP | VLDN------ | | 463 |
| SEQ_ID_NO_77 | LILTAGKGNV | VRIVPPLVIS | EEEIERA--- | -VEIMADNLT | ALD------- | | 457 |
| SEQ_ID_NO_92 | LILTAGKGNV | VRIVPPLIIS | EEEIERA--- | -VEIFHDLT | ALD------- | | 448 |
| SEQ_ID_NO_78 | LVLTAGKGNV | VRIVPPLIIT | EQELEKA--- | -AEILLQCLP | ALDRHG---- | | 451 |
| SEQ_ID_NO_82 | LILTAGKGNV | VRLVPPLIIS | EQELERA--- | -AEILLECLP | ALDKTS---- | | 451 |

| | | | |
|---|---|---|---|
| SEQ_ID_NO_88 | APPAGPSACD | RCGRVVYG | 469 |
| SEQ_ID_NO_95 | ---------- | -------- | 466 |
| SEQ_ID_NO_90 | ---------- | -------- | 457 |
| SEQ_ID_NO_93 | ---------- | -------- | 465 |
| SEQ_ID_NO_80 | ---------- | -------- | 307 |
| SEQ_ID_NO_87 | ---------- | -------- | 463 |
| SEQ_ID_NO_77 | ---------- | -------- | 457 |
| SEQ_ID_NO_92 | ---------- | -------- | 448 |
| SEQ_ID_NO_78 | ---------- | -------- | 451 |
| SEQ_ID_NO_82 | ---------- | -------- | 451 |

Figure 4

```
SEQ_ID_NO_101   -MSETEAAPV VA-------- -----PAAEA APAAEAPK-- AKAPKAKAPK   34
SEQ_ID_NO_102   --MATTEAVE EP-------- ----VPVEAT ANEDAKPTE- EKPAKEKKPK   35
SEQ_ID_NO_150   --MASTDPPA DT-------V PAEPVANEDV KAAEEKPI-- VKAPKEKKVK   38
SEQ_ID_NO_118   --MALDTPVS AP-------- -----VVPEV TERKSKRG-- TKAAAVKVPK   32
SEQ_ID_NO_145   --MATTVAIE TP-------- --------AFT PVAVDPPA-- AKPAKAKKAK   31
SEQ_ID_NO_149   --MSAAVAIE TP-------- ------AFAPV PVARDEPV-- AKPGKVTKAK   33
SEQ_ID_NO_144   --MATDETTD PR-------- ---------PV- AKSKKAKAPK   22
SEQ_ID_NO_125   --MSTDVAAD VP----APEV EVAADPVVET TAEAAAGD-- AKPAKETKAK   42
SEQ_ID_NO_137   --MATEVAET PA-------- ---PLAEAVP ETPAEAPA-- APAAEANST-   34
SEQ_ID_NO_146   --MATDVAAT EP-------- -----EVAAE EAAAAAPETT ATAGDSKPAK   35
SEQ_ID_NO_147   --MATDVAAT EP-------- -----EVAAE EAAAAAPETT ATAGDSKPAK   35
SEQ_ID_NO_119   -MAAVEDPIV PM-----EGV EEEYPVTVTE APEEAAPP-- AEDPAPKKGK   42
SEQ_ID_NO_100   --MSIEEENV PT-------T VDSGAADTTV KSPEKKPA-- AKGGKSKKTT   39
SEQ_ID_NO_113   --MSTEEETK VV-------- ---VESGDAEA TVTEKKPA-- AKGGAKAKKT   36
SEQ_ID_NO_104   --MATEEPAV VA-------- --DPAPETEED KTAETKAT-- SKSGRAKKTK   37
SEQ_ID_NO_108   --MSSDEPTV AV-------- -DGSTEPTSA EPADDKPA-- AKPSRAKKTK   37
SEQ_ID_NO_116   MTSSVEEPTV SAVEQTIVEE PAAVDPLPPV VNESDEPT-- AAKPKL----   43
SEQ_ID_NO_117   --MASEEPTT VAVEQPIVEE PEAVDTFPPV VNESEEPT-- AKPKKAPK-   44
SEQ_ID_NO_122   --MATEEPLV VT-----EIV TEAVVVEAEP AKEENSPA-- AEPDEPKKEK   41
SEQ_ID_NO_120   --MATEEPVI VN-------E VVEEQAAPET VKDEANPP-- AKSGKAKKET   39

SEQ_ID_NO_101   QPKAPKAPKE PKAPKEKKPK AAPTHPPYI E MVKDAITTLK ERNGSSLPAL   84
SEQ_ID_NO_102   TP----KEKK PRAAKGS--K PPAHPPYVQ MIAEAITALK ERGGSSPYAI   79
SEQ_ID_NO_150   TP----KEKK PKAAKGS--K PPPAHPPYFQ MISEAIVALK ERGGSSPYAI   82
SEQ_ID_NO_118   -----EKKK VIAAKKPKSK GTSSHPSFFE MISDAISTLK ERTGSSQYAI   76
SEQ_ID_NO_145   VP----KEKK ASVAKL---- -PALHPTYLE MISEAIASLK ERTGSSQIAI   71
SEQ_ID_NO_149   AP----KEKK ASVAKKP--- --ALHPTYLE MISEAIASLK ERTGSSQYAI   74
SEQ_ID_NO_144   EA----RAKK AAAPRKP--- --SAHPPYAE MIKEAITTLK ERTGSSPYAI   63
SEQ_ID_NO_125   AA----KAKK PSAPRKP--R ATPAHPTYAE MVSEAITALK ERTGSSQYAI   86
SEQ_ID_NO_137   -----KAKK ASAPKK---R ANPTHPPYAE MISEAVTSLK ERTGSSQYAI   75
SEQ_ID_NO_146   EA----KAKK AAAPRKA--R STATHPPYAE MISEAIATLK ERTGSSQYAI   79
SEQ_ID_NO_147   EA----KAKK AAAPRKA--R STATHPPYAE MISEAIATLK ERTGSSQYAI   79
SEQ_ID_NO_119   EL----KPKK AAAPRKP--R SAPAHPPYLE MITDAITSLK ERTGSSQAI   86
SEQ_ID_NO_100   TAKATKKPVK AAAPTKK--K TTSSHPTYEE MIKDAIVTLK ERTGSSQYAI   87
SEQ_ID_NO_113   PA----KKKP AAAPRK---R TTGSHPYEE MIKDAIVTLK ERTGSSQYAI   79
SEQ_ID_NO_104   EP----KTKK AAAPRKP--R AAPTHPPYEE MIKDAIVTLK ERTGSSQYAI   81
SEQ_ID_NO_108   EP----KAKK APAPKKPRHR TPSSHPPYEE MIKDAIVTLK ERTGSSQYAI   83
SEQ_ID_NO_116   -----KAPK EPKPRKPASK NTRTHPTYEE MVTDAIVTLK EKNGSSQYAL   87
SEQ_ID_NO_117   -----EPKA KKAPAKP--- --RTHPTYEE MVKEAIVALK ERNGSSQYAI   83
SEQ_ID_NO_122   EI----EAKK PAAPRK---R NPPTHPSYFE MIKDAIVTLK DKTGSSQHAI   84
SEQ_ID_NO_120   -----KAKK PAAPRKR--S ATPTHPPYFE MIKDAIVTLK ERTGSSQHAI   81
```

Figure 4 (continued)

| | | | | | | | |
|---|---|---|---|---|---|---|---|
| SEQ_ID_NO_101 | KKFIENKYGK | DIHDKNFAKT | LSQVVKTFVK | GGKLVKVKGS | FKLSE---- | | 129 |
| SEQ_ID_NO_102 | AKFLGDKYK | ADLPPNFKKQ | LNVQLKNLTK | SGKLTKVKAS | YKLTA---- | | 123 |
| SEQ_ID_NO_150 | AKFLSEKYK | SDLPPVFKKK | LNVQLRNLTN | SGKLTKVKGS | YKLAE---- | | 126 |
| SEQ_ID_NO_118 | NKFVEDKHK | Q-LPSNFRKL | LLFHLKKLVA | SGKLVKVKNS | FKLPS---- | | 119 |
| SEQ_ID_NO_145 | SKFVENKHK | AHLPANFKKL | LLVQLRKLTA | AGKLTKVKNS | YKISA---- | | 115 |
| SEQ_ID_NO_149 | AKFVEDKHK | SHLPANFKKL | LLVQLQKLTA | AGKLTKVKNS | YKISA---- | | 118 |
| SEQ_ID_NO_144 | GKFIEDKHK | AHLPSNFRKI | LFLQLKKLAA | AGKLTKVKSS | YKLST---- | | 107 |
| SEQ_ID_NO_125 | AKFVEDKHK | AHLPANFRKI | LSVQLKKLVA | SGKLTKVKAS | YKLSA---- | | 130 |
| SEQ_ID_NO_137 | AKFVEDKHK | DKLPPNFRKL | LLGQLKKLVA | AGKLTKVKNS | YKLPA---- | | 119 |
| SEQ_ID_NO_146 | GKFLEDKHK | DHLPSNFRKQ | LLVQIKKLVA | AGKLTKVKNS | YKLPP---- | | 123 |
| SEQ_ID_NO_147 | GKFLEDKHK | DHLPSNFRKQ | LLVQIKKLVA | AGKLTKVKNS | YKLPP---- | | 123 |
| SEQ_ID_NO_119 | QKFLEAKHK | D-LPAVFRKM | LSNNLKKLVA | AGKLVKVKAS | YKLPS---- | | 129 |
| SEQ_ID_NO_100 | QKFIEEKHK | SLPPTFRKL | LLVNLKRLVA | SEKLVKVKAS | FKIPS--A- | | 131 |
| SEQ_ID_NO_113 | QKFIEEKQ-K | SLPPTFRKL | LLVNLRRLVA | SGKLVKVKAS | FKIPS---- | | 122 |
| SEQ_ID_NO_104 | AKFIEEKQ-K | N-LPGNFKKL | LLVHLKKLVA | AGKLVKVKAS | YKLPS--A- | | 125 |
| SEQ_ID_NO_108 | TKFLEEKHK | Q-LPSNFKKL | LLFHLKKLVL | SDKIVKVKGS | FKLPS---- | | 126 |
| SEQ_ID_NO_116 | AKFIEEKHK | N-LPANFKKI | LLVQIKKLVA | SGKLVKVKGS | YKLPA--KS | | 132 |
| SEQ_ID_NO_117 | AKFIEEKHK | Q-LPSNFKKL | LLYQIRKLVA | SGKLVKVKAS | YKLPA---- | | 126 |
| SEQ_ID_NO_122 | TKFIEDKQ-K | N-LPSNFRKL | LLVQLKKLVA | SGKLVKVKSS | YKLPA-AR- | | 129 |
| SEQ_ID_NO_120 | TKFIEEKQ-K | SLPSNFKKL | LLTQLKKFVA | SEKLVKVKNS | YKLPSGSKP- | | 128 |

| | | | | | | | |
|---|---|---|---|---|---|---|---|
| SEQ_ID_NO_101 | ---ALKAKAK | KSTPKK-AKA | DG----EAKP | KK-SE-AKPK | ----KAEAVK | | 165 |
| SEQ_ID_NO_102 | -----PKAPA | APKPKK-EKK | TVAKKKAPKP | KV-PA-AKPK | -APAAKAAKP | | 164 |
| SEQ_ID_NO_150 | ----KEKKAD | APKPKT-EKK | PA----AKKP | KA-PA-AKAP | -AKAPSKAS | | 163 |
| SEQ_ID_NO_118 | -------ARA | APAPAL-AKK | PT----IPKP | KV-------- | --AAKPKTAK | | 147 |
| SEQ_ID_NO_145 | ----KPTTAT | KPKKTS-AKS | TT----VAKP | KS-AA-AKPK | --STAAKVKK | | 152 |
| SEQ_ID_NO_149 | ----KPTPAA | KPKSA----- | ------AVKP | KS-AA-TKLK | -SAAKKVKK | | 149 |
| SEQ_ID_NO_144 | ---IVHAAPA | EPKS------ | ------AAGP | KK-PA-AVQT | --KLKAKAKP | | 138 |
| SEQ_ID_NO_125 | --------AAA | KPKP------ | ------AAKK | KPAAK-KKAP | --AKKTATKT | | 158 |
| SEQ_ID_NO_137 | ----RAPAAA | KPKPKS-KTA | ------VKKP | KA-------- | -GAKKPKAA | | 148 |
| SEQ_ID_NO_146 | ---TRAPAAA | KPKAKP-AAA | A----KPKP | KPKAA-AKPK | --AAAKPKAK | | 161 |
| SEQ_ID_NO_147 | ---TRAPAAA | KPKAKP-AAA | A----KPKP | KPKAA-AKPK | --AAAKPKAK | | 161 |
| SEQ_ID_NO_119 | -AKSSAPAKK | KPAAAP-AKK | KA----AAAP | AKKKT-AAAP | --KKKAAAAP | | 170 |
| SEQ_ID_NO_100 | -RSAATPKPA | APVKKK-ATV | VA----KPKG | KV-AA-AVAP | -AKAKAAAK | | 171 |
| SEQ_ID_NO_113 | --AAKPAATT | KPVNKK-PAA | A-----VTKP | KG----KAP | --AKAKPAAK | | 157 |
| SEQ_ID_NO_104 | -RSSKTATAA | SAPAKK-KTA | TT----KSKS | KP--A-SKPK | --EGKSTKAT | | 164 |
| SEQ_ID_NO_108 | ---AKSSAPA | KPAASPAKK | KTATAAKPKA | KSKPAVSKAK | ETKSAKSTAK | | 173 |
| SEQ_ID_NO_116 | AAPAKKPAAA | KPKPKPKAKA | PVAKAPAAKS | KAKAA-PAKA | KAKAKAKAAP | | 181 |
| SEQ_ID_NO_117 | -KSSAAKPAK | KPAAAK-SKA | KPKAKAATKS | KAKPA-AKAK | --PAAKAKPA | | 171 |
| SEQ_ID_NO_122 | -SAAPKAAAT | APAKKK-PGA | KPKAT-KAKP | KPKPK-TVAP | -KAKTATKP | | 173 |
| SEQ_ID_NO_120 | -AAAAVPAKK | KPAAAK-SKP | AAKPKAAVKP | KAKPA-AKAK | --PAAKAKPA | | 173 |

Figure 4 (continued)

| | | | | | | | |
|---|---|---|---|---|---|---|---|
| SEQ_ID_NO_101 | KTKAPKEKVE | RPKKEKKEKV | EKKKATPKAE | KPKK----AA | TPKSAGKKK- | | 210 |
| SEQ_ID_NO_102 | KAAKKAAPAK | PAAPAPP--- | ------KKEE | KPAA-AA-PK | KAAPAAKPKK | | 203 |
| SEQ_ID_NO_150 | KPAAPKKAEK | PMAPKK---A | AAPKKAAKPA | APKAAAPKAK | KPAAAAKPL- | | 208 |
| SEQ_ID_NO_118 | IGAKPKAKAK | VAAKTKA--T | TKTVA----- | ---------- | KKIPAAKPKA | | 180 |
| SEQ_ID_NO_145 | A--------- | ----------A | VKPKPKSAAV | KPKAEPA-AP | KPKAVSKPKA | | 183 |
| SEQ_ID_NO_149 | AAVKPKPKSA | ----------A | VKPKAPAVNM | KSKP-A-AL | KPNTVTKSKT | | 187 |
| SEQ_ID_NO_144 | AAASKTKAK | IATTAKA--K | SKHVASTVKP | KPKA-A-AA | KPRVAPKRKS | | 183 |
| SEQ_ID_NO_125 | KAKAPAKKA- | ---------A | AKPKA-KAPA | KPKA----AA | KPKAAAKPKA | | 193 |
| SEQ_ID_NO_137 | TKPKPKAKAK | SPAKAKP--A | AKPKA-AAKP | KPAA----JA | KPKAAAKPKA | | 190 |
| SEQ_ID_NO_146 | APAKSKAAAK | PKAAAKP--A | AKPKAAAKPK | SPAK--P-AA | KPKAAPKAKA | | 206 |
| SEQ_ID_NO_147 | APAKSKAAAK | PKAAAKP--A | AKPKAAAKPK | SPAK--P-AA | KPKAAPKAKA | | 206 |
| SEQ_ID_NO_119 | KKKAPVAKAK | PAAKPKAKAV | VKPKA-KAAV | KPKA-KP-AA | KPAAKAKPA- | | 216 |
| SEQ_ID_NO_100 | GTKKPAAKVV | AKAKV----T | AKPKAKVTAA | KPKS----K | SVAAVSKTKA | | 212 |
| SEQ_ID_NO_113 | GAKKPAAAK | PKAKT----T | ATTKA-AAKP | KPKT----K | SVAAVSKTKA | | 197 |
| SEQ_ID_NO_104 | PKAKAKTKTT | SKAKSKP--A | AKPKA---TS | KAKAAPA-KT | KAVASVKPKT | | 208 |
| SEQ_ID_NO_108 | SPAKSKAAAK | PKAKPAA-A | AKPKV-TAKA | KPKA-AP-AK | AKTSVAKPKA | | 219 |
| SEQ_ID_NO_116 | AKAKPAAKAK | PAAKAKP--A | AKAKP-VAKA | KPKAKAP-VA | KANAVPVA-- | | 225 |
| SEQ_ID_NO_117 | AKAKPAAKAK | PAAKAKP--A | AKAKPAAKPV | KTAAAKP-AA | KAKPAAKPKA | | 218 |
| SEQ_ID_NO_122 | KAKQRQVKAK | LVAKAKP--A | VKPKA----- | -----AA-VA | MPKAAEKPK- | | 209 |
| SEQ_ID_NO_120 | AKAKPAAKAK | PAAKAKP--A | AKAKP-VAKA | KPKA-AA-AA | KPKAAVKPKA | | 218 |

| | | | | | | | |
|---|---|---|---|---|---|---|---|
| SEQ_ID_NO_101 | -ATPKPKAAP | ---------- | ---------- | -------K | SPAKKDAKPK | KATPSKKAAP | 240 |
| SEQ_ID_NO_102 | -PAAKPKKAA | ---------- | ---------- | ---TPKKPAP | KPKPAKKAAT | | 229 |
| SEQ_ID_NO_150 | -AAPKRSST- | ---------- | ---------- | ---RTAAKPA | APKAAKKPTP | | 233 |
| SEQ_ID_NO_118 | KTAGKPKTVA | ---------- | ---------- | --------A | KPAKVAKTAA | VASPGKKKAV | 211 |
| SEQ_ID_NO_145 | -VAPKPKTAG | ---------- | ---------- | ---------- | -PAKKAKTSA | KPSPSKKAAP | 211 |
| SEQ_ID_NO_149 | -VALKGKTAG | ---------- | ---------- | ---------- | RPAKAAKTSV | KAAPGKKAAP | 216 |
| SEQ_ID_NO_144 | PVKPKPKPKP | ---------- | ---------- | ---------- | RPTRAAKTAA | KDSPGKKAAK | 213 |
| SEQ_ID_NO_125 | KAAAKPKAAA | ---------- | -----KPKG | RPAKAAKTSA | KDAPGKKAPA | | 227 |
| SEQ_ID_NO_137 | KPAAKAKPKA | ------VAA | KPKPAAKKAG | RPAKAAKTSA | KDTPGKKAAP | | 233 |
| SEQ_ID_NO_146 | KPAAKPKAKA | APKPKAAVVT | KTKATSAPAR | RPAKAAKTSA | KDTPSKKAAP | | 256 |
| SEQ_ID_NO_147 | KPAAKPKAKA | APKPKAAAVT | KTKATSAPAR | RPAKAAKTSA | KDTPSKKAAP | | 256 |
| SEQ_ID_NO_119 | -AKAKPAAKP | ---------- | KAK-----A | KPAKVARTST | RTTPGKKAPA | | 249 |
| SEQ_ID_NO_100 | -VAAKPKAKE | ---------- | ---------- | RPAKASRTST | RTSPGKKVAA | | 241 |
| SEQ_ID_NO_113 | -VAAKPKAKE | ---------- | ---------- | RPVKASRTST | RTSPGKKAAA | | 226 |
| SEQ_ID_NO_104 | TAATKPKAAA | ---------- | KPK-----D | KPVKASRTST | RTSPGKRAAA | | 242 |
| SEQ_ID_NO_108 | -APAKPKAKE | ---------- | ---------- | RPAKASRTST | RTSPGKKAAA | | 248 |
| SEQ_ID_NO_116 | -AKAKPAAKA | ---------- | KPAAKAKPAA | RPAKASRTST | RTSPGKRAAA | | 264 |
| SEQ_ID_NO_117 | AAKAKPAAKA | ---------- | KPAAKAKPAA | KPAKAARTST | RTSPAAAAAA | | 258 |
| SEQ_ID_NO_122 | -TPVKTKAAA | ---------- | KP--KAK--E | KPAKVARTAT | RSTPSRKAAP | | 244 |
| SEQ_ID_NO_120 | -APAKTKAAV | ---------- | KPNLKAK--T | TTAKVAKTAT | RTTPSRKAAP | | 255 |

Figure 4 (continued)

| | | | | | |
|---|---|---|---|---|---|
| SEQ_ID_NO_101 | - - KKAPAKKS | T - PKAKEA - - | - - - - - - - - - - - - - | - - - - - - - - - - | 255 |
| SEQ_ID_NO_102 | - - - - - - - - - - | - - PKKKAG - - | - - - - - - - - - - - - - | - - - - - - - - RP - - | 237 |
| SEQ_ID_NO_150 | - - - - - - - - - - | - - - - KKAG - - | - - - - - - - - - - - - - | - - - - - - - - GA - - - | 239 |
| SEQ_ID_NO_118 | - - - - - PVKKV | K - TVKSPA - - | - - - - - - - - - - - - - | - - - - - - - - - - - | 223 |
| SEQ_ID_NO_145 | - - - - VASKKA | K - PVKKATA - | - - - - - - - - - - - - - | - - - - - - - - - - - | 225 |
| SEQ_ID_NO_149 | - - - - VALKKA | K - AGKKVTT - | - - - - - - - - - - - - - | - - - - - - - - - - - | 230 |
| SEQ_ID_NO_144 | - - - - RSSSRS | A - PTKKPK - - | - - - - - - - - - - - - - | - - - - PAVKKA | 232 |
| SEQ_ID_NO_125 | - - - - AAAPKK | A - AARKPPT - | - - - - - - - - - - KRSTPVKKAA | PAKKAAPAKK | 261 |
| SEQ_ID_NO_137 | - - - - AKKPA | A - AAKKAPA - | - - - - - - - - - - KKAAPAKKA - | - - - - PTPSRK | 261 |
| SEQ_ID_NO_146 | - - - - AAKKPA | A - AAKKAPA - | - - - - - - - - - - KKAAPAKKA - | - - - - AAPARK | 285 |
| SEQ_ID_NO_147 | - - - - AAKKPA | A - AAKKAPA - | - - - - - - - - - - KKAAPAKKA - | - - - - AAPARK | 285 |
| SEQ_ID_NO_119 | KPAAAPVKKA | T - PVKKATAT | PVKKAAPVKK AAPAKGKSV - | - - - - KTPVKR | 293 |
| SEQ_ID_NO_100 | - - - - - PAKKV | A - VTKKAP - - | - - - - - - - - - - - - AKSAKV - | - - - - KSPAKR | 265 |
| SEQ_ID_NO_113 | - - - - PAKKAA | AAATKKAP - - | - - - - - - - - - - - - AKSVKV - | - - - - KSPAKR | 252 |
| SEQ_ID_NO_104 | - - PKPAAKKA | P - AAKKAP - - | - - - - - - - - - - - AKSVKPKSV - | - - - - KSPAKK | 272 |
| SEQ_ID_NO_108 | - - TKVAPKKA | A - TPKKAP - - | - - - - - - - - - - - AKTVKLKSV - | - - - - KTPTKK | 278 |
| SEQ_ID_NO_116 | - - AKPAVKKA | ATPVKKAVPA - | - - - - - - - - - - KKAATPVKK - | - - - - AAPARK | 297 |
| SEQ_ID_NO_117 | - - PKPAAKKA | A - PVKKTPV - | - - - - - - - - - - KAAAKAKTA - | - - - - KSPAKK | 289 |
| SEQ_ID_NO_122 | - - - KPVAKKV | P - VKKAAPA - | - - - - - - - - - - - AKSVKAKTA - | - - - - KSPAKR | 274 |
| SEQ_ID_NO_120 | - - KATPAKKE | - - PVKKAP - - | - - - - - - - - - - - - - - AKNV - | - - - - KSPAKK | 279 |

| | | |
|---|---|---|
| SEQ_ID_NO_101 | - - - KSKGKK | 261 |
| SEQ_ID_NO_102 | - - - AKKAKK | 243 |
| SEQ_ID_NO_150 | - - - AKKAKK | 245 |
| SEQ_ID_NO_118 | - - - GKRTRK | 229 |
| SEQ_ID_NO_145 | - - - PKKAKK | 231 |
| SEQ_ID_NO_149 | - - - PKKAKK | 236 |
| SEQ_ID_NO_144 | AAAAKKAKK | 241 |
| SEQ_ID_NO_125 | APAAKKAKK | 270 |
| SEQ_ID_NO_137 | VP - SRKAKK | 269 |
| SEQ_ID_NO_146 | VP - ARKAKK | 293 |
| SEQ_ID_NO_147 | VP - ARKAKK | 293 |
| SEQ_ID_NO_119 | TSARKAGKK | 302 |
| SEQ_ID_NO_100 | AS - TRKAKK | 273 |
| SEQ_ID_NO_113 | ASTRKK - - - | 258 |
| SEQ_ID_NO_104 | AT - SRRGKK | 280 |
| SEQ_ID_NO_108 | AA - VKKGKK | 286 |
| SEQ_ID_NO_116 | APAKRGGRK | 306 |
| SEQ_ID_NO_117 | AA - AKRGKK | 297 |
| SEQ_ID_NO_122 | AS - ARKGRK | 282 |
| SEQ_ID_NO_120 | AT - PKRGRK | 287 |

Figure 5

| | | | | | | | |
|---|---|---|---|---|---|---|---|
| SEQ_ID_NO_164 | MENM----- | KMNNDERFA- | ------QKGV | PVHSQVMKIK | QESEKIVDWS | 37 |
| SEQ_ID_NO_158 | MENN----- | SSNDDSRGRN | GDGDHGYVGF | PIHSQVIKIR | QEFDKIKHPS | 44 |
| SEQ_ID_NO_154 | MEQKKISSSS | SSNNNAVIRD | EDE---YKGV | PIHSQVMKIK | QEFEKIKHPS | 47 |
| SEQ_ID_NO_152 | MENK----- | TDNGN----- | ------EDGP | IIHSQVEKIK | KEFEKIRQPS | 33 |
| SEQ_ID_NO_162 | MENK----- | TNNGN----- | ------EDG- | PKHSQVVKIK | REFEKISQPS | 32 |

| | | | | | | |
|---|---|---|---|---|---|---|
| SEQ_ID_NO_164 | PGKPEIRSVL | REISHRQLSR | SPLGISGDPI | SVGES | 71 |
| SEQ_ID_NO_158 | LQQLEVRGYV | KCRINRQRSR | SPLGLAERPI | SVGN- | 78 |
| SEQ_ID_NO_154 | LQQPDMRRVL | REITHRQRSR | SPLGLAERPI | SVGNS | 81 |
| SEQ_ID_NO_152 | LQQPEMRRVL | SEIKRRQRSR | SPLGLGERSI | SVGN- | 67 |
| SEQ_ID_NO_162 | LKQPEMRRVL | SEITRRQRSR | SPLGLGERSI | SVGH- | 66 |

Figure 6

| | | | | | | |
|---|---|---|---|---|---|---|
| SEQ_ID_NO_184 | ---------- | ---------- | -------MG | L--------- | ---------- | 3 |
| SEQ_ID_NO_168 | ---------- | ---------- | -------MS | SPTQVLQG | LLGEFHSRRL | 22 |
| SEQ_ID_NO_177 | ---------- | ---------- | -------ME | YPRRTLLH-- | ---------- | 10 |
| SEQ_ID_NO_181 | ---------- | ---------- | -------MG | TPLRMPHMST | CSNVAPAP-- | 20 |
| SEQ_ID_NO_182 | ---------- | ---------- | -------MA | MSPHDQHEHE | PDHAHRSP-- | 20 |
| SEQ_ID_NO_183 | ---------- | ---------- | -------MA | MSPHDQHEHE | PDHAHRSP-- | 20 |
| SEQ_ID_NO_170 | ---------- | ---------- | -------MR | PAPLEAEAAA | ANSHLSP--- | 20 |
| SEQ_ID_NO_166 | ---------- | ---------- | -------MR | LLVAEAA--- | ---------- | 9 |
| SEQ_ID_NO_174 | MWMMISQEGQ | RSNPIIYHNN | IHLLCEVDQK | REKASVIVLK | IQTKHPNPES | 50 |

| | | | | | | |
|---|---|---|---|---|---|---|
| SEQ_ID_NO_184 | ------SSLP | GPSEGMLCVI | LVN------- | TALSISFKG | VRSVLHVLG | 40 |
| SEQ_ID_NO_168 | LLTPL-TTAS | PPSSEHHNS | SDLYTRNNSF | DANIVMVLSV | LLCALICSLG | 70 |
| SEQ_ID_NO_177 | --TPFSGHPS | GPSQPIDGAT | A---TDGSNF | DANVVMILAV | LLCALICALG | 55 |
| SEQ_ID_NO_181 | --APEAPRAP | PSSP------ | ---------L | DYDVVVILAA | MLCALVCALG | 53 |
| SEQ_ID_NO_182 | ------SNGT | AATSTIATNR | AGPYSGAGDF | ASNMAVILAA | LLAALALALA | 64 |
| SEQ_ID_NO_183 | ------SNGT | AATSTIATNR | AGPYSGAGDF | ASNMAVILAA | LLAALALALA | 64 |
| SEQ_ID_NO_170 | --PPLHSRAP | SCDPQVHSCK | WAPYSNSNDF | GANTAMILII | LLCALICALV | 68 |
| SEQ_ID_NO_166 | --SPLSSLAA | TPTCNSHTCR | WKPYSNSTDF | TANASVLLIL | VISALICALS | 56 |
| SEQ_ID_NO_174 | FKTSLEPLSP | PLSPHSLCIR | WKPYSNSSEF | QANASVLLIL | FVSALICGLS | 99 |

| | | | | | | |
|---|---|---|---|---|---|---|
| SEQ_ID_NO_184 | IRLSQSSSSP | SSVTASSEIP | ASEPFDFRVS | HPESFLEEFR | NKIPTLRYES | 90 |
| SEQ_ID_NO_168 | LNSIIRCALR | CSSLIASESG | ATTSSRLANK | ---GNKRKAL | KTFPTVNYS- | 116 |
| SEQ_ID_NO_177 | LNSIVRCALR | CSSRVVVGPE | PNQVTRLVQS | ---GLRRKAL | RAMPVLVYS- | 101 |
| SEQ_ID_NO_181 | LNSMLOCVVR | CTRRAVADPV | GWAHRRASA | ---GLKREDV | VALPVVTYS- | 99 |
| SEQ_ID_NO_182 | LNAAVRYLLR | RHRRARQQPA | AAAAAAEDPE | KPPVQEADPP | PPPPALVYSA | 114 |
| SEQ_ID_NO_183 | LNAAVRYLLR | RHRRARQQPA | AAAAAAEDPE | KPPVQEADPP | PPPPALVYSA | 114 |
| SEQ_ID_NO_170 | LNTAIRAFLR | BNNNNSSDRL | GELEEDRKPK | --DEADMATL | VLATTQVYS- | 115 |
| SEQ_ID_NO_166 | LYAAIRCFLR | -------PT | LETEDDHKPD | --PEAAASST | PTTPTLVYS- | 95 |
| SEQ_ID_NO_174 | LCAAIRCFLR | PN------L | QTDDNEHKPD | --PEEDVSST | VPTPTLVYS- | 139 |

| | | | | | | |
|---|---|---|---|---|---|---|
| SEQ_ID_NO_184 | LCRCKKHEDN | ECSVCLSKFE | EDSEINKLK- | -C----GHL | FHKTCLEKW- | 132 |
| SEQ_ID_NO_168 | ADLKLPGLDS | ECIICLSDFT | AGDRVRLLPK | -C----NHG | FHVRCIDKW- | 159 |
| SEQ_ID_NO_177 | PGLRINAANP | TCAICLSDFE | AGEHVRVLPK | -C----NHG | FHVRCIDRW- | 144 |
| SEQ_ID_NO_181 | -ASPPAAAAA | GCAICLSDFA | DGERMRVLPV | -C----GHR | FHVVCIDRW- | 141 |
| SEQ_ID_NO_182 | AGTKLAGALA | ECAICLAEFV | DGDTVRVMPC | WCDEIPLESG | LRFACIKVYQ | 163 |
| SEQ_ID_NO_183 | AGTKLAGALA | ECAICLAEFV | DGDTVRVMPV | -C----GHG | FHARCIERW- | 156 |
| SEQ_ID_NO_170 | AGMKLGGVEA | DCAICLSEFV | EGEGRVLGR | -C----DHG | FHVLCIEKW- | 158 |
| SEQ_ID_NO_166 | SDLELAGAEA | ECAICLSEFE | QGESIQVLEK | -C----QHG | FHVKCIHKW- | 138 |
| SEQ_ID_NO_174 | SDLELAGAQA | ECAICLSEFE | PGESIHVLEK | -C----HHG | FHIKCIHKW- | 182 |

Figure 6 (continued)

```
SEQ_ID_NO_184  ............ -I- DYWN TC PL CRT- PLVV ............ ........V        150
SEQ_ID_NO_168  ............ -L- SAHSSC PKCRH- CLVD TCQKI VGCT- --QASSSEPP         192
SEQ_ID_NO_177  ............ -L- LARSTC PTCRQ- SLFG VPQKASGCSE ASRAAEPEPA          180
SEQ_ID_NO_181  ............ -L- ASHKSC PTCRR- RLSS ............ ........ES        159
SEQ_ID_NO_182  TGPFNVEAAN LL- PTPGIC TTCRF- VYRG VVKHLHFL-- --YGDWRD L             206
SEQ_ID_NO_183  ............ L- AGGRRSSC PTCRA- PAAT ............ ........PP        176
SEQ_ID_NO_170  ............ -L- SSHSSC PTCRRSCLAS SPSSPEPDNC SAGNGHDSNS            195
SEQ_ID_NO_166  ............ -L- STRSSC PTCRT SIFS ............ ............        154
SEQ_ID_NO_174  ............ -L- SSRSSC PTCRT- SIFS ............ --QNTLDSAT         206

SEQ_ID_NO_184  AAAEDQKQLS SNVW- ..... ....     164
SEQ_ID_NO_168  PVQETILSII TPVDREGFIH SYR-       215
SEQ_ID_NO_177  PAPAPARSVL VPLRPEGLVT HYDF       204
SEQ_ID_NO_181  GGGHRHLQYL TAV- ..... ....       172
SEQ_ID_NO_182  ACFVKGKKNT NS- ....... ....      218
SEQ_ID_NO_183  GATATEPAAV APL- ...... ....      188
SEQ_ID_NO_170  SQSAEPERAA DNLSTNGNIP V---       216
SEQ_ID_NO_166  QHSETPSSHI NA- ....... ....      166
SEQ_ID_NO_174  SAVAPSTNEL NA- ....... ....      218
```

Figure 7

```
SEQ_ID_NO_194    MLKSKSCREE MRSSS AYK  YHCLTNGGTP EAVAAPSPTN PQLPVMLRSY   49
SEQ_ID_NO_199    -MAAADYDRA YRPYAPSSAA DYDRPYRNE- ---------- ------VPY    32
SEQ_ID_NO_204    -MAAADADYE YRAYG-APA- DHDRPYHG-- ---------- RE---VVPY    31
SEQ_ID_NO_186    ---MANYYE- -PPAS-GNRR DAVKGYNS-- -G-------- --------SF    25
SEQ_ID_NO_201    ---MD--RS- -KSYA-GGR- MQIEPYYD-- -G----GGAR PD---FRSY    30
SEQ_ID_NO_203    ---MDDFRS- -RSFN-DGK  MQLEVYGSRR SGAVPAPPVL HD---YRSY    39
SEQ_ID_NO_188    ---MEHFRS- -KSCR-EGR  IEMEGYDEDK AA----PTNM QD---LRSY    35
SEQ_ID_NO_196    ---MEEFRS- -KSYG-DGR- MQIEAYRG-- --------ANI QD---LRCY    30
SEQ_ID_NO_197    ---MEDYNKQ IRPYG-NSCM MQMEGYYG-- -A----TNPN YD---IRSY    35
SEQ_ID_NO_193    ---MEDYNRQ -RAYG-DTG- MQIQPYHG-- -G----GPGT GD---FRKY    33

SEQ_ID_NO_194    S-------- TSTYS----- ---------- ----PHKNPT TVRDNPNS-K   70
SEQ_ID_NO_199    G-------- DRRIDLVVKP PPP------- ----TRSPPP PLPVTKSG--   60
SEQ_ID_NO_204    G-------- DRRIDVVVKP PGTTTTTT-- ----TRSPPP PLPVTKVG-G   65
SEQ_ID_NO_186    D-------- DSSGDQSQ-- ---------- ----TNDYQL KIKKSKSVPN   50
SEQ_ID_NO_201    SYSAGGSGMG TSSYAYQYEY S--------- ----GAGAGE EMKRSKS--    64
SEQ_ID_NO_203    S-------- -ASYFYTYD- ---------- ----GSGVGY GDFKGKPDHG   64
SEQ_ID_NO_188    S-------- -VSYAVSVQP N--------- ----QSGKEG KMKKQKSN--   60
SEQ_ID_NO_196    S-------- -ASYASSVHP TTTTTTTTQT QMGGNNNNEA KFKKGKST--   68
SEQ_ID_NO_197    S-------- DFSYAQTQRG ---------- ----PNNKDL KLKKGKS-S    61
SEQ_ID_NO_193    S-------- -TSYA----- ---------- ----TENNIX NLKKEKS--    52

SEQ_ID_NO_194    SNGKVKKGL- --KEAEIQRK KRVAAYNVYG VEGKVKGSIR KNFKWEKETC  117
SEQ_ID_NO_199    GGGGIGSAWC F-SDPEVKRR RRVASYKAYS VEGKVKASFR RGFRWIKDKC  109
SEQ_ID_NO_204    GGGGMGSAWC F-SDPEMKRR RRVASYKAYS VEGKVKSSLR RGFRWIKAKC  114
SEQ_ID_NO_186    ADRAASRSWS F-SDPESRRK RRVAGYKVYS VEDKMKGSIR KSFKWFKD--   97
SEQ_ID_NO_201    -----KRRWL ALADPDMERK RRVAAYKAVG VEGKMKGSFR KSFKWIKDRY  109
SEQ_ID_NO_203    SSASNKGGRV F-KDPEFQRK RRVASYKAYA VEGKVKGSLR RSLRWFKDKY  113
SEQ_ID_NO_188    -LESSSKSWS F-NDPELQRK RRVANYKVYA IEGKMKGSLR KSFRWIKDTC  108
SEQ_ID_NO_196    -NGSTSKSWS F-SDPELQRK KRVASYKVYA VEGKLKGSLR KSFKWLKDRC  116
SEQ_ID_NO_197    SRSSISKSWG FGDDPEFQRK KRVASYKMYS VEGKVKGSFR KSFKWLKNRY  111
SEQ_ID_NO_193    ---ARSKSWG I-TDPELQRK KRVASYKMYS VEGKVKGSFR KSFRWLKQRY   98
```

Figure 7 (continued)

| | | |
|---|---|---|
| SEQ_ID_NO_194 | SNAVNGLV- ........... ........ . | 125 |
| SEQ_ID_NO_199 | TGF HG- ........... ........ . | 115 |
| SEQ_ID_NO_204 | SELIHGWYGS LLLPLSFSLD DFIITSKQAL S | 145 |
| SEQ_ID_NO_186 | ---IGLS-- ........... ........ . | 102 |
| SEQ_ID_NO_201 | LNLVYGWS- ........... ........ . | 117 |
| SEQ_ID_NO_203 | TRAVYGWW- ........... ........ . | 121 |
| SEQ_ID_NO_188 | TQVVYGWR- ........... ........ . | 116 |
| SEQ_ID_NO_196 | NRVVYG--- ........... ........ . | 122 |
| SEQ_ID_NO_197 | WHVVYSLV- ........... ........ . | 119 |
| SEQ_ID_NO_193 | TQVVYGWW- ........... ........ . | 106 |

Figure 8

```
SEQ_ID_NO_216    MGKGEAWWNG QRIGRYWPTY VASDASCTDS CNYRGPYSAS KCRKNCEKPS    50
SEQ_ID_NO_208    .......... .......... ....METLQ  CRHQHVFIL  ........-C    15
SEQ_ID_NO_214    .......... .......... ....MDTTHS CRRG--YIL  ........-C    14

SEQ_ID_NO_216    QTLYHVPRSW LKPSGNILVL FEERGGDPTQ ISIVTKQTES LCAHVSDSHP    100
SEQ_ID_NO_208    LVLFHS-SL  FVLASKIDVS DDARGIRIDG ---GQKRFLT NSPQHGKEHA    60
SEQ_ID_NO_214    LVLSYS-SV  FGLASNMSIS NDTSGNKTDS FFESQSTSTE WGTDMGDKY     62

SEQ_ID_NO_216    PPVDLWNSET ESGRKVGPVL SLTCPHDNQV ISSIKFASYG TPLGTCGNFY    150
SEQ_ID_NO_208    -------ACT NEEPDLGPLT RISCNEPEYV LTKINFADYG NPTGTCGHFR    103
SEQ_ID_NO_214    -------MCT ESNMEIPWW- -ISCKKSKEV FTRINFADYG NPSGKCEHYR    103

SEQ_ID_NO_216    HGRCSSNKAL SIVQKACIGS SSCSVGVSQD TFGDP-CRGM AKSLAVEATC    199
SEQ_ID_NO_208    RDNCGARATM RIVKKNCLGK EKCHLLVTDE MFGPSKCKGA PM-LAVETTC    152
SEQ_ID_NO_214    HGNCGAKTTM EVAKKNCLGK HQCVFKVSDE MFGTSHCKKE AK-FFVQLTC    152

SEQ_ID_NO_216    A--         200
SEQ_ID_NO_208    TIA         155
SEQ_ID_NO_214    TKA         155
```

Figure 9

| | | | | | | | |
|---|---|---|---|---|---|---|---|
| SEQ_ID_NO_218 | ----MDEEAA | KPRDSTVNQQ | H--------- | ---------- | --QYY | YGTFQGVANF | 30 |
| SEQ_ID_NO_225 | ----MDEEAA | KPRDTTVNQQ | Q--------- | ---------- | --QYY | YGTFQGVANY | 30 |
| SEQ_ID_NO_227 | -MGDGEEDKS | KGFADEAGTH | H--------- | ---------- | -----Q | YGTFQGVSNY | 31 |
| SEQ_ID_NO_220 | ----MSGDEK | NPAVVDHQH | H--------- | ---------- | -----Q | YGTFQGVSNY | 28 |
| SEQ_ID_NO_222 | ----MSDQEK | NRGVVDHRH | HEDQPPPPP | -----PPDPQ | YGTFQGVANY | 40 |
| SEQ_ID_NO_231 | MAGEMPDADG | KPRSASSGFD | PSAPPQPQ-- | ------AQQYQ | YGTFGA--- | 39 |
| SEQ_ID_NO_230 | -MGGGREEEA | ASK--VGYSS | GDLPPSAPPH | LQGQDPQQYQ | YGTFQ---- | 42 |
| SEQ_ID_NO_229 | -MGGGDEQEA | DAGKSGGYSS | SGLPPSEP- | -----SQQYG | YGTFQG--- | 38 |
| SEQ_ID_NO_1052 | -MGGRHEAEA | DGGKAGGYSS | SGLPPSEAPH | LQGQPSQEYG | YGTFQG--- | 45 |

| | | | | | | | |
|---|---|---|---|---|---|---|---|
| SEQ_ID_NO_218 | PTPAPPPQFM | QPQHPITTF | ---PGHAY- | ---------- | -Q | NLQGHG--- | 61 |
| SEQ_ID_NO_225 | PPPAPPP--- | LPHQPIVTSP | LLPP---- | ---------- | | ---------- | 51 |
| SEQ_ID_NO_227 | PPPRP---- | QNSPPVTGFP | QPSAPPRV-- | ---------- | -Y | D-SAPP--- | 60 |
| SEQ_ID_NO_220 | PPPPPP--- | QHHGPAIGFP | QPVPPPGL- | ---------- | -H | EPSAPP--- | 59 |
| SEQ_ID_NO_222 | PPPS----- | --QSHVIGFP | QPVPPPG- | ---------- | | ---TAFP--- | 64 |
| SEQ_ID_NO_231 | PSSAPG--- | EVPQPAVGFP | QPAPPPGL- | ---------R | HYPQPPPPSY | 74 |
| SEQ_ID_NO_230 | PPPHHHAASG | ELARPPVGFP | QPAPPPGFAG | ASGGGGHYHH | HHQQQP--- | 88 |
| SEQ_ID_NO_229 | SRAGSG--- | EFRKPPVGFP | QPAPPPGF- | ---GGGG---Y | HNQQQP--- | 73 |
| SEQ_ID_NO_1052 | P-------- | --RQPPVGFP | QPAPPPGF- | ---GGGG---Y | HNQQKP--- | 73 |

| | | | | | | | |
|---|---|---|---|---|---|---|---|
| SEQ_ID_NO_218 | ---------- | ----GGVNYAQ | GFPVVVPDYT | -VVEVRP-M | IEHELPCCGL | 95 |
| SEQ_ID_NO_225 | ---------- | --------VH | GYQ-TLQEYT | -VVEVRP-V | REHDVPCCGF | 79 |
| SEQ_ID_NO_227 | ---------- | -----HYAH | GYQ-TVPVHG | -IAEGRPVHV | RQRRLPCCGI | 92 |
| SEQ_ID_NO_220 | ---------- | ----PQYYPQ | GYQ-TVPGYA | -VAEGRP-V | RERRLPCCGI | 91 |
| SEQ_ID_NO_222 | ---------- | -------YAQ | GYQ-TVPGYA | -VAEGRP-V | RQRRLPCCGC | 93 |
| SEQ_ID_NO_231 | AVYPPLPPQT | YPANAPYYAL | GYQ-AVQGYL | PVVEGRP-V | RMRRLPFCGL | 121 |
| SEQ_ID_NO_230 | ---------- | YAPAEPYYAQ | GYQ-TGPGYG | SIAEGRP-V | RMRRLPCCGL | 125 |
| SEQ_ID_NO_229 | ---------- | YTPEEPYYAQ | GYQ-AVPGYG | QVAEGRP-V | RMRRLPCCGL | 110 |
| SEQ_ID_NO_1052 | ---------- | YAPAEPYYAQ | GYQ-AVPGYG | PVAEGRP-V | RMRRLPCCGL | 110 |

| | | | | | | | |
|---|---|---|---|---|---|---|---|
| SEQ_ID_NO_218 | GMGWFLFIMG | FLFGGIPWYL | GAFIVLVT-S | VDHREKAGYV | ACSIA---- | 139 |
| SEQ_ID_NO_225 | GMGWFLFIMG | FLFGGIPWYL | GAFIILFT-S | VDHREKAGYV | ACSVA---- | 123 |
| SEQ_ID_NO_227 | GLGWFLFIVG | FFLGAIPWYV | GMFIMIVGRR | IDHREKPGYI | ACTIA---- | 137 |
| SEQ_ID_NO_220 | GFGWFLFIIG | FFLGAIPWYI | GLFVLLCA-R | DYREKPGYI | ACTIA---- | 135 |
| SEQ_ID_NO_222 | GVGWFLFIIG | FFLGAIPWYI | GLFIIACM-R | DPREKPGYV | ACTIALRKHL | 142 |
| SEQ_ID_NO_231 | GMGWFLFIIG | FFLAAIPWYI | GAFVLICVRV | HDYREKPGYV | ACTIA---- | 166 |
| SEQ_ID_NO_230 | GLGWLLFIAG | FFLAAIPWYV | GAFILICVRV | HDYREKPGYV | ACTVA---- | 170 |
| SEQ_ID_NO_229 | GLGWCLFITG | FFLAAIPWYI | GAFIMICVRV | HDHREKPGYV | ACTIAVSS-- | 158 |
| SEQ_ID_NO_1052 | GLGWCLFITG | FFLAAIPWYI | GAFILICVRV | HDQREKPGYV | ACTIA---- | 155 |

Figure 9 (continued)

| | | | | |
|---|---|---|---|---|
| SEQ_ID_NO_218 | ---------- ---------- S | VVYLIAVMLG | MTGD N W | 158 |
| SEQ_ID_NO_225 | ---------- ---------- S | VVYLIAVMLG | MAGN N W | 143 |
| SEQ_ID_NO_227 | ---------- ---------- A | ILATIAVILG | VTKGAE DW | 156 |
| SEQ_ID_NO_220 | ---------- ---------- A | VLATIAIILG | VTKGID DF | 153 |
| SEQ_ID_NO_222 | VEHECHIEIR CLLHNLCVK A | LLATIAIILG | ATKGAD EW | 180 |
| SEQ_ID_NO_231 | ---------- ---------- A | SLAAIAILLG | VTRGEE IW | 185 |
| SEQ_ID_NO_230 | ---------- ---------- A | VIAAIM PLG | LTKGAH VW | 189 |
| SEQ_ID_NO_229 | ---------- ---------- F | LL QCNL TVY | FTSGI --- | 174 |
| SEQ_ID_NO_1052 | ---------- ---------- A | VVAAVAILLG | VTKGTH VW | 174 |

Figure 10

```
SEQ_ID_NO_244    MEYQRTNNLS  LAFQFFRKAF  EMCDSDPLLF  NEYGVLRYRQ  G-NYEEAVEN    49
SEQ_ID_NO_234    MEYMRTHSYK  LADQFFMQAK  AICPSDPLVY  NELGVVAYHM  K-EYGKAVRW    49
SEQ_ID_NO_236    MEYMRTHSYK  LAEQFFMQAK  TICPSDPLVY  NELGVVAYNM  K-EYNKAVLA    49
SEQ_ID_NO_241    MQYVRMHNFK  LAEQFFTQAK  SICPSDPLIH  NELGVVAYNM  KEEYQKAVSY    50
SEQ_ID_NO_242    MQYLRMHNFK  LAEQFFTQAK  SICPSDPLIY  NEMGVVAYNM  K-EYQKAVQW    49

SEQ_ID_NO_244    FERALDLAPK  PVGSRWESLI  VNLAQAFRKI  GRYDEAIATF  QSALLISPRN    99
SEQ_ID_NO_234    FEKTLAH PS  ALTESWEPTV  VNLAHAYRKL  RKDREAISYY  ERALTLSTKS    99
SEQ_ID_NO_236    FEKTLKH PS  -LSQLWEPTV  INLAHAYRKL  KIYHEAISCY  ERALALSTRS    98
SEQ_ID_NO_241    YAKNLTFPTK  SLS----AF   AGLAYIYHLM  DDFEAAINYY  HKALWLKPDD    95
SEQ_ID_NO_242    FELTLEHTSS  SLNEMWEPTL  VNLGHALRKL  KKYQKAISYY  EKALTFQTKS    99

SEQ_ID_NO_244    ASTYAALAFT  YQMKSRCSEP  VSLGLAIEYY  HKALSLRADD  AFSQHHLELA   149
SEQ_ID_NO_234    LSTYSGLAYT  YHLQGNFS-   ----AAISYY  HKALWLKPDD  QFCTEMLNVA   143
SEQ_ID_NO_236    LSTYAGLAYT  YHLQDNFT-   ----AAITCY  HKALWLKPDD  QFCTEMLSLA   142
SEQ_ID_NO_241    QFCTDMLTYA  LESICQIT-   ----------  ----------  ---------A   114
SEQ_ID_NO_242    LSAFAGLAYT  YHLMAMYH-   ----V-----  HRA-------  ----EVLQL    127

SEQ_ID_NO_244    LIDQSAITIP  RHQQVEWDTM  FPKVEDINAV  TPTFGIASSP  QGGILFPTPS   199
SEQ_ID_NO_234    LMDE------  ----------  ----------  ----------  ----------   147
SEQ_ID_NO_236    LVDE------  ----------  ----------  ----------  ----------   146
SEQ_ID_NO_241    RRKP------  ----------  ----------  ----------  ----------   118
SEQ_ID_NO_242    TKEP------  ----------  ----------  ----------  ----------   131

SEQ_ID_NO_244    PHSFQGTPTF  GQTPFSARVD  RMDESVDMDQ  SVDMDESE      237
SEQ_ID_NO_234    ----------  CQNGVDSKV-  ----------  ----ELC       159
SEQ_ID_NO_236    ----------  GRRGIDPKI-  ----------  ----EFR       158
SEQ_ID_NO_241    ----------  GRGLLTATGG  ----------  ----VTC       131
SEQ_ID_NO_242    ----------  GR--------  ----------  -------       133
```

Figure 11

```
SEQ_ID_NO_268   ---MEEQCAA AASGG---GG GGGASMCANG CGFFGSEATK KLCSKCYRDQ  44
SEQ_ID_NO_298   ---MAER-QE VSG------ SMAAPMCANA CGFFGSAATK NLCSKCYK--  37
SEQ_ID_NO_260   ---MSBEQNN STSFP----- PTEPKLCDNG CGFFGSPSNM NLCSKCYR--  40
SEQ_ID_NO_249   ---MAEE-HR CQA------ P---QLCAHN CGFFGSPTTC NLCSECYR--  34
SEQ_ID_NO_255   ---MAEEQHR CQE------ P---RLCVHN CGFFGSPATC NLCSKCYG--  35
SEQ_ID_NO_265   ---MAEE-HR CQA------ ---ADRLCANN CGFFGSPANC DLCSKCYR--  36
SEQ_ID_NO_262   ---MAEE-HR CQA------ PEGHRLCBNN CGFFGSPATM NLCSKCYR--  37
SEQ_ID_NO_251   ---MAEE-HR CQA------ PEGHRLCVHN CGFFGSSATM NLCSKCYR--  37
SEQ_ID_NO_246   ---MAEE-HR CET------ PEGHRLCVHN CGFFGSSATM NLCSNCYG--  37
SEQ_ID_NO_274   ---MAEE-HP CQT------ PEGHRLCVHN CGFFGSSATM NLCSNCYG--  37
SEQ_ID_NO_248   MAQRDKEETE MKV------ SEBLSLCIHN CGFSGNPATK NMCDSCYK--  41
SEQ_ID_NO_279   ---MAQESWK QESEETRVHA PEAPILCINN CGFFGSSMTN NMCSKCYR--  46
SEQ_ID_NO_295   ---MAQESWK QESHA----- PEAPILCINN CGFFGSSMTN NMCSKCYR--  40
SEQ_ID_NO_270   ---MDHDKTG CQSP------ PEGPKLCINN CGFFGSAATM NMCSKCHK--  39
SEQ_ID_NO_267   ---MEQNETG CQVP------ PDAPMLCVNN CGFFGSAATM NPCSKCHK--  39
SEQ_ID_NO_277   ---MEHEETG CQPH------ PEGPILCVNN CGFFGSMATR NMCSKCHK--  39
SEQ_ID_NO_286   ---MEHKETG CQQ------- PKGPILCINN CGFFGSAATM NMCSKCHK--  38
SEQ_ID_NO_290   ---MEHKETG CQQ------- PEGPILCINN CGFFGSAATM NMCSKCHK--  38

SEQ_ID_NO_268   LKAAPSSPPA APDLVANEEE EASTAAAAAA DECLALCSSG CGFFGSKETN  94
SEQ_ID_NO_298   ---------- --EHLIKTAK DEASAAVVVG GAIVKCAADE CGFFGSSATN  76
SEQ_ID_NO_260   ---------- --SLRAEEDQ AVAKAAVEK SLKLPSCSL TAPAPKQ-PL  77
SEQ_ID_NO_249   ---------- --GLQLKEQQ SSSAKQAFNH TLVPSSSSLP -------SS  64
SEQ_ID_NO_255   ---------- --DLRDSQPL NGLLAPSSSA SVSSFSSPL- ----------  61
SEQ_ID_NO_265   ---------- --DLQMKEQR SSSAKLVLNQ TLIPDCSNSS SLDTS-HP  72
SEQ_ID_NO_262   ---------- --DIRLKEEE DAKTKSTIET ALSGSSSATV -------T  66
SEQ_ID_NO_251   ---------- --DLCLKEQE ASSKSALSS SPSSSSTVV ----------  64
SEQ_ID_NO_246   ---------- --DLCLKQQQ DASMKSTVES SLSPVIAPV ----------  64
SEQ_ID_NO_274   ---------- --DLCLKNQQ DASMKSTVES SLSAASPPS ----------  64
SEQ_ID_NO_248   ---------- -----STG MTQPALTFSG KEKARSSE-R ------LP  68
SEQ_ID_NO_279   ---------- --DFI----- KLMEAPVVEK KVTTSASSS ----------  67
SEQ_ID_NO_295   ---------- --DFV--KL MEMDAPVVDK KLITTASSL- ----------  63
SEQ_ID_NO_270   ---------- --TLFDQEQ GAKLASAVSG SPSNLKETF ------TA  69
SEQ_ID_NO_267   ---------- --DLMLKQQQ TELAASSIGS ANGGSGSPS KEPDSAIT--  75
SEQ_ID_NO_277   ---------- --DMMLKEEQ AKLAASSFGN VNGTSNSNG NEPV----VA  73
SEQ_ID_NO_286   ---------- --EMIMKQEQ AKLAASSIDS VNGGDSGKE PIIAG--HA  73
SEQ_ID_NO_290   ---------- --EMIMKQEQ AKLAASSIDS VNGGDSGKE PIIAG--HA  73
```

Figure 11 (continued)

| | | | | | | |
|---|---|---|---|---|---|---|
| SEQ_ID_NO_269 | NMCSKCYRDH | LKATSPLFSS | SSSPATASTT | DITVPIAPAT | TAPTPSLKGK | 144 |
| SEQ_ID_NO_298 | NMCSGCYMDF | LKDAH----- | ----ASPAVA | DKVVLAAEK | QPAAAQISAA | 116 |
| SEQ_ID_NO_260 | E--------- | ---------- | ----TKPASV | ETVVAETSS | VPPVATGCDE | 104 |
| SEQ_ID_NO_249 | S--------- | ---------- | ----SARGSF | SASLPAKEFP | SAGTKETKVV | 91 |
| SEQ_ID_NO_255 | ---------- | ---------- | ----TVDVLK | NQIAPVLVVE | GDEKGEFKAE | 87 |
| SEQ_ID_NO_265 | S--------- | ---------- | ----STSPSV | MVSSSTPTV | ELVAAAAGPS | 99 |
| SEQ_ID_NO_262 | A--------- | ---------- | ----TAVVAS | SVESPSAPVE | SLPPPVLIS | 93 |
| SEQ_ID_NO_251 | ---------- | ---------- | ----ESSQV | PLLALHEVNR | ESAVPEIASA | 90 |
| SEQ_ID_NO_246 | ---------- | ---------- | ----LENYAA | ELEPTFKKT | EEKKPQIPT | 90 |
| SEQ_ID_NO_274 | ---------- | ---------- | ----SPEDS | ISTST APVV | QIYAAEIQIE | 90 |
| SEQ_ID_NO_248 | E--------- | ---------- | ----RSDYCR | --RDLITQDD | KKSDDDAK | 93 |
| SEQ_ID_NO_279 | ---------- | ---------- | ----TAPLET | KRDDAPAAAA | TEAVAEKQAE | 93 |
| SEQ_ID_NO_298 | ---------- | ---------- | ----STVPFE | TAKQDDTVPD | AAAMDKQPA | 89 |
| SEQ_ID_NO_270 | D--------- | ---------- | ----LVDACT | KSIEPVAVSV | QAVAEVAPE | 96 |
| SEQ_ID_NO_267 | ---------- | ---------- | ----TVHVDA | GSDSMIVSM | QASHESLLNE | 101 |
| SEQ_ID_NO_277 | A--------- | ---------- | ----GVDVQA | HLVEPKTLSL | QPSFSFGSGS | 100 |
| SEQ_ID_NO_286 | E--------- | ---------- | ----VAVAQV | EVKTLVAQPA | EIAGPSEGVT | 100 |
| SEQ_ID_NO_280 | E--------- | ---------- | ----VAVAQV | EVKTLVAQPA | EIAGPSEGVT | 100 |

| | | | | | | |
|---|---|---|---|---|---|---|
| SEQ_ID_NO_269 | EEEATAAASS | SAAAAAKPNR | CVACRKKVGL | LGFECRCGGT | FCSTHRHADK | 194 |
| SEQ_ID_NO_298 | TSSTAPAA- | -VKAAAAPNR | CASCRKKVGL | LGFPCRCGGT | FCALHRYAEK | 163 |
| SEQ_ID_NO_260 | GEPF------ | --SKPARPNR | CFSCNKKVGV | MGFKCKCGST | FCGSHRYPEK | 145 |
| SEQ_ID_NO_249 | EEE------- | --EQOVEPNR | CLSCKKRVGL | TGFKCRCGMV | FCGLHRYPGT | 132 |
| SEQ_ID_NO_255 | PTA------- | --VVPCQKPNR | CLTCRRRVGL | TGFNCRCGMV | FCGTHRYPEQ | 129 |
| SEQ_ID_NO_265 | EAE------- | --PPKVQPNR | CGTCRRRVGL | TGFKCRCGLT | LCGTHRYPEQ | 140 |
| SEQ_ID_NO_262 | PDI------- | --AAPVQANR | CGACRKRVGL | TGFKCRCGTT | FCGSHRYPEK | 134 |
| SEQ_ID_NO_251 | AFD------- | --RESQQPNR | CMVCRKRVGL | TGFRCKCGVT | FCGSHRYPEN | 131 |
| SEQ_ID_NO_246 | EQP------- | --SPPQRPNR | CTVCRKRVGL | TGFMCRCGTT | FCGSHRYPEV | 131 |
| SEQ_ID_NO_274 | KQI------- | ---GQQRPNR | CTVCRKRVGL | TGFMCRCGTT | FCGTHRYPEV | 130 |
| SEQ_ID_NO_248 | NDSTT KI-- | -VEKKQEVNR | CSGCRRKVGL | TGFRCRCGDM | FCSEHRYSDR | 140 |
| SEQ_ID_NO_279 | QEPF------ | ---PKPPSNR | CLTCRKKVGL | TGFLCRCGDT | FCSTHRYTDS | 133 |
| SEQ_ID_NO_298 | QEPF------ | ---PKPPSNR | CSTCRKKVGL | TGFQCRCGGT | FCSLHRYTDS | 129 |
| SEQ_ID_NO_270 | EAA------- | -AKPKEGPSR | CTTCNKRVGL | TGFNCRCGDL | FCGTHRYADV | 138 |
| SEQ_ID_NO_267 | NNV------- | -LVKEVPPNR | CSACRKRVGL | TGFNCRCGNL | FCAVHRYSDK | 143 |
| SEQ_ID_NO_277 | GSS------- | GEAKPEGPKR | CGTCNKRVGL | TGFNCRCGHL | FCAVHRYSDK | 143 |
| SEQ_ID_NO_286 | VNP------- | --KGREGPNR | CSTCRKRVGL | TGFNCRCGNL | YCAMHRYSDK | 141 |
| SEQ_ID_NO_280 | VNP------- | --KGREGPNR | CSTCRKRVGL | TGFNCRCGNL | YCAMHRYSDK | 141 |

Figure 11 (continued)

| | | | | | |
|---|---|---|---|---|---|
| SEQ_ID_NO_268 | HACTFDFKKS | DREKIAKENP | LIVAPKITKF | | 224 |
| SEQ_ID_NO_298 | HACDFDFKAA | GREKIAKNNP | LVVAAK NKI | | 193 |
| SEQ_ID_NO_260 | HECSFDFKEV | GRGAIAKANP | VVKADKVQRI | | 175 |
| SEQ_ID_NO_249 | TCLCFL---- | ---------- | ---------- | | 137 |
| SEQ_ID_NO_255 | HDCEFDFKSL | GKEQIAKANP | VVKGEKLQRI | | 159 |
| SEQ_ID_NO_265 | HGCGFDFKGM | GREEIKKANP | VVKGEKLNKI | | 170 |
| SEQ_ID_NO_262 | HACGFDFKAV | GREEIARANP | VIKGEKLRRI | | 164 |
| SEQ_ID_NO_251 | HGCTFDFKKV | GREEIARANP | LVKAEKLEKI | | 161 |
| SEQ_ID_NO_246 | HGCTFDFKSA | GREEIAKANP | LV AAKLQKI | | 161 |
| SEQ_ID_NO_274 | HGCTFDFKSA | GREEIAKANP | LVVAAKLQKI | | 160 |
| SEQ_ID_NO_248 | HDCSFDYKAA | GREEIARQNP | VVKAAK RL | | 170 |
| SEQ_ID_NO_279 | HQCTFDYKKV | AREQIAKQNP | VVMAEK NKI | | 163 |
| SEQ_ID_NO_286 | HECTFDYKKV | AREQIAKQNP | VV AEK NKI | | 159 |
| SEQ_ID_NO_270 | HNCSFDYHVA | AQEAIAKANP | VVKADKLDKI | | 168 |
| SEQ_ID_NO_267 | HDCPFDYRSA | AQDAIAKANP | VVKAEKLDKL | | 173 |
| SEQ_ID_NO_277 | HDCPYDYHTA | ARDVIAKANP | VVKADKLEKI | | 173 |
| SEQ_ID_NO_285 | HDCQFDYRTA | ARDAIAKANP | VVKAEKLDKI | | 171 |
| SEQ_ID_NO_290 | HDCQFDYRTA | ARDAIAKANP | VVKAEKLDKI | | 171 |

Figure 12

```
SEQ_ID_NO_310  .......MAE AKGAAAPL- ---AREDGRR RGGAGGATWA Q--TLGNVW      37
SEQ_ID_NO_316  MGFGMG-NDG ASSSSSRLDP APLLPHHGSA GGEIG--LSS QPKTFANVFI    47
SEQ_ID_NO_325  MGFGMGNNNG ASSSSSRLDP APLLPHHGSG SREVG--LSS QPKTFANVFI    48
SEQ_ID_NO_312  MGF----DKE ASSSSSRLDA APLLPQHG-- GGGAGGH-SS QPKTFANVFI     44
SEQ_ID_NO_319  MGL----HKE ASSSSSRLDA APLLPHHGHG GGGAGHH-SS QPKTFANVFI     46
SEQ_ID_NO_321  MGL----HKE ASSSSSRLDA APLLPHHGHG GGGAGHH-SS QPKTFANVFI     46
SEQ_ID_NO_300  MGF----QNE ASSSSYTLKI PPPAREDTPL LGK-GPPLSS QFKTFANVFI     45
SEQ_ID_NO_302  MGFG---RKK ASSSAKTF-- --PPREDTPL IAK-STPLSS QSKTFANVFI     42

SEQ_ID_NO_310  SIVGTGVLGL PYAFRAAGWV AGSLGMAAAG FALLYCMLLL VDCKDKLQEE    87
SEQ_ID_NO_316  AVVGAGVLGL PYTFSHTGWA AGSLLLFAVA VLTFYCMMLL VACRRRLAD-    96
SEQ_ID_NO_325  AVVGAGVLGL PYTFSHTGWA AGTLLLFSVA ALTFYCMMLL VACRRRLAD-    97
SEQ_ID_NO_312  AVVGSGVLGL PYTFSRTGWA AGTLLLLAVA ALTFHCMMLL VAARRRIAD-    93
SEQ_ID_NO_319  AVVGSGVLGL PYTFSRTGWV AGSVLLLAVA ALTFHCMMLL VACRRRLAY-    95
SEQ_ID_NO_321  AVVGSGVLGL PYTFSRTGWV AGSVLLLAVA ALTFHCMMLL VACRRRLAY-    95
SEQ_ID_NO_300  AVVGAGVLGL PYAFKRTGWL MGVLLLVSVS VLTHHCMMLL VYTRRKLDSF    95
SEQ_ID_NO_302  AIVGAGVLGL PYAFKRTGWL MSLIMLFSVA GLTHYCMMLL VNTRGKLQSF    92

SEQ_ID_NO_310  ETDEPKNYTY GDFGEKCFGT IGRCLTEILI LISQAGGSVA YLVFIGENLH   137
SEQ_ID_NO_316  --ERPKIASF GDLGDAVFGA HGRFAVDVML VLSQASFCIG YLIFISNTMA   144
SEQ_ID_NO_325  --EHPKIASF GDLGDAVFGA HGRFAVDVML VLSQVSFCVG YLIFISNTMA   145
SEQ_ID_NO_312  --AHPKIASF GDLGHAIYGA PGRHAVDAML VLSQASFCVG YLIFISNTMA   141
SEQ_ID_NO_319  --DHPKIASF GDLGAAVCGP AGRHVVDAML VLSQASFCVG YLIFISNTMA   143
SEQ_ID_NO_321  --DHPKIASF GDLGAAVCGP AGRHVVDAML VLSQASFCVG YLIFISNTMA   143
SEQ_ID_NO_300  NAGISKIGSF GDLGFAVCGS LGRIVVDLFI ILSQAGFCVG YLIFISTTLA   145
SEQ_ID_NO_302  SGGFSKITSF GDVGFTVCGS IGRFVVDVMI VLSQAGFCIG YLIFIANTLA   142

SEQ_ID_NO_310  SVFS------ ---------- -----QSMS PAGFIFAVLL PVQIALSFL    165
SEQ_ID_NO_316  HLYP----IF APSSS----- ------ALLS PKALFIWAML PFQLGLNSIK   179
SEQ_ID_NO_325  HLYP----IT APSSS----- ------ALLS PKALVIWAML PFQLGLNSIK   180
SEQ_ID_NO_312  HLYPAIGAQ SPAS------ ------PLLT AKALFIWAML PFQLGLNSIR   179
SEQ_ID_NO_319  HLYP-VGDS SPSS------ ------PLLT AKAIFIWVML PFQLGLNSIK   179
SEQ_ID_NO_321  HLYP-VGDS SPSS------ ------PLLT AKAIFIWVML PFQLGLNSIK   179
SEQ_ID_NO_300  NLSD----PE SPTSLRHQFT RLGSEFLGVS SKSLYIWGCF PFQLGLNSIK   191
SEQ_ID_NO_302  NLFN----SP SPNGLASQIL A-----LSMS AKSAYMWGCF PFQLGLNSIA   183
```

Figure 12 (continued)

| | | | | | | | |
|---|---|---|---|---|---|---|---|
| SEQ_ID_NO_310 | SLSSLSPFSI | FADVCNVLAA | AVVIRKDLDL | IDHPFANRSA | FNGVLAPFA | | 215 |
| SEQ_ID_NO_316 | TLTLLAPLSI | FADVVDLGAM | GVVLGQDVAA | MAMPPPVVA | FGGPAALLYG | | 229 |
| SEQ_ID_NO_325 | TLTLLAPLSI | FADVVDLGAM | GVVLGQDVAA | WAKPVPVAA | FGGPAALLYG | | 230 |
| SEQ_ID_NO_312 | TLTLLAPLSI | FADVVDLGAM | GVVLGQDASV | MLADRPPVFA | FAGPAQLLYG | | 229 |
| SEQ_ID_NO_319 | TLTLLAPLSI | FADVVDLGAM | GVVLGQDVST | MLANKPPVFA | SAGPTELLYG | | 229 |
| SEQ_ID_NO_321 | TLTLLAPLSI | FADVVDLGAM | GVVLGQDVST | MLANKPPVFA | SAGPTELLYG | | 229 |
| SEQ_ID_NO_300 | TLTHLAPLSI | FADIVDLGAM | AVVIVEDSM | ILKQRPDVVA | FGGMSLFLYG | | 241 |
| SEQ_ID_NO_302 | TLTHLAPLSI | FADVVDLAAM | GVVIVKDVF | MENRAEVRA | FGGLSVFFYG | | 233 |

| | | | | | | | |
|---|---|---|---|---|---|---|---|
| SEQ_ID_NO_310 | FGVAVFCFEG | FSMTLALESS | MAERRKFRW | LSDAVVGILV | VYACFGVCGY | | 265 |
| SEQ_ID_NO_316 | LGVSVYAFEG | VGMVLPLEAE | AANKRKFGVT | LGLSMAFIAV | MYGLFGVMGY | | 279 |
| SEQ_ID_NO_325 | LGVSVYAFEG | VGMVLPLEAE | AANKKKFGVT | LGLSMAFIAV | MYGLFGVMGY | | 280 |
| SEQ_ID_NO_312 | LGVAVYAFEG | IGMVLPLEAE | AADKRRFGAT | LALSMAFIAV | MYGLFGAMGY | | 279 |
| SEQ_ID_NO_319 | LGVAVYAFEG | IGMVLPLEAE | AADKRKFGGT | LALSMAFIAV | MYGLFGAMGY | | 279 |
| SEQ_ID_NO_321 | LGVAVYAFEG | IGMVLPLEAE | AADKRKFGGT | LALSMAFIAV | MYGLFGAMGY | | 279 |
| SEQ_ID_NO_300 | MGVAVYSFEG | VGMVLPLESE | MKDKDKFGKV | LALGMGFISL | IYLAFGILGY | | 291 |
| SEQ_ID_NO_302 | MGVAVYAFEG | IGMVLPIESE | MREREKFGRI | LGLSMGLISV | IYGAFGVLGY | | 283 |

| | | | | | | | |
|---|---|---|---|---|---|---|---|
| SEQ_ID_NO_310 | LAYGEATKDI | TLNLPNSNS | SAAVKVGLCI | ALAFTFPVMM | HPIHEIVETR | | 315 |
| SEQ_ID_NO_316 | VAFGDATRDI | TTNLGAGWL | SAAVQLGLCI | NLFFTMPVMM | NPVYEVAERL | | 329 |
| SEQ_ID_NO_325 | VAFGDATRDI | TTNLGAGWL | SAAVQLGLCI | NLFFTMPVMM | NPVYEVAERL | | 330 |
| SEQ_ID_NO_312 | LAFGAATRDI | TTNLGTGWL | SVLVQLGLCI | NLFFTMPVMM | NPVYEVAERL | | 329 |
| SEQ_ID_NO_319 | LAFGAATRDI | TTNLGTGWL | SVAVQLGLCI | NLFFTMPVMM | NPVYEVAERL | | 329 |
| SEQ_ID_NO_321 | LAFGAATRDI | TTNLGTGWL | SVTVQLGLCI | NLFFTMPVMM | NPVYEVAERL | | 329 |
| SEQ_ID_NO_300 | LAFGEDTMDI | TANLGAGLV | STVVQLGLCI | NLFFTFPLMM | NPVFEIVERR | | 341 |
| SEQ_ID_NO_302 | FAFGNDTQDI | TANLGPGL | SLLVQLGLCI | NLFFTFPLMM | NPVYEILERR | | 333 |

| | | | | | | | |
|---|---|---|---|---|---|---|---|
| SEQ_ID_NO_310 | LRSSGCFQKL | SHGVPGAEWL | GLHSSRLIMV | TLLTVMASCI | PAFGSFVSFV | | 365 |
| SEQ_ID_NO_316 | L-------- | -HGKRYCWWL | -----RWLLV | VVVGLAAMYV | PNFTDFLALV | | 364 |
| SEQ_ID_NO_325 | L-------- | -HGKRYCWWL | -----RWLLV | IVVGLAAMYV | PNFTDFLALV | | 365 |
| SEQ_ID_NO_312 | L-------- | -CGKRYAWWL | -----RWILV | VLVGLLAMLV | PNFADFLSLV | | 364 |
| SEQ_ID_NO_319 | L-------- | -CRKRYAWWL | -----RWLLV | MVVGLMAMLV | PNFADFLSLV | | 364 |
| SEQ_ID_NO_321 | L-------- | -CRKRYAWWL | -----RWLLV | MVVGLMAMLV | PNFADFLSLV | | 364 |
| SEQ_ID_NO_300 | F-------- | -SRGMYSAWL | -----RWLV | LAVTLVALFV | PNFADFLSLV | | 376 |
| SEQ_ID_NO_302 | F-------- | -WGGRYCLWL | -----RWSV | LLVTLVALMV | PNFADFMSLV | | 368 |

Figure 12 (continued)

| SEQ_ID_NO_310 | GCTVCALLSF | VLPTFFHLN | VGSSMSLWRR | VLDYGFLLFG | LGFAGYGLFT | 415 |
| SEQ_ID_NO_316 | GSSVCVLLGF | VLPASFHLKV | FGAEMAWPGV | LSDALLVVLG | LALAVFGTYT | 414 |
| SEQ_ID_NO_325 | GSSVCVLLGF | VLPASFHLKV | FGSEMEWPGV | VSDVLVVIG | LSLAVFGTYT | 415 |
| SEQ_ID_NO_312 | GSSVCVVLGF | VLPAVFHLKV | FGTFIGWAGL | VADVAIIVTG | LALAVSGTWT | 414 |
| SEQ_ID_NO_319 | GSSVCVLLGF | VLPAAFHLKV | FGAEVGWPGL | AGDVAVIVVG | TALAVSGTWT | 414 |
| SEQ_ID_NO_321 | GSSVCVLLGF | VLPAAFHLKV | FGAEVGWPGL | AGDVAVIVVG | TALAVSGTWT | 414 |
| SEQ_ID_NO_300 | GSSICCVLGF | VLPALFHLLV | FKEEMGWLQW | SSDTAIVVLG | VVLAVSGTWS | 426 |
| SEQ_ID_NO_302 | GSSVCCGLGF | VLPALFHLLV | FKEEMSWKGW | STDVGIVALG | LVLAVSGTWY | 418 |

| SEQ_ID_NO_310 | ALSSH----- | 420 |
| SEQ_ID_NO_316 | SLLQIFHSSG A | 425 |
| SEQ_ID_NO_325 | SLLQIFHSSG A | 426 |
| SEQ_ID_NO_312 | SLVQIFSSSD L | 425 |
| SEQ_ID_NO_319 | SLAQIFSSSD V | 425 |
| SEQ_ID_NO_321 | SLAQIFSSSD V | 425 |
| SEQ_ID_NO_300 | SLSEIFSVKV - | 436 |
| SEQ_ID_NO_302 | ALMEIFAVKV - | 428 |

Figure 13

| SEQ_ID | | | | | | | | |
|---|---|---|---|---|---|---|---|---|
| SEQ_ID_NO_366 | - - - - - | VEAEM | LYSALALTFA | LMVHRILSN | SQNK | - - - - - | RSLINLPPSP | 39 |
| SEQ_ID_NO_348 | - - - - - | VEAEM | LYSALALTFA | FMVYRILSN | SQDK | - - - - - | RSLFKLPPSP | 39 |
| SEQ_ID_NO_365 | - - - - - | VEAEM | LYSALALTFA | FMVYRILSN | SCEK | - - - - - | SSLIKLPPSP | 39 |
| SEQ_ID_NO_346 | - - - - - - - - | MV | LLSELAAATL | FLTTHIFIS | TLLS | - - - - - I | TNGRRLPPGP | 37 |
| SEQ_ID_NO_2546 | - - - | MAPRKSK | TTAMRPPLVS | PPYLSKKIRR | NLKCSYSLKS | | HKKIHLPPSP | 47 |
| SEQ_ID_NO_332 | - - - - - - - - - - | | | | | - - - - - - | - - - - - - - - - - | 0 |
| SEQ_ID_NO_339 | - - - - - | MEALSNV | DFSNCLTLTL | LLLSFLCYS | FFFK | - - - - KP | KDGNLPPSP | 43 |
| SEQ_ID_NO_341 | - - - - - - - - - - | M | EMIVFLFL | VLLISLLSS | SSNN | - - - - - | - - SLQLPKGP | 32 |
| SEQ_ID_NO_2549 | - - - - - | MSTFT | DLGYYTIFFI | LEFISTLLLR | SFLN | N TTS | TLRLRLPPSP | 44 |
| SEQ_ID_NO_2544 | - - - - - - - - | MLL | EIALGLLVLG | LFLHLRPTPS | AKSK | - - - - K | LRHLPNPPSP | 38 |
| SEQ_ID_NO_2541 | - - - - - - - - | MLL | ELALGLLVLA | LFLHLRPTPT | AKSK | - - - - K | LRHLPNPPSP | 38 |
| SEQ_ID_NO_358 | - - - - - - - - | MLL | ELALGLLVLA | LFLHLRPTPT | AKSK | - - - - K | LRHLPNPPSP | 38 |
| SEQ_ID_NO_360 | - - - - - - - - | MLL | ELALGLLVLA | LFLHLRPTPT | AKSK | - - - - K | LRHLPNPPSP | 38 |
| SEQ_ID_NO_339 | - - - - - - - - | MRLV | E-AVTLVLIA | LFIHFRPTPT | AKSK | - - - - K | LRHLPNPPSP | 39 |
| SEQ_ID_NO_2550 | - - - - - - - - | MLV | ELALRLAIA | LFLHLRPTPT | AKSK | - - - - K | LRHLPNPPSP | 38 |
| SEQ_ID_NO_2543 | - - - - - - - - | ML | E-OGYVVLFL | LWFISSIFIR | SLFK | - - - - K | SVCYKLPPGP | 37 |
| SEQ_ID_NO_2551 | - - - - - - - - | ML | DIOGYLVLFL | LWFISTILIR | SIFK | - - - - K | SQCYKLPPGP | 37 |
| SEQ_ID_NO_2548 | MEVATSRELI | NPFAFPLVL | VAGLTTVFYV | LRRR | - - CSG | NGGLRLPPSP | 47 |
| SEQ_ID_NO_353 | - - - - - | MDHQL | VARGLFKPLL | LFVAGLIVLY | ALRR | RRHRR | SSDLRLPPSP | 44 |
| SEQ_ID_NO_354 | - - - - - | MDHQL | VARGLFKPLL | LFVAGLIVLY | ALRR | RRHRR | SSGLRLPPSP | 45 |
| SEQ_ID_NO_334 | - - - - - - - - | MA | DIQGYILLFL | LWLLSTILVR | AILN | - - - KF | RAKPRLPPSP | 38 |
| SEQ_ID_NO_356 | - - - - | MEPCLV | AVSVLVEKLI | CVFFFRPYFH | RYGK | - - - - - | - - NLPPSP | 36 |
| SEQ_ID_NO_349 | - - - - - | MNIFEV | FQSVSPAIIA | LFFISSLFIY | LVLL | - - - - RN | QKSLSLPPSP | 42 |
| SEQ_ID_NO_351 | - - - - - | MNTL | QLFLLFFFP | TLLFLYGLPY | KRNG | - - - - - | NHRRLPPSP | 37 |
| SEQ_ID_NO_2553 | - - - - | MNIFVL | FQSLSPAVIA | AVVLPSLFLY | LLSK | - - - - S | KQNHRLPPSP | 41 |
| SEQ_ID_NO_364 | - - - - - - - - - - | - - MALYAN | LFLLSAAVVR | SVLD | - - - - RK | RGRPPYPPGP | 32 |
| SEQ_ID_NO_347 | - - - - - - - - - - | MSTLVYST | LFILSTLLLT | LLTR | - - - - - | TRRKTRPPGP | 32 |
| SEQ_ID_NO_359 | - - - - - - - - - M | DTVLITLYTA | LFVITTFFLF | LLRR | - - - - - | RGFPSPPGP | 34 |

Figure 13 (continued)

| SEQ_ID_NO | | | | | | | |
|---|---|---|---|---|---|---|---|
| SEQ_ID_NO_366 | PGWLPIIGH | -LHLIK NPL | HRTLYDCSQK | LGSIFSVWFG | --SRLVVVVS | | 84 |
| SEQ_ID_NO_349 | PGWLPVIGH | -AHLMK NLL | HRTLYDFSQK | LGPIFSIRFG | --GRLVVVVS | | 84 |
| SEQ_ID_NO_365 | PGWLPVIGH | -VHLMK NLL | HRTLYDFSQK | LGPIFSLRFG | --TRLVVVVS | | 84 |
| SEQ_ID_NO_346 | -RPDPVIGA- | -LPLLG AMP | HVSLAKMAKK | VGAL MYLKVG | --TCGMVVAS | | 81 |
| SEQ_ID_NO_2546 | -PALPFIGH | -LHILG SLW | HQSFDKLALR | VGPFMLIHAS | --ASWSYVVS | | 81 |
| SEQ_ID_NO_332 | | | | | | | 0 |
| SEQ_ID_NO_338 | -PSLPIIGH | -LHHL SLFM | HRSLQKLSSK | VGPLLYLHVF | --IVPLLVS | | 88 |
| SEQ_ID_NO_341 | -PSIPLLGH | -LHHLT-PSL | YKSLYTLSSK | HGPLLLLRLG | PSRRLLLVS | | 78 |
| SEQ_ID_NO_2549 | -PALPIIGHL | RLHFJ-S-SSI | YKSFHSLSTQ | VGPLLYLHFG | --ASRCLLVS | | 90 |
| SEQ_ID_NO_2544 | KPRLPLIGH | -LHLLKDQLL | HHSLIDLSKR | VGPLYSLYFG | --SMPTVVAS | | 84 |
| SEQ_ID_NO_2541 | KPRLPFIGH | -LHLLKDKLL | HYALIDLSKK | HGPLFSLYFG | --SMPTVVAS | | 84 |
| SEQ_ID_NO_358 | KPRLPFIGH | -LHLLKDKLL | HYALIDLSKK | HGPLFSLYFG | --SMPTVVAS | | 84 |
| SEQ_ID_NO_360 | KPRLPFIGH | -LHLLKDKLL | HYALIDLSKK | HGPLFSLYFG | --SMPTVVAS | | 84 |
| SEQ_ID_NO_339 | KPRLPFVGH | -LHLLDHPLL | HQSLIRLGER | VGPLYSLYFG | --SMPTIVAS | | 85 |
| SEQ_ID_NO_2550 | KPRLPFVGH | -LHLLDDPLL | HHSLIKLGER | VGPLYSLYFG | --SMPTVVAS | | 84 |
| SEQ_ID_NO_2543 | PISFPILGH | -APYLR SLL | HKSLYKLSNR | VGPLMHIMLG | --SQHVVVAS | | 82 |
| SEQ_ID_NO_2551 | PISLPLIGH | -APYLR SLL | HQALYKLSTR | VGPLMHVLDS | --SQHVIVAS | | 82 |
| SEQ_ID_NO_2548 | -LALPVLGH | -FHLLA PLP | HQALHRLASR | HGPLLYLRLG | --SMPRAAC | | 91 |
| SEQ_ID_NO_352 | -FGLPILGH | -LHLLA PLP | HQALHRLAAR | HGPLLFLRLG | --SVPCVAAC | | 88 |
| SEQ_ID_NO_354 | -FGLPILGH | -LHLLA PLP | HQALHRLAAR | HGPLLFLRLG | --SVPCVAAC | | 80 |
| SEQ_ID_NO_334 | -LALPIIGH | -LHLLA PIP | HQALHKLSTR | VGPLIHLFLG | --SVPCVVAS | | 82 |
| SEQ_ID_NO_356 | FFRLPIIGH | -MHMLG PLL | HQSFHNLSHR | VGPLFSLNFG | --SVLCVVAS | | 81 |
| SEQ_ID_NO_349 | -PALPIIGH | -LHHLG PLI | HHSFHDLSTR | VGPLIHLRLG | --SVPCVVAS | | 66 |
| SEQ_ID_NO_351 | -PSFPIIGH | -LHHLG PLI | HQSFHALSTR | VGSLIHLRLG | --SVPCVVVS | | 51 |
| SEQ_ID_NO_2553 | -PSLPIIGH | -LHHLG PLI | HQSFHNLSTR | VGPLIHLRLG | --SVPCVVVS | | 55 |
| SEQ_ID_NO_364 | -FELPIIGH | -LHLLG PRL | HQTFHDLSQR | VGPLMQLRLG | --SIRCVIAA | | 76 |
| SEQ_ID_NO_347 | -LALPLIGH | -LHLLG PKQ | HHTFHDFSQR | VGPLIQLYLG | --SVPCVVAS | | 76 |
| SEQ_ID_NO_359 | -LSLPIIGH | -LHLLG PRL | HHTFHEFSLK | VGPLIQLKLG | --SIPCVVAS | | 78 |

Figure 13 (continued)

| | | | | | | | |
|---|---|---|---|---|---|---|---|
| SEQ_ID_NO_368 | SSSLVEECFT | KYD- | I VLANR | PD-HLDL-RSL | G-STL-SVI GA | PYGDHWRNLR | 133 |
| SEQ_ID_NO_348 | SSSLVEECFT | KYD- | I VLANR | PC-SVDRRSL | GFSTTSVI GA | PYGDHWRNLR | 133 |
| SEQ_ID_NO_365 | SSSLVEECFT | KYD- | I VLANR | PGPSVDRRSL | GFSTTSVI GA | PYGDHWRNLR | 133 |
| SEQ_ID_NO_346 | TPDAAKE-FLK | T-D- | L NFSNR | PPN-B-TH-L | A-GAQD-WFA | H-GP-R-WK-L R | 129 |
| SEQ_ID_NO_2546 | NG-I AKEVFK | TND- | L NFANR | PEF-GSSE-V- Q | I -NDI-ME-SI M | D-NKL-W--FLK | 139 |
| SEQ_ID_NO_332 | | | | | | | 0 |
| SEQ_ID_NO_338 | SPSI A-VE-I FR | TDD- | VN-V-SSR | DFPTHEGS- | LFGSF-GF-S-TA | PYGE-YWKFMK | 138 |
| SEQ_ID_NO_341 | SAAVA-TDVFK | THD- | LAFSSR | P-F-AFAER-L | PFGTSGFVTA | PYGPYWRFMK | 129 |
| SEQ_ID_NO_2549 | SAAMA-AEI FK | TND- | LAFASR | PRLAFADK- L | PYGTSSFI TA | E-YGDYWRFMK | 138 |
| SEQ_ID_NO_2544 | TPELFKLFLQ | THEAASFNTR | FQTSA- KR- L | TYDNS- VAMV | PFGPYWKF-I R | 132 |
| SEQ_ID_NO_2541 | TPELFKLFLQ | THEATSFNTR | FQTSA- RR- L | TYDSS- VAMV | PFGPYWKFVR | 132 |
| SEQ_ID_NO_358 | TPELFKLFLQ | THEATSFNTR | FQTSA- RR- L | TYDSS- VAMV | P-I-SPYWKFVR | 132 |
| SEQ_ID_NO_360 | TPELFKLFLQ | THEATSFNTR | FQTSA- RR- L | TYDSS- VAMV | PFGPYWKFVR | 132 |
| SEQ_ID_NO_332 | TPDLFKLFLQ | THEAVSFNTR | FQTSA- RR- L | TYDNS- VAMV | PFAPYWKF-I R | 133 |
| SEQ_ID_NO_2550 | TPELFKLFLQ | THEA-S-FNTR | FQTSA- RR- L | TYDNS- VAMV | PFAPYWKF-I R | 132 |
| SEQ_ID_NO_2543 | TAEB-AKQI LK | TCE-ESFTNR | PI MI ASEN- L | TYGAADYFFI | PYGN-YWRFLK | 130 |
| SEQ_ID_NO_2551 | SAEMAKQI LK | TYE-ESFCNR | PI MI ASEN- L | TYGAADYFFI | PYGTYWRFLK | 130 |
| SEQ_ID_NO_2548 | SPDAAREVLK | THE-AAFLDR | A-V-PTAVHR- L | V-YGGQDF-I FS | AYGPYWRFMK | 139 |
| SEQ_ID_NO_353 | SPDAAREVLK | THE-AAFLDR | PKPAAVHR- L | TYGGQDFSFS | AYGPYWRFMK | 136 |
| SEQ_ID_NO_354 | SPDAAREVLK | THE-AAFLDR | PKPAAVHR- L | TYGGQDFSFS | AYGPYWRFMK | 137 |
| SEQ_ID_NO_334 | TPEF-AKEFLK | THE- N-SFCDR | PKSTAVDF- | TYGSADFSFA | PYGPYWKFMK | 130 |
| SEQ_ID_NO_355 | TP-HE-AKC-L-Q | TNE- -AFN-CR | I-ESTAVKK- L | TYE-SS- LAFA | PYGDYWRF-I K | 128 |
| SEQ_ID_NO_349 | TPDLARDFLK | TNE- LAFSSR | KHSLA-I DH- V | TYGVS- FAFA | PYGPYWKF-I K | 133 |
| SEQ_ID_NO_351 | TPDLAKDFLK | TNE- LAFSSR | KHSLA-I DH- V | TYGVA- FAFA | PYGTYWKF-I K | 128 |
| SEQ_ID_NO_2553 | TPDLARDFLK | TNE- LAFSSR | KHSLA-I DH- I | TYDVA- FAFA | PYGPYWKF- K | 132 |
| SEQ_ID_NO_364 | SPELAKECLK | THE- LVFSSR | KHSTA-I DI- V | TYDSS- FAFS | PYGPYWKF- K | 123 |
| SEQ_ID_NO_347 | TPELAREFLK | THE- L-D-FSSR | KHSTA-I DI- V | TYDSS- FAFA | PYGPYWKF- K | 123 |
| SEQ_ID_NO_352 | TPELAREFLK | TNE- LAFSSR | KHSTA-I DI- V | TYDSS- FAFS | PYGPYWKY-I K | 125 |

Figure 13 (continued)

| | | | | | | | |
|---|---|---|---|---|---|---|---|
| SEQ_ID_NO_366 | KLCDLEVFAP | TRLASFLSIR | RDERDRMISS | LYKISSAGLA | KVNLEAKIAE | | 183 |
| SEQ_ID_NO_346 | KLCDLEVFAP | TRLASFLSIR | LDERDRMISA | LYKISSAGFA | KVNLEAKIVE | | 183 |
| SEQ_ID_NO_365 | KLCDLEVFAP | TRLASFLSIR | LDERDRMISS | LYKISSAGFA | KVNLETKIVE | | 183 |
| SEQ_ID_NO_348 | KLSNLHMLGG | KALENWANVR | ANELSHMLKS | MFDMSREGE | RVVVAEMLTF | | 178 |
| SEQ_ID_NO_2548 | KICMTELLSA | QQISKFADVR | KEEMMKVLQF | F-LKDEEQGD | AFDVGIDLMD | | 188 |
| SEQ_ID_NO_332 | .......... | .......... | .......... | .......... | ........MK | | 2 |
| SEQ_ID_NO_338 | KLIVTKFLGP | QALERSQKVR | ----RSYVLN | LLDKAVKKE | SVEIAEEAMK | | 181 |
| SEQ_ID_NO_341 | KLCVTELLST | RQLERSRSIR | REETLRSIKR | VIDNAREITV | ALDLGSEFIK | | 175 |
| SEQ_ID_NO_2549 | KLCVTELLGV | KQLERSRVVR | REELDCFLKK | LIVESGENGE | AVDVRAEVMK | | 197 |
| SEQ_ID_NO_2544 | KLIMNDLLNA | TTVNKLRPLR | SHEIRKVLRV | LIAQSAEAQQ | PLNVTEELLK | | 181 |
| SEQ_ID_NO_2541 | KLIMNDLFNA | TTVNKLRPLR | TQQIRKFLRV | MIAQGAEAQK | PLDLTEELLK | | 181 |
| SEQ_ID_NO_358 | KLIMNDLLNA | TTVNKLRPLR | TQQIRKFLRV | MIAQGAEAQK | PLDLTEELLK | | 181 |
| SEQ_ID_NO_360 | KLIMNDLLNA | TTVNKLRPLR | TQQIRKFLRV | MIAQGAEAQK | PLDLTEELLK | | 181 |
| SEQ_ID_NO_339 | KLIMNDLLNA | TTVNKLRPLR | SQEIRKVLNM | LIAKSAQTQE | PLNVTEELLK | | 182 |
| SEQ_ID_NO_2550 | KIIMNDLLNA | TTVNKLRPLR | SQEIRKVLKA | MIAHSAESQQ | PLNVTEELLK | | 181 |
| SEQ_ID_NO_2543 | KLCMTELLSG | KTLEHFVHIR | EDEIKCFMGT | LILEISKNGK | PIEMRHELIR | | 179 |
| SEQ_ID_NO_2551 | KLCMTELLSG | KTLEHFVNIR | EDEIQCFLRN | VILEISKTGK | GVEMRQELIR | | 179 |
| SEQ_ID_NO_2546 | RACVHELLSS | RTLERLRHVR | REEVERLVRS | LSRSAGDDSA | AVDVDAVLMG | | 189 |
| SEQ_ID_NO_353 | RACVHELLAG | RTLDRLRHVR | REEVARLVGS | LIRASADGGE | RVDVDAALMG | | 185 |
| SEQ_ID_NO_354 | RACVHELLAG | RTLDRLRHVR | REEVARLVGS | LIRASADGGE | RVDVDAALMG | | 186 |
| SEQ_ID_NO_334 | KICMTELLGG | RMLDQLPVK | HEEIRQFLQF | LLKKANARE | SIDVGSQLIR | | 179 |
| SEQ_ID_NO_356 | KLSMNELLGS | R3INNFQHLR | AQETHQLLRL | LSNRARAFE | AVNITEELLK | | 177 |
| SEQ_ID_NO_349 | KLTSVELLGN | QNLSNFLPIR | TQEVHELLQT | LMVKSKKNE | SVNLSEELLK | | 182 |
| SEQ_ID_NO_351 | KLITVELLGT | QNLGHFLPIR | THEIRELLRT | LMVKSRAKE | RVNLTEELLK | | 177 |
| SEQ_ID_NO_2553 | KLSTVELLGN | QNLGHFLPIR | TQEIHELLHT | LMEKSKRKE | SVNLTEELLK | | 181 |
| SEQ_ID_NO_364 | KLCTYELLGA | RNLAHFQPIR | TLEVKSFLQI | LMRKGESGE | SFNVTEELVK | | 172 |
| SEQ_ID_NO_347 | KLCTYELLGA | RNLSHFQPIR | ALEVMSFLRI | LYEKFEQKQ | SVNVTEELVK | | 172 |
| SEQ_ID_NO_359 | KLCTYELLGA | RNLGHFQPIR | NLEVRSFLQL | LLMHKSFKGE | SVNVTDELVR | | 174 |

Figure 13 (continued)

| | | | | | | | |
|---|---|---|---|---|---|---|---|
| SEQ_ID_NO_366 | LTFNNLMRML | AGK YYGEEA | EDEEEAKRFR | DMTKEALELM | N TFNLAEIFP | 233 |
| SEQ_ID_NO_346 | LTFNNIMRMV | A K RYYGEEA | EDDEEAKRFR | DLTKEALELT | SASNPGEIFP | 233 |
| SEQ_ID_NO_365 | LTFNNIMRMV | AGKRYYGEEA | EDDEEAKRFR | DLTKEALELT | SASNPGEIFP | 233 |
| SEQ_ID_NO_348 | A A NMI QVI | LSKRVFVN -- | K V-EVN FK | DMV ELM T | G F NI GDFIP | 226 |
| SEQ_ID_NO_2546 | MTNNLICRLI | MSTR S N-- | VN -ES EIR | EIAK VL A | GQL -GEIFG | 234 |
| SEQ_ID_NO_332 | LVNNTVCQME | MGRSCSEE-- | NG -EAERVR | GLVTKTDALT | KKFILAGILR | 48 |
| SEQ_ID_NO_335 | LVNNTVCQME | MGRSCSEE-- | NG -EAERVR | GLVTKTDALT | KKFILAGILR | 227 |
| SEQ_ID_NO_341 | F TNNYTCR A | MSTSCAE --- | C -DAERIR | KLVKE F LA | AKL FGDVLG | 221 |
| SEQ_ID_NO_2549 | LTNH S CRVI | LS RCSED-- | ND -EAERL | EMVTE WELA | VKM FGDVFG | 233 |
| SEQ_ID_NO_2544 | WTNNTISMLM | LG-------- | ----EAEEVR | DLARETVKIF | GEYSLTDF W | 219 |
| SEQ_ID_NO_2541 | WTNSTISMMM | LG-------- | ----EAEEIR | DIAREVLKIF | GEYSLTDF W | 219 |
| SEQ_ID_NO_356 | WTNSTISMMM | LG-------- | ----EAEEIR | DIAREVLKIF | GEYSLTDF W | 219 |
| SEQ_ID_NO_360 | WTNSTISMMM | LG-------- | ----EAEEIR | DIAREVLKIF | GEYSLTDF W | 219 |
| SEQ_ID_NO_339 | WTNSTISRMM | LG-------- | ----EAEEIR | DIARDVLKIF | GEYSLTDF W | 220 |
| SEQ_ID_NO_2550 | WTNNTISRMM | LG-------- | ----EAEEVR | DIAREVLKIF | GEYSLTDF W | 219 |
| SEQ_ID_NO_2543 | HTNN ISRMT | MGKKSSG --- | ND -EVGQLR | KVVREIGELL | GAFNLGDI G | 225 |
| SEQ_ID_NO_2551 | HTNNI ISRMT | MGKKSNG --- | ND -EVGQVR | KLVREIQELL | GAFNLGDI G | 225 |
| SEQ_ID_NO_2548 | VTGDI VSRMV | MSRRWTGD-- | D A T EEMR | SVIAETA T | GTFNLQDY G | 237 |
| SEQ_ID_NO_353 | LTGDI VSRMV | MGRRWTGD-- | DN -DAEEMR | SVVAETAELT | GTFNLQDY G | 231 |
| SEQ_ID_NO_354 | LTGDI VSRMV | MGRRWTGD-- | DN -DAEEMR | SVVAETAELT | GTFNLQDY G | 232 |
| SEQ_ID_NO_334 | LTNNVISRMA | MS QRCSP -- | DD -EAOEVR | NLV EVADLT | GKFNLSDF W | 225 |
| SEQ_ID_NO_358 | LTNNVIS MM | VG-------- | ----EAEEAR | DVVRDVTEIF | GEFNVSDF W | 215 |
| SEQ_ID_NO_349 | LTNNVICQMM | MSIRCSG --- | NN -EADEAK | NLVREVTKIF | GEFN SDF E | 228 |
| SEQ_ID_NO_351 | LTNNVISQMM | MSIRCSG --- | NS -EADEAK | NLVREVTKIF | GQFNVSDF W | 223 |
| SEQ_ID_NO_2553 | LTNNVICQMM | MSIRCSG --- | NS -EADEAK | NLVREVTTIF | GQFNVSDF W | 227 |
| SEQ_ID_NO_364 | LTSNVISHMM | LSIRCSET-- | ES -EAEAAR | TVIREVTQIF | GEFDVSDI W | 218 |
| SEQ_ID_NO_347 | LTSNVIS NMM | LGIRCSG -- | EG -EAE AR | TVIREVTQIF | GEFDVSEIVW | 218 |
| SEQ_ID_NO_359 | LTSNVISHMM | LSIRCSED-- | EG -DAEAAR | TVIREVTQIF | SEFDVTDI W | 220 |

Figure 13 (continued)

| SEQ_ID_NO | | | | | | | | |
|---|---|---|---|---|---|---|---|---|
| SEQ_ID_NO_366 | - LRWLGCNG | FEKQLPVHSR | KTDEIMQGLL | DEHR | - - - - - | - - - - - - - - - | | 266 |
| SEQ_ID_NO_348 | - LRWLGCNG | LEKKLAVHSR | KTDEFMQGLL | DEHR | - - - - - | - - - - - - - - - | | 268 |
| SEQ_ID_NO_365 | - LRWLGFNG | LEKKLAVHAR | KTDEFMQGLL | DEHR | - - - - - | - - - - - - - - - | | 268 |
| SEQ_ID_NO_346 | -CLAMMDLQG | LEKEMKEL HK | KFDALL IKMF | DEHR | - - - - - | - - - - - | AFSV | 262 |
| SEQ_ID_NO_2548 | -PLKKYDLQG | ASRKAKALLL | KFDEL MQGIT | KKHE | - -DER | R- - - - - | - V | 272 |
| SEQ_ID_NO_332 | KPLQKIGISL | FKKELMDASC | KFNEVLEKIL | VEYK | - - - - - | - - - - - | EKVE | 86 |
| SEQ_ID_NO_338 | KPLQKIGISL | FKKELMDASC | KFNEVLEKIL | VEYK | - - - - - | - - - - - | EKVE | 265 |
| SEQ_ID_NO_341 | -PFKELSFW | YGKKALDMST | RYDELLEEVL | KEHE | - -HKR | O - - - - | SRAN | 262 |
| SEQ_ID_NO_2549 | -PLKRLGFW | YGRKAVELT | RYDEILEKML | KEHE | - -ER | - - - - - - - - - | | 268 |
| SEQ_ID_NO_2544 | -PLKKLKFGK | YEKRIDEIFN | KFDPV EKVI | KKRQEI VRRR | KN | - - - | GEVV | 264 |
| SEQ_ID_NO_2541 | -PLKHLKVGK | YEKRIDDILN | KFDPVVERVI | KKRREI VRRR | KN | - - - | GEVV | 264 |
| SEQ_ID_NO_359 | -PLKHLKVGK | YEKRIDDILN | KFDPVVERVI | KKRREI VRRR | KN | - - - | GEVD | 264 |
| SEQ_ID_NO_360 | -PLKHLKVGK | YEKRIDDILN | KFDPVVERVI | KKRREI VRRR | KN | - - - | GEVV | 264 |
| SEQ_ID_NO_339 | -PLKKLKVGK | YEKKIEEIFN | RFDPV EKVI | KKRQDVRRRR | KERN | - - | GELE | 267 |
| SEQ_ID_NO_2550 | -PLKKLKYGQ | YEKRIDEIFN | KFDPV EKVI | KKRQEI KRR | KERQ | - - | GELE | 266 |
| SEQ_ID_NO_2543 | -FMRPLDLQG | FGKRNKDTHH | KMDVMMEKVL | KEHE | - -EAR | AL- - - - | KEGA | 266 |
| SEQ_ID_NO_2551 | -FMRPFDLQG | FGKKNRDAHH | MMDVMMEKVL | KEHE | - -EAR | AKE- - - | KGGA | 268 |
| SEQ_ID_NO_2545 | -VFKYWDMQG | LGKRIDAVHR | KFDAMMERIL | TARDA RRRR | RKEP | - - | ADGA | 284 |
| SEQ_ID_NO_353 | -VFKYWDVQG | LGKRIDAVHR | KFDAMMERIL | TFREAKRKLR | RQ | - - - | AAAD | 276 |
| SEQ_ID_NO_354 | -VFKYWDVQG | LGKRIDAVHR | KFDAMMERIL | TAREAKRKLR | RQ | - - - | AAAD | 277 |
| SEQ_ID_NO_324 | -FCKNLDLQG | FGKRLKEVRK | RFDTMIERI I | MEHE | - -EAR | KKK- - - | KETG | 268 |
| SEQ_ID_NO_358 | -LFKKMDLQG | FGKRIEDLFQ | RFDTLVERI I | SKREQ RKDR | RRNSKEGE | QS | | 264 |
| SEQ_ID_NO_349 | -LFKNIDLQG | FKKRYVDTHT | RYNALLEKMI | FERE | - -EKR | KQ- - - | KKSE | 270 |
| SEQ_ID_NO_351 | -FCKNIDLQG | FKKRYEST HR | RYDALLERI I | MERE | - -EIR | RR- - - | GK K | 265 |
| SEQ_ID_NO_2553 | -FCKNLDLQG | FKKRYEDTHR | RYDALLEKI I | SERE | - -EKR | RK- - - | GGKR | 269 |
| SEQ_ID_NO_364 | -LCKNFDFQG | IRKRSEDI QR | RYDALLEKI I | TDRE | - -KQR | RTH- - | GGGG | 281 |
| SEQ_ID_NO_347 | -FCKNLDLQG | IRKRSEDI RR | RYDALLEKI I | SDRE | - -RLR | LRS- - | GGGG | 281 |
| SEQ_ID_NO_359 | -FCKKFDLQG | IKKRSEDI QR | RYDALLEKI I | SDRE | - -RSR | RQNRDK | HGG | 286 |

Figure 13 (continued)

| SEQ ID | Col1 | Col2 | Col3 | Col4 | Col5 | Col6 | # |
|---|---|---|---|---|---|---|---|
| SEQ_ID_NO_365 | RGERQNTMVD | HLLSL--  | QE | SQPDYYTDEI | TGLIISLII | AGTDASVVTT | 313 |
| SEQ_ID_NO_346 | RGERQNTMVD | HLLSL-- | QE | SQPEYYTDEI | TGLIVALII | AGTDASVVTT | 313 |
| SEQ_ID_NO_325 | RGERQNTMVD | HLLSL-- | QE | SQPEYYTDEI | TGLIVALII | AGTDASVVTT | 313 |
| SEQ_ID_NO_348 | ERKGKFDFLD | CVMENRD | NS | EGERLSITV | KALLLNLFT | AGTDTSSSAI | 310 |
| SEQ_ID_NO_2546 | GGKESRDMMD | LLEIAD | DE | NAEMRLTRNG | KGLFLDLFL | GGTDTTSVAL | 321 |
| SEQ_ID_NO_332 | EHHQGTDMMD | KLLEVYG | DE | KAEYKITRDH | KSLFVDLFF | AGTDTSTHAI | 136 |
| SEQ_ID_NO_338 | EHHQGTDMMD | KLLEVYG | DE | KAEYKITRDH | KSLFVDLFF | AGTDTWFHAI | 314 |
| SEQ_ID_NO_341 | GDCSERDLMD | LLDVYF | DA | HAEFKITMH | KAFFMDLFI | AGTHITSAEAT | 311 |
| SEQ_ID_NO_2549 | GKREDKDLMD | VLLEVYQ | DD | KAGMKLTRTH | KAFILDLFM | AGTNTSAESM | 317 |
| SEQ_ID_NO_2544 | EGEQSGIFLD | TLLEFAE | DE | TMEIK-TKEC | KGLVVDFFS | AGTDSTAVAT | 313 |
| SEQ_ID_NO_2541 | EGEVSGVFLD | TLLEFAE | DE | TMEIKITKDH | KGLVVDFFS | AGTDSTPVAT | 313 |
| SEQ_ID_NO_358 | EGEVSGVFLD | TLLEFAE | DE | TTEIKITKDH | KGLVVDFFS | AGTDSTAVAT | 313 |
| SEQ_ID_NO_320 | EGEVSGVFLD | TLLEFAE | DE | TMEIKITKDH | KGLVVDFFS | AGTDSTAEAT | 313 |
| SEQ_ID_NO_339 | EGEQSVVFLD | TLLDFAE | DE | TMEIKITKEC | KSLVVDFFS | AGTDSTAVAT | 318 |
| SEQ_ID_NO_2550 | EGEQSVVFLD | TLLEFAE | DE | TMEIKITKEC | KGLVVDFFS | AGTDSTAVAT | 315 |
| SEQ_ID_NO_2543 | GSDRKKDLFD | LLNLIE | DD | GAESKLTRDS | AKAFALDMFI | AGTNGPASVL | 316 |
| SEQ_ID_NO_2551 | ESDRKKDLFD | LLNLIE | AD | GAQNKLTRES | AKAFALDMFI | AGTNGPASVL | 317 |
| SEQ_ID_NO_2548 | GEGAVKDLLD | MLFDMHE | DE | AAEMRLTRDN | KAFMLDIFS | AGTDTTAITL | 333 |
| SEQ_ID_NO_353 | GEDDEKDLLD | MLFDMHE | DE | AAEMRLTRDN | KAFMLDIFA | AGTDTTTITL | 326 |
| SEQ_ID_NO_354 | GEDDEKDLLD | MLFDMHE | DE | AAEMRLTRDN | KAFMLDIFA | AGTDTTTITL | 326 |
| SEQ_ID_NO_334 | EGDPVKDLLD | LLDISE | DD | SSEMKLTREN | KAFILDIFA | AGTDTSAVTM | 317 |
| SEQ_ID_NO_355 | SSDGIRDFLD | LLDCTE | DE | NSEIKIGRMH | KALIMDFFT | AGTDTTAIST | 313 |
| SEQ_ID_NO_349 | DGIKGKDFLD | LLDVLE | DE | HAEIKITRDH | KALILDFFT | AATDTTAISI | 316 |
| SEQ_ID_NO_351 | DGIEGKDFLD | MLLDVLE | DG | KAEIKITRDH | KALILDFFT | AGTDTTAIAL | 313 |
| SEQ_ID_NO_2553 | DDVKGTDFLD | MLLDVLE | DG | KAEIKITRDH | KALILDFFT | AATDTTAIAV | 316 |
| SEQ_ID_NO_364 | GGGEAKDFLD | MFLDIME | SG | KAEVKFTREH | LKALILDFFT | AGTDTTAIVC | 310 |
| SEQ_ID_NO_347 | GGGEVKDFLD | MLLDVME | SE | KSEVEFTREH | LKALILDFFT | AGTDTTAITT | 310 |
| SEQ_ID_NO_359 | NNEEAKDFLD | MLLDVME | SG | DEVKFTREH | LKALILDFFT | AGTDTTAIAT | 316 |

Figure 13 (continued)

| SEQ_ID | col1 | col2 | col3 | col4 | col5 | num |
|---|---|---|---|---|---|---|
| SEQ_ID_NO_368 | EWAMSLLLNH | PKVLEKARQE | MOTLVGHERM | VEEDDLPKLR | YLHMILETL | 363 |
| SEQ_ID_NO_348 | EWAMSLLLNH | PKVLEKARKE | LDTLVGHERM | VDEHDLPKLR | YLHCIVLETL | 363 |
| SEQ_ID_NO_365 | EWAMSLILNH | PQVLEKARKE | LDTLVGHERM | VDEHDLPKLR | YLHCIVLETL | 363 |
| SEQ_ID_NO_346 | EWALAEMMKN | PALKKACEE | MDQVIGNNRR | LLESDIPNLP | YLRAISKETF | 360 |
| SEQ_ID_NO_2546 | QWEAEVLNH | PKALKKLQEE | DRVVGPNRL | VDDSDIPNLP | YLQAVVKETL | 371 |
| SEQ_ID_NO_332 | QWMAEIINH | GYILERLREE | DSVVGKTRL | QETDLPNLP | CLQATVKEGL | 185 |
| SEQ_ID_NO_333 | QWMAEIINH | GYILERLREE | DSVVGKTRL | QETDLPNLP | CLQATVKEGL | 364 |
| SEQ_ID_NO_341 | QWAMAELLNH | PEAFQKVRKE | ELVFGNVRL | VDESDITNLP | YLQAVVKETL | 361 |
| SEQ_ID_NO_2549 | QWTIAELINH | PDVFKKVREE | DLAVGRTRL | VEESDIPNLP | YLQAVVKETL | 367 |
| SEQ_ID_NO_2544 | EWALAELINN | PRVLQKAREE | VYSVVGKDRL | VDEVDTQNLP | YIRAIVKETF | 363 |
| SEQ_ID_NO_2541 | EWALAELINN | PKVLEKAREE | VYSVVGKDRL | VDEVDTPNLP | YISAIVKETF | 363 |
| SEQ_ID_NO_359 | EWALAELINN | PKVLEKAREE | VYSVVGKDRL | VDEVDTQNLP | YIRAIVKETF | 363 |
| SEQ_ID_NO_360 | EWALAELINN | PKVLEKAREE | VYSVVGKDRL | VDEVDTQNLP | YIRAIVKETF | 363 |
| SEQ_ID_NO_339 | DWQSELINN | PRVMKKAREE | VDSVVGKDRL | VDEADIQNLP | YIRAVVKETF | 366 |
| SEQ_ID_NO_2550 | DWALSELINN | PRVLKKAREE | VESVVGKDRL | VDEADIQNLP | YIRAIVKETF | 365 |
| SEQ_ID_NO_2543 | EWALAELIRN | PHVFKKAREE | DSTVGKERL | FKESDIPNLP | YLQAVVKETL | 366 |
| SEQ_ID_NO_2551 | EWSLAELIRN | PQVFKKAREE | DSVVGKERL | VKESDIPNLP | YLQAVVKETL | 367 |
| SEQ_ID_NO_2548 | EWALSELINN | PDILRRAQAE | LDAIVGASRL | ADESDIPRLP | YLQAIAKETL | 363 |
| SEQ_ID_NO_353 | EWALSELINN | PPVLRKLQAE | LDAVVGGARL | ADESDIPSLP | YLQAVAKETL | 375 |
| SEQ_ID_NO_354 | EWALSELINN | PPVLRKLQAE | LDAVVGGARL | ADESDIPSLP | YLQAVAKETL | 376 |
| SEQ_ID_NO_334 | EWALAELINN | PNILERAREE | DSVVGQSRL | VCESDIANLP | YVOAILKETL | 367 |
| SEQ_ID_NO_356 | EWALVELVKK | PSVLQKVREE | DNVVGKDRL | VEESDIPNLP | YLQAILKETF | 363 |
| SEQ_ID_NO_349 | EWTLVELTNN | PKVLENARKE | AEVVGDERL | VQESDIPNLP | YIQAIIKETL | 368 |
| SEQ_ID_NO_351 | EWALVELINN | PNALEKARQE | DQVIGDERL | VQESDTPNLP | YIQAIIKEAL | 363 |
| SEQ_ID_NO_2553 | EWTMVELINN | PKVLEKAKKE | VDNVIGNSRL | VQESDAPNLP | YIQAIIKETL | 368 |
| SEQ_ID_NO_364 | EWAIAEVINN | PNVLKKAQEE | ANIVGFDRI | LQESDAPNLP | YLDALIKETF | 360 |
| SEQ_ID_NO_347 | EWAIAELISN | PNVLKKAQEE | MDKVIGSQRL | LQESDAPNLP | YLNAIIKETF | 360 |
| SEQ_ID_NO_369 | EWAIAELINN | PNVLKKAQEE | SRIIGTKRI | VQESDAPDLP | YLQAIIKETF | 365 |

Figure 13 (continued)

| SEQ_ID_NO | | | | | | | | |
|---|---|---|---|---|---|---|---|---|
| SEQ_ID_NO_365 | RLFPSVPTLV | PHEPSEDCM | GGYNVPKGTM | LVNAWAIHR | DPKVV | DDPM | | 412 |
| SEQ_ID_NO_348 | RLFPSVPTLV | PHEPSEDCKI | GGYNVPKGTM | VLVNAWAIHR | DPKVV | DDPL | | 412 |
| SEQ_ID_NO_365 | RLFPSVPTLV | PHEPSEDCKI | GGYNVPKGTM | LVNAWAIHR | DPKVV | DDPL | | 412 |
| SEQ_ID_NO_346 | RHHPSTPLNL | PRSNEPCIV | DGYYIPKNTR | SVNIWAIGR | DPEVV | ENPL | | 409 |
| SEQ_ID_NO_2548 | RVHPSLPLI | FRKCREDCVV | NGYTIPKNSR | LVLNIYAINR | DPNEI | RDAD | | 410 |
| SEQ_ID_NO_332 | RLHPPVPL V | LRTFKEGCTI | GGFYVPEKTT | VVHGYAMMR | DPEYV | EDPQ | | 233 |
| SEQ_ID_NO_339 | RLHPPVPL LV | LRTFKEGCTI | GGFYVPEKTT | VVNGYAMMR | DPEYV | EDPQ | | 412 |
| SEQ_ID_NO_341 | RLYPPAPL F | TRECROHCKI | NEFDVPPKTA | VAINLYAIMR | DPDSI | DNPN | | 409 |
| SEQ_ID_NO_2549 | RLHPPAPL VL | TRECRKNCKI | GGFNIPEKTA | VAINLYAIMR | DPEIV | DDPT | | 415 |
| SEQ_ID_NO_2544 | RMHPPLPL VV | KRKCVEECEI | EGCVIPEGAL | LFNVWAVGR | DPKYV | DRPS | | 411 |
| SEQ_ID_NO_2541 | RMHPPLPL VV | KRKCTEECEI | NGYVIPEGAL | LFNVWQVGR | DPKYV | DRPS | | 411 |
| SEQ_ID_NO_358 | RMHPPLPL VV | KRKCTEECEI | NGYVIPEGAL | LFNVWQVGR | DPKYV | DRPS | | 411 |
| SEQ_ID_NO_360 | RMHPPLPL VV | KRKCTEECEI | NGYVIPEGAL | LFNVWQVGR | DPKYV | DRPS | | 411 |
| SEQ_ID_NO_339 | RMHPPLPL VV | KRKCTEECEI | NGYVIPEGAL | VLFNVWAVGR | DPKYV | DRPL | | 414 |
| SEQ_ID_NO_2550 | RMHPPLPL VV | KRKCVQECEL | NGYVIPEGAL | LFNVWAVDR | DPKYV | EGPS | | 413 |
| SEQ_ID_NO_2543 | RMHPPTPL F | AREATRSCQV | DGYDVPAFSK | FINAWAIGR | DPNYV | DNPL | | 414 |
| SEQ_ID_NO_2551 | RMHPPTPL F | AREAIRGCQV | DGYDIPANSK | FINAWAIGR | DPKYV | DNPQ | | 415 |
| SEQ_ID_NO_2548 | RLHPAFP LV | VRRSTEPCKV | GGYDVPAGST | VFVNVWAIGR | DPACV | APDPL | | 432 |
| SEQ_ID_NO_353 | RLHPTGPL LV | VRRSLERATV | AGYDVPAGAT | VFVNVWAIGR | DAAWV | PEPT | | 423 |
| SEQ_ID_NO_354 | RLHPTGPL LV | VRRSLERATV | AGYDVPAGAT | VFVNVWAIGR | DAAWV | PEPT | | 424 |
| SEQ_ID_NO_334 | RLHPTGPL II | LRESSESCTI | NGYEIPARTR | LFVNVWAINR | DPNYV | ENPL | | 415 |
| SEQ_ID_NO_356 | RLHPPVPL MV | TRRCVAECTV | ENYVIPEDCL | LFVNVWSIGR | NPKFV | DNPL | | 411 |
| SEQ_ID_NO_349 | RMHPPIPL MV | RKSIDNVTV | DGYDIRAGTM | LFVNIWSIGR | NPIV | ESPL | | 418 |
| SEQ_ID_NO_351 | RLHPPIPL ML | RKSTENVIV | DGYDIPAGTL | LFVNIWSIGR | NPQCV | EFPL | | 411 |
| SEQ_ID_NO_2553 | RLHPPIPL ML | RKSIEKVTV | DGYEIPAGTM | LFVNIWSIGR | NAQYV | ESPL | | 418 |
| SEQ_ID_NO_324 | RLHPPIPL ML | ARKSISDCVI | DGYM PANTL | LFVNLWGMGR | NPKIV | DIPT | | 408 |
| SEQ_ID_NO_347 | RLHPPIPL ML | TRKSISDVVV | NGYTIPAKTL | LFVNLWGMGR | NPNYV | ENPM | | 408 |
| SEQ_ID_NO_359 | RLHPPIPL ML | SRKSTSDCTV | NGYK QAKSL | LFVNIWSIGR | NPNYV | ESPM | | 413 |

Figure 13 (continued)

| SEQ_ID | Seq1 | Seq2 | Seq3 | Seq4 | Seq5 | Seq6 | # |
|---|---|---|---|---|---|---|---|
| SEQ_ID_NO_366 | GFKPDRFET | .................. | LE | VETHKLLPFG | MGRRGCPGAG | | 443 |
| SEQ_ID_NO_348 | GFKPDRFEI | .................. | ME | VETHKLLPFG | MGRRACPGAG | | 443 |
| SEQ_ID_NO_365 | GFKPDRFET | .................. | ME | VETHKLLPFG | MGRRACPGAG | | 443 |
| SEQ_ID_NO_346 | EFYPERFLS | ...GRNSKI....D....PR | GNDFELIPFG | AGRRCASTR | | | 447 |
| SEQ_ID_NO_2546 | EFIPERYLVN | GGGEENQLA EPDELEAMK | GQNFCYVPFG | GGRRGCPGAG | | | 468 |
| SEQ_ID_NO_332 | EFKPERFLAS | SRSSQND...E....R | DELLKYLPFG | NGRRACPGAN | | | 273 |
| SEQ_ID_NO_339 | EFKPERFLAS | SRSSQND...E....R | DELLKYLPFG | NGRRACPGAN | | | 452 |
| SEQ_ID_NO_341 | EFEPERFLQE | CDHEDLRD...D....GK | RMKFNFVPFG | GGRRGCPGTA | | | 450 |
| SEQ_ID_NO_2542 | EFRPERFLVP | GKFDVDLD...Q....TK | GQNFNFVPFG | GGRRGCPGTL | | | 456 |
| SEQ_ID_NO_2544 | EFRPERFLEN | GGEGAVSPI...D....LR | GQHFQLLPFG | GGRRMCPGVN | | | 463 |
| SEQ_ID_NO_2541 | EFRPERFLET | GAEGEAGPL...D....LR | GQHFQLLPFG | GGRRMCPGVN | | | 463 |
| SEQ_ID_NO_358 | EFRPERFLET | GAEGEARPL...D....LR | GQHFQLLPFG | GGRRMCPGVN | | | 463 |
| SEQ_ID_NO_360 | EFRPERFLET | GAEGEARPL...D....LR | GQHFQLLPFG | GGRRMCPGVN | | | 463 |
| SEQ_ID_NO_339 | EFRPERFLEN | AGEGDAGSI...D....LR | GQHFQLLPFG | GGRRMCPGVN | | | 456 |
| SEQ_ID_NO_2550 | EFRPERFLT | .AEGGATSI...D....LR | GQNFELLPFG | GGRRMCPGVN | | | 463 |
| SEQ_ID_NO_2543 | VFNPERFLQ | GDDPGKSKI...D....VR | GQYYQLLPFG | GGRRSCPGSS | | | 465 |
| SEQ_ID_NO_2551 | VYEPERFLI | TDEPGKSKI...D....VR | GQYYQLLPFG | GGRRSCPGSS | | | 466 |
| SEQ_ID_NO_2548 | AFRPERFLE | GGEGRGDSAG D....VR | GQHFHLLPFG | GGRRCPGAS | | | 475 |
| SEQ_ID_NO_353 | AFRPERFVS | GGGGGGTAA...D....VR | GQHFHLLPFG | GGRRCPGAS | | | 464 |
| SEQ_ID_NO_354 | AFRPERFVS | GGGGGGTAA...D....VR | GQHFHLLPFG | GGRRCPGAS | | | 465 |
| SEQ_ID_NO_334 | EFEPERFLC | AGEMGKSQL...D....VR | GQHFHFLPFG | GGRRGCPGTT | | | 456 |
| SEQ_ID_NO_356 | EFRPERFLK | LEDDSSBDV...D....VR | GQHFQLLPFG | GGRRMCPGYS | | | 452 |
| SEQ_ID_NO_349 | EFKPHRFLD | ...GARNL...D....VK | GHNFQLLPFG | TGRRGCPG-S | | | 454 |
| SEQ_ID_NO_351 | EFKPHRFLD | .GDLKSSL...D....K | GHNFQLLPFG | TGRRGCPGVN | | | 461 |
| SEQ_ID_NO_2553 | EFEPDRFFE | .GDF.KSSL...D....K | GCGFQLLPFG | TGRRGCPGIN | | | 458 |
| SEQ_ID_NO_364 | AFQPERFLE | ...KEKAAI...D....VK | GQHFELLPFG | TGRRGCPGML | | | 448 |
| SEQ_ID_NO_347 | EFRPERFLEK | GIJSSI....D....VK | GQHFELLPFG | TGRRGCPGML | | | 448 |
| SEQ_ID_NO_359 | EFRPERFLEK | GRESI....D....VK | GQHFELLPFG | TGRRGCPGML | | | 451 |

Figure 13 (continued)

| SEQ_ID_NO | | | | | | | | |
|---|---|---|---|---|---|---|---|---|
| SEQ_ID_NO_366 | LAKKFVGLAL | ASLIQCFDWE | R | SA-EKI | ------DLK | EGAKRI | TLPK | 483 |
| SEQ_ID_NO_348 | LAQKFVGLAL | GSLIQCFDWE | R | TSP--EKI | ------DLN | EGSCI | TLPK | 482 |
| SEQ_ID_NO_365 | LAQKFVGLAL | GSLIQCFEWE | R | MSAL-EKI | ------DLN | EGSG | TLPK | 482 |
| SEQ_ID_NO_346 | MGIVMVEYL | GTLVHSFDWK | L | PSEVELL | ------NME | EAFG-LKLCK | 487 |
| SEQ_ID_NO_2546 | LARAVLHRTL | GVLIQCFDWK | I | KGAL-EKL | ------NME | QGVG-FSSAM | 508 |
| SEQ_ID_NO_332 | LAYISVGTAI | GVMVQCFDWE | | ---KGDKI | ------NMD | EAPGKITLTM | 312 |
| SEQ_ID_NO_335 | LAYISVGTAI | GVMVQCFDWE | | ---KGDKI | ------NMD | EAPGKITLTM | 491 |
| SEQ_ID_NO_341 | LAFSLMNTAV | AAMVQCFDWK | | GKDGKGEKV | ------DME | SGSG-NSLSM | 492 |
| SEQ_ID_NO_2549 | LAFAMMNTTV | AAIVQCFDWK | L | GSDGDGSKV | ------DMQ | SGPG-LTLSM | 498 |
| SEQ_ID_NO_2544 | LSTSGMATLL | ASVIQCFDLQ | V | LDPQGHVL | KGDDAKVSME | ERAG-LTVPR | 501 |
| SEQ_ID_NO_2541 | LATSGMATLL | ASLIQCFDLQ | V | LGPQGQIL | KGGDAKVSME | ERAG-LTVPR | 501 |
| SEQ_ID_NO_358 | LATSGMATLL | ASLIQCFDLQ | V | LGPQGQIL | KGGDAKVSME | ERAG-LTVPR | 501 |
| SEQ_ID_NO_360 | LATSGMATLL | ASLIQCFDLQ | V | LGPQGQIL | KGGDAKVSME | ERAG-LTVPR | 501 |
| SEQ_ID_NO_339 | LATAGMATLL | SSVLQCFELQ | V | AGFNGQIL | KGADAKVSMD | ERPG-LTVPR | 504 |
| SEQ_ID_NO_2550 | LATAGMATLL | ASVIQCFDLQ | V | VGEKGKLL | KGSDAKVSME | ESPG-LTVPR | 501 |
| SEQ_ID_NO_2543 | LALLVIQATL | ASLIQCFDWW | V | NDGKSHD | ------DMS | EVBR-VTVFL | 488 |
| SEQ_ID_NO_2551 | LALLVIQATL | ASLVQCFDWW | V | NDGKNSE | ------DMS | EEBR-VTVFL | 497 |
| SEQ_ID_NO_2548 | LAMLVVQAAL | AAMLQCFEWA | P | VGG--ATV | ------DME | EGPG-TLPR | 514 |
| SEQ_ID_NO_353 | LAMLVVQAAL | AAMVQCFEWS | P | VGG--APV | ------DME | EGPG-TLPR | 503 |
| SEQ_ID_NO_354 | LAMLVVQAAL | AAMVQCFEWS | P | VGG--APV | ------DME | EGPG-TLPR | 504 |
| SEQ_ID_NO_334 | LALQMVQTGL | AAMIQCFDWK | V | NGFVL--- | ------DMQ | EGTS-TLPR | 493 |
| SEQ_ID_NO_356 | LAMQEVPALL | GAIIQCFDFH | V | VGPKGETLL | KGDDVLNVD | ERPG-TAPR | 500 |
| SEQ_ID_NO_349 | LAMRELPVVI | AGLIQCFEWN | A- | NDKF-EVL | ------SMD | ERAG-TAPR | 493 |
| SEQ_ID_NO_351 | LAMRELSVVI | ANLIQCFDWD | V | VGE--RLL | ------NTD | ERAG-TAPR | 490 |
| SEQ_ID_NO_2553 | LAMRELPVVI | AGLIQCFEWD | V | NDKL-EAL | ------ITD | ERAG-TAPR | 495 |
| SEQ_ID_NO_364 | LAIQEVVLI | GTMIQCFDWK | L | PDGSGHV | ------DMA | ERPG-TAPR | 488 |
| SEQ_ID_NO_347 | LGMQELFSII | GAMVQCFDWK | L | PDGVKEV | ------DMT | ERPG-TAPR | 488 |
| SEQ_ID_NO_359 | LAIQEVVSII | GTMVQCFDWK | L | ADGSGNNV | ------DMT | ERSG-TAPR | 492 |

Figure 13 (continued)

| | | | | | | |
|---|---|---|---|---|---|---|
| SEQ_ID_NO_366 | ATTLEAMCKP | RRVMEKVLRQ | VSNV | | | 507 |
| SEQ_ID_NO_348 | AKTLEAMCKP | RHVMEKVLRQ | VSNV | | | 506 |
| SEQ_ID_NO_365 | AKTLEAMCKP | RHIMERVLRQ | VSNV | | | 506 |
| SEQ_ID_NO_346 | AVPLEAMVTP | RLPLDVYAPL | A | | | 508 |
| SEQ_ID_NO_2546 | VHPLCMPVV | R VNPL | ETAN | | | 527 |
| SEQ_ID_NO_332 | AHPLNCTLVP | RTLIPVTSTV | QIPSS | | | 337 |
| SEQ_ID_NO_338 | AHPLNCTLVP | RTLIPVTSTV | QIPSS | | | 516 |
| SEQ_ID_NO_341 | VHPLCVPVV | F PY | D | | | 509 |
| SEQ_ID_NO_2549 | LHPLKCHPIV | H FNPF | EG | | | 515 |
| SEQ_ID_NO_2544 | KHNLVCLPLA | K TLAAKL | LSP | | | 522 |
| SEQ_ID_NO_2541 | AHSLVCVPLA | R GVASKL | LSF | | | 521 |
| SEQ_ID_NO_359 | AHSLVCVPLA | R GVASKL | LSL | | | 521 |
| SEQ_ID_NO_360 | AHSLVCVPLA | R GVASKL | LSL | | | 521 |
| SEQ_ID_NO_339 | AHNLVCVPLA | R PGAAKL | LSS | | | 526 |
| SEQ_ID_NO_2550 | AHNLMCVPLA | R FNVTSE | LSS | | | 522 |
| SEQ_ID_NO_2543 | AKPLKCKPVP | H FVPF | SSA | | | 514 |
| SEQ_ID_NO_2551 | AKPLKCKPVP | R FVPF | SA | | | 514 |
| SEQ_ID_NO_2548 | KRPLVCTVKA | R HPV | PVPTAAAADN | GVDGTLHCA | 548 |
| SEQ_ID_NO_353 | KRPLVCTVSP | R HPL | PAAASASLT | | | 527 |
| SEQ_ID_NO_354 | KRPLVCTVSP | R HPL | PAAASASLT | | | 528 |
| SEQ_ID_NO_334 | AHPLCVPVA | R LNPF | PSF | | | 511 |
| SEQ_ID_NO_356 | AHNLYCVPVD | RTSGSPLKI | EC | | | 523 |
| SEQ_ID_NO_349 | AVDLEFVPLM | R CNCPNF | VSA | | | 514 |
| SEQ_ID_NO_351 | AVDFVCVPLE | R GNTLKI | LGSN | | | 511 |
| SEQ_ID_NO_2553 | AVDFVCVPSM | R ENCPKVF | | | | 513 |
| SEQ_ID_NO_364 | ETDLFCRVVP | R VDPL | VVSTD | | | 508 |
| SEQ_ID_NO_347 | AHDLVCQ-VP | R DPV | VVSGP | | | 508 |
| SEQ_ID_NO_359 | AFDLVCRLVP | R VDPA | TLSGA | | | 512 |

Figure 14

| | | | | | | |
|---|---|---|---|---|---|---|
| SEQ_ID_NO_475 | ---------- | --MSS- | ---- | ------ | RL | ------YVGN | 9 |
| SEQ_ID_NO_436 | MAFCNKLGNL | LRQGATQS-- | ------ | SHAP VSSMLNYLRH | MSSSKL | FIGG | 42 |
| SEQ_ID_NO_420 | MAFLSKVGKI | FRQTSAHVTA | SNSMLQSI-- | -------- | RC | MSSSKI FVGG | 40 |
| SEQ_ID_NO_473 | ---------- | --MAASDV- | ------ | EF- | ---------- | RC------FVGG | 14 |
| SEQ_ID_NO_369 | ---------- | --MAGGE- | ------ | EF- | ---------- | RC------FVGG | 13 |
| SEQ_ID_NO_371 | ---------- | --MASADV- | ------ | EF- | ---------- | RC------FVGG | 14 |
| SEQ_ID_NO_372 | ---------- | --MASADV- | ------ | EF- | ---------- | RC------FVGG | 14 |
| SEQ_ID_NO_373 | ---------- | ----MAEV- | ------ | EY- | ---------- | RC------FVGG | 12 |
| SEQ_ID_NO_458 | ---------- | ----MADV- | ------ | EY- | ---------- | RC------FVGG | 12 |
| SEQ_ID_NO_597 | ---------- | ----MADV- | ------ | EY- | ---------- | RC------FVGG | 12 |
| SEQ_ID_NO_455 | ---------- | --MAAADV- | ------ | EY- | ---------- | RC------FVGG | 14 |
| SEQ_ID_NO_477 | ---------- | --MAAADV- | ------ | EY- | ---------- | RC------FVGG | 14 |
| SEQ_ID_NO_465 | ---------- | --MAASDV- | ------ | EY- | ---------- | RC------FVGG | 14 |
| SEQ_ID_NO_488 | ---------- | --MAAPDV- | ------ | EY- | ---------- | RC------FVGG | 14 |
| SEQ_ID_NO_494 | ---------- | --MAAPDV- | ------ | EY- | ---------- | RC------FVGG | 14 |
| SEQ_ID_NO_374 | ---------- | ---MDAEV- | ------ | EY- | ---------- | RC------FVGG | 13 |
| SEQ_ID_NO_441 | ---------- | ----MAEV- | ------ | EY- | ---------- | RC------FVGG | 12 |
| SEQ_ID_NO_444 | ---------- | --MASADV- | ------ | EY- | ---------- | RC------FVGG | 14 |
| SEQ_ID_NO_451 | ---------- | ----MGDV- | ------ | EY- | ---------- | RC------FVGG | 12 |
| SEQ_ID_NO_595 | ---------- | ----MAEV- | ------ | EY- | ---------- | RC------FVGG | 12 |
| SEQ_ID_NO_474 | ---------- | ----MAEV- | ------ | EY- | ---------- | RC------FVGG | 12 |
| SEQ_ID_NO_447 | ---------- | ----MAEV- | ------ | EY- | ---------- | SC------FVGG | 12 |
| SEQ_ID_NO_450 | ---------- | ---MAAEV- | ------ | EY- | ---------- | SC------FVGG | 13 |
| SEQ_ID_NO_434 | ---------- | --MGSSDV- | ------ | EY- | ---------- | RC------FVGG | 14 |
| SEQ_ID_NO_437 | ---------- | --MAAADI- | ------ | EY- | ---------- | RC------FVGG | 14 |
| SEQ_ID_NO_438 | ---------- | ---MSADI- | ------ | EY- | ---------- | RC------FVGG | 13 |
| SEQ_ID_NO_454 | ---------- | ----MAE-- | ------ | EY- | ---------- | RC------FVGG | 11 |
| SEQ_ID_NO_392 | ---------- | ---MSAEV- | ------ | EY- | ---------- | RC------FVGG | 13 |
| SEQ_ID_NO_425 | ---------- | --MASAEV- | ------ | EF- | ---------- | RC------FVGG | 14 |
| SEQ_ID_NO_504 | ---------- | --MASAEI- | ------ | EF- | ---------- | RC------FVGG | 14 |
| SEQ_ID_NO_368 | ---------- | --MASGDV- | ------ | EY- | ---------- | RC------FVGG | 14 |
| SEQ_ID_NO_422 | ---------- | --MASPDV- | ------ | EY- | ---------- | RC------FVGG | 14 |
| SEQ_ID_NO_596 | ---------- | --MASADV- | ------ | EF- | ---------- | RC------FVGG | 14 |
| SEQ_ID_NO_433 | ---------- | --M--ADV- | ------ | ED- | ---------- | RC------FVGG | 12 |
| SEQ_ID_NO_376 | ---------- | --MASADV- | ------ | EY- | ---------- | RC------FVGG | 14 |
| SEQ_ID_NO_440 | ---------- | --MASADV- | ------ | EY- | ---------- | RC------FVGG | 14 |

Figure 14 (continued)

| SEQ_ID | | | | | | | |
|---|---|---|---|---|---|---|---|
| SEQ_ID_NO_475 | LSWNAKEEDL | RTYFGKFGEV | EEASIALDRE | SGRSRGFGFV | TLPADVALKD | 58 |
| SEQ_ID_NO_436 | LSYGVDDQSL | KDAFASYGEV | VEARVITDRD | TGRSRGFGFV | NFTSDESATS | 92 |
| SEQ_ID_NO_420 | ISYSTDEFGL | REAFSKYGEV | VDAKIIVDRE | TGRSRGFAFV | TFTSTEEASN | 90 |
| SEQ_ID_NO_473 | LAWATDDASL | ERAFSTYGDI | VESKIINDRE | TGRSRGFGFV | TFRDEQSMRD | 64 |
| SEQ_ID_NO_369 | LAWATTDGRL | EGAFRPFGEV | VQSKVISDRE | TGRSRGFGFV | TFADENSMNA | 63 |
| SEQ_ID_NO_371 | LAWSTDDRSL | QEAFSPYGEV | VESKIISDRE | TGRSRGFGFV | TFNDEQSMRD | 64 |
| SEQ_ID_NO_372 | LSWSTDDRSL | KDAFTAFGEV | MDSKVVSDRE | TGRSRGFGFV | TFMDEQSMRD | 64 |
| SEQ_ID_NO_373 | LSWGTDDRSL | AFAFNKFGEV | TDSKIINDRE | TGRSRGFGFV | TFANEQSMRD | 62 |
| SEQ_ID_NO_458 | LAWATDDQSL | DNAFSKYGDV | IDSKIITDRE | TGRSRGFGFV | TFASDEAMRD | 62 |
| SEQ_ID_NO_507 | LRWATDDQSL | QNAFSKYGDV | IDSKIITDRE | TGRSRGFGFV | TFASDEAMRD | 62 |
| SEQ_ID_NO_455 | LAWATNNETL | EQAFANFGQV | IDSKVITDRE | TGRSRGFGFV | TFSSEQSMLD | 64 |
| SEQ_ID_NO_477 | LAWATDNASL | QQAFASYGDV | LDSKVITDRE | TGRSRGFGFV | TFSSEQSMLD | 64 |
| SEQ_ID_NO_465 | LAWATDDHSL | HNAFSTYGEV | LESKIILDRE | TDRSRGFGFV | TFSTEEAMRN | 64 |
| SEQ_ID_NO_488 | LAWATDDRSL | EAAFSTYGEI | LDSKIINDRE | TGRSRGFGFV | TFSSEQSMRD | 64 |
| SEQ_ID_NO_494 | LAWATDDRSL | EAAFSTYGEI | LDSKIINDRE | TGRSRGFGFV | TFSSEQSMRD | 64 |
| SEQ_ID_NO_374 | LAWATDDQSL | ERAFSNYGQV | LESKIINDRE | TGRSRGFGFV | TFSSEQAMRD | 63 |
| SEQ_ID_NO_441 | LAWATNDESL | EQAFSQFGDI | TDSKIINDRE | TGRSRGFGFV | TFKDEKSMRD | 62 |
| SEQ_ID_NO_444 | LAWATTDQSL | SEAFSQYGEI | LESKIINDRE | TGRSRGFGFV | TFKDEQSMRD | 64 |
| SEQ_ID_NO_451 | LAWATTDNTL | SEAFSQYGEV | VESKIINDRE | TGRSRGFGFV | TFKDEQAMRD | 62 |
| SEQ_ID_NO_505 | LAWATTDQTL | GDAFSQFGEI | LDSKIINDRE | TGRSRGFGFV | TFKDEKAMRD | 62 |
| SEQ_ID_NO_474 | LAWATTDQTL | GDAFSQYGEI | LDSKIINDRE | TGRSRGFGFV | TFKDEQAMRD | 62 |
| SEQ_ID_NO_447 | LAWATTDRTL | ADAFGTYGEV | LDSKIINDRE | TGRSRGFGFV | TFKDEKCMRD | 62 |
| SEQ_ID_NO_450 | LAWATTDRTL | SDAFSTYGEV | VDSKIINDRE | TGRSRGFGFV | TFKDEKSMKE | 63 |
| SEQ_ID_NO_434 | LAWATDSDAL | EQAFSKFGEI | TDSKVINDRE | TGRSRGFGFV | TFAEEKSMRD | 64 |
| SEQ_ID_NO_437 | LAWATSDKAL | EEAFSAYGEV | LESKIINDRE | TGRSRGFGFV | TFNNEKSMRD | 64 |
| SEQ_ID_NO_438 | LAWATTDQSL | QEAFSPYGEI | LDSKIINDRE | TGRSRGFGFV | TFNNEKSMRD | 63 |
| SEQ_ID_NO_454 | LAWATNDQSL | EQAFSQFGEI | TDCKIINDRE | TGRSRGFGFV | TFSSSESMKN | 61 |
| SEQ_ID_NO_392 | LAWATTDQVL | QEAFSQYGEI | IDSKIINDRE | TGRSRGFGFV | TFGNEKAMRD | 63 |
| SEQ_ID_NO_425 | LAWATDHDAL | EKAFSQFGEI | VESKVINDRE | TGRSRGFGFV | TFATEQAMRD | 64 |
| SEQ_ID_NO_504 | LAWATDNDAL | ERAFSPFGEI | IESKIINDRE | TGRSRGFGFV | TFSNEKAMRD | 64 |
| SEQ_ID_NO_368 | LAWATDDRAL | ETAFAQYGDV | IDSKIINDRE | TGRSRGFGFV | TFKDEKAMKD | 64 |
| SEQ_ID_NO_422 | LAWATDDRAL | ETAFSQYGEV | LDSKIINDRE | TGRSRGFGFV | TFKDEKSMKD | 64 |
| SEQ_ID_NO_506 | LAWATTDSSL | HEAFSAYGDI | LESKIINDRE | TGRSRGFGFV | TFRDEKSMRD | 64 |
| SEQ_ID_NO_433 | LAWATDNDAL | EKAFSQYGEI | VDSKIINDRE | TGRSRGFGFV | TFANEKSMND | 62 |
| SEQ_ID_NO_376 | LAWATDDRAL | EEAFSVYGEI | VESKIINDRE | SGRSRGFGFV | TFRDEKSMRD | 64 |
| SEQ_ID_NO_440 | LAWATDDHAL | EQAFSQYGEV | VESKIINDRE | TGRSRGFGFV | TFSNEKSMND | 64 |

Figure 14 (continued)

| | | | | | | | | |
|---|---|---|---|---|---|---|---|---|
| SEQ_ID_NO_475 | AI EKTNGAEF | MGRNI KVNEA | SPPGER- PPR | TNN------Y | GGGY | GDFN-- | | 99 |
| SEQ_ID_NO_436 | ALSAMDGQDL | NGRNI RVSYA | NDRPSA---- | ------------ | ---- | P---- | | 119 |
| SEQ_ID_NO_420 | AMQLLDGQDL | HGRFI RVNYA | TERGSGFGGR | G--------F | GGP | ------- | | 124 |
| SEQ_ID_NO_473 | AI KGMNGQTL | DGRNI TVNEA | EVFAAA- VAA | ---------G | TAAAAEVAVT | | | 104 |
| SEQ_ID_NO_369 | AI KEMNGQEL | DGRNI TVNQA | QSRGGG- GGG | GG-------G | GGGY | GR---- | | 101 |
| SEQ_ID_NO_371 | AI DAMNGKML | DGRSI TVNPA | QSRGNG- GGG | GGG------G | SRGY | R----- | | 102 |
| SEQ_ID_NO_372 | AI EGMNGRDL | DGRNI TVNRA | QARGGG- GGG | GG-------G | GGGY | RG---- | | 102 |
| SEQ_ID_NO_373 | AI DFMNGKEL | DGRSI TVNEA | QSRGSG- GGG | ---------G | GGGY | RS---- | | 98 |
| SEQ_ID_NO_458 | AI EAMNGQDL | HSRRBG- GGG | GGFSGG---G | GGGY | GGQRRE | | | 108 |
| SEQ_ID_NO_507 | AI EAMNGQDL | DGRNI TVNEA | QSRRSD- GGG | GFGG-----G | GGGY | GGQRRE | | 106 |
| SEQ_ID_NO_455 | AI ENMNGKEL | DGRNI TVNQA | QSRGGG- GGG | GGYGG----G | GGGY | ------ | | 103 |
| SEQ_ID_NO_477 | AI EAMNGKDL | DGRNI TVNQA | QSRGGG----- | ---------G | GGGY | ------ | | 95 |
| SEQ_ID_NO_465 | AI EGMNGKEL | DGRNI TVNEA | QSRGGR- GG | ---------G | GGGY | G----- | | 98 |
| SEQ_ID_NO_488 | AI EGMNGKEL | DGRNI TVNEA | QSRRBG- GGG | ---------G | GGGY | ------ | | 98 |
| SEQ_ID_NO_494 | AI EGMNGKEL | DGRNI TVNEA | QSRRBG- GGG | GGYGG----G | GGGY | ------ | | 103 |
| SEQ_ID_NO_374 | AI EGMNGQDL | DGRNI TVNEA | QSRGSG- GGG | GGYRGG---G | GGGY | ------ | | 103 |
| SEQ_ID_NO_441 | AI EGMNGQEL | DGRNI TVNEA | QSRGSG- GGG | GRREG----G | GGGY | ------ | | 101 |
| SEQ_ID_NO_444 | AI EGMNGQTL | DGRNI TVNEA | QSRGSG- GN- | ---------G | GGGF | RGPRRD | | 103 |
| SEQ_ID_NO_451 | AI EGMNGQDL | DGRNI TVNEA | QSRGGG- GGG | GGR------G | GGCY | GGGRRE | | 105 |
| SEQ_ID_NO_505 | AI EGMKGQDL | DGRNI TVNEA | QSRGSG- GGG | ---------G | GGGY | R----- | | 97 |
| SEQ_ID_NO_474 | AI EGMNGQDL | DGRNI TVNEA | QSRGSG- GGG | GG-------Y | RGG | - R---- | | 98 |
| SEQ_ID_NO_447 | AI EGMNGQEL | DGRSI TVNEA | QARGSG- GGG | GG-------Y | GGC | RRE---- | | 100 |
| SEQ_ID_NO_450 | AI SGMNGSEL | DGRNI TVNEA | QARGSG- GGG | G--------G | GGGF | GGGRRR | | 104 |
| SEQ_ID_NO_434 | AI EEMNGQDI | DGRNI TVNEA | QSRGSG- GGG | RGGGGGGYGG | GGGY | GG---- | | 109 |
| SEQ_ID_NO_437 | AI EGMNGQNL | DGRNI TVNEA | QSRGGG- GGF | ---------G | GGGY | R----- | | 98 |
| SEQ_ID_NO_438 | AI QGMNSDEL | DGRNI TVNEA | QSRGSG- GGG | ---------G | GGGY | SR---- | | 99 |
| SEQ_ID_NO_454 | AI EGMNGQDL | DGRNI TVNEA | QSRSGG----- | ---------G | GGGY | ------ | | 92 |
| SEQ_ID_NO_392 | AI DGMNGQDL | DGRNI TVNEA | QSRGSG- GGG | G--------G | GGGY | NR---- | | 100 |
| SEQ_ID_NO_425 | AI EGMNGQNL | DGRNI TVNEA | QSRGKGGGGG | GGGYGG---G | GGGY | ------ | | 105 |
| SEQ_ID_NO_504 | AI EGMNGQNL | DGRNI TVNEA | QSRGSG- GGG | GG-------N | GGGY | SR---- | | 102 |
| SEQ_ID_NO_368 | AI EGMNGQDL | DGRSI TVNEA | QSRGSG- GGG | GHRGG----G | GGGY | R---- | | 104 |
| SEQ_ID_NO_422 | AI EGMNGQDL | DGRSI TVNEA | QSRGSG- GGG | GGRG-----G | GGGY | R----- | | 103 |
| SEQ_ID_NO_506 | AI EGMNGQNL | DGRNI TVNEA | QSRGSG- GGG | GGGYGSR--G | GGGY | ------ | | 105 |
| SEQ_ID_NO_433 | VI EAMNGQDL | DGRNI TVNQA | QSRGSG- GGG | GGR------G | GGGY | ------ | | 99 |
| SEQ_ID_NO_376 | AI EGMNGQNL | DGRNI TVNEA | QSRRBG- GGG | GEGYGG---G | SGGY | KR---- | | 106 |
| SEQ_ID_NO_440 | AI EGMNGQNL | DGRNI TVNEA | QSRGSG- GGG | GRREGG---G | GGGY | GR---- | | 106 |

Figure 14 (continued)

| | | | | | | |
|---|---|---|---|---|---|---|
| SEQ_ID_NO_475 | GNGGGRDYG | ---------- | RGGYGRG | ------ NGGY | GGRNAG-YGG | 128 |
| SEQ_ID_NO_436 | RGGG-GGY- | ---------- | GGGY---- | --------------- | -G-DGF | 134 |
| SEQ_ID_NO_420 | GGGNAGGYGA P- | --------- | SGGYGGG- | ------GGY | -----G-GGA | 149 |
| SEQ_ID_NO_473 | EVVG----- | ---------- | TAATAGTA- | --------------- | -----V-DRR | 120 |
| SEQ_ID_NO_369 | REQGGGGY- | ---------- | GGGYGGSR- | ------GGG | -----D-REG | 124 |
| SEQ_ID_NO_371 | GGGG----- | ---------- | GGGYGGSRD RG---- | DRGY | -----G-GGG | 125 |
| SEQ_ID_NO_372 | GGGG----- | ---------- | SGGYGGG- | ------SGGY | ESRRSG-GGG | 127 |
| SEQ_ID_NO_373 | GGGG----- | ---------- | GGGYGGG- | ------GGGY | GGRREG-GGG | 122 |
| SEQ_ID_NO_458 | GGGGGGGY- | ---------- | GGGRSGG- | ------GGGY | GS---R-EGG | 133 |
| SEQ_ID_NO_507 | GGGG-GYGG G- | -------- | GGGYGGGR- | --------------- | -----S-GGG | 127 |
| SEQ_ID_NO_455 | GGREGGGYGG G- | -------- | GGGYGGRRE G- | ----GGGY | GGGGYG-GGG | 137 |
| SEQ_ID_NO_477 | GGGRQGGYGG G- | -------- | GGGYGGGGG | ------GGGY | GG---G-RRE | 125 |
| SEQ_ID_NO_465 | GGRGGGGYGG | GGRRDG---- | GGGYGGG- | ------GGGY | ----------GGG | 128 |
| SEQ_ID_NO_488 | GGGG-GGYGG | GRG------- | GGGYGGGG- | ------GGGY | GRREGGYGGG | 132 |
| SEQ_ID_NO_494 | GGGGGGGYGR R- | -------- | EGGYGGG- | --------------- | -----G-GYG | 125 |
| SEQ_ID_NO_374 | GGRREGGYNR GG- | -------- | GGGYGGG- | ------GGGY | -----G-GGG | 130 |
| SEQ_ID_NO_441 | -GGG-GGYGG | RREGGG---- | GGGYGGRR- | --------------- | -----E-GGG | 127 |
| SEQ_ID_NO_444 | GGGG-GGYGG | GRR------- | DGGYGGN- | ------GGY | GG---G-RRE | 131 |
| SEQ_ID_NO_451 | GGGG-GYGG- | ---------- | GGGYGGGRR E- | --------------- | -----G-GGG | 127 |
| SEQ_ID_NO_505 | GGGG-GGYGG | GGRR------ | EGGYGGG- | ------GGY | GG---G-RRE | 126 |
| SEQ_ID_NO_474 | GGGG-GGYGG | GGRR------ | EGGYGGG- | ------GGGY | GG---G-RRE | 128 |
| SEQ_ID_NO_447 | GGGG-GYGG | G--------- | GGGYGGGRR | --------------- | -----E-GGG | 122 |
| SEQ_ID_NO_450 | EGGG-GGYGG | ---------- | GGGYRGGG- | ------GGGY | -------GGG | 128 |
| SEQ_ID_NO_434 | GGGGYGGGGC | RRDGGYSRSG GGGGYGGGG- | ------DRGY | G----G-GGG | 147 |
| SEQ_ID_NO_437 | NGGG-GGYGG | GRR------- | EGGYGGG- | ------GGY | -----S-RGG | 124 |
| SEQ_ID_NO_438 | GGGG-GGYGG | GGRR------ | EGGYGGG- | ------GGGY | NSRS-S-GGG | 131 |
| SEQ_ID_NO_454 | SRGG----- | ---------- | --------- | --------------- | ----------- | 96 |
| SEQ_ID_NO_392 | NSGG-GGYGG | GGRREG---- | GGGYSRG- | ------GGGY | GG---G-GGG | 132 |
| SEQ_ID_NO_425 | GGGG-GYSR G- | -------- | GGGYGGGGG RR- | ---EGGY | NR---N-GGG | 135 |
| SEQ_ID_NO_504 | GGGG-GGYGG | ---------- | GGGYGGGGR R- | ----EGCG | OGYSRG-GGG | 134 |
| SEQ_ID_NO_368 | SGGG-GGYSG --G | ------- | GGSYGGGG- | --------------- | ------------ | 122 |
| SEQ_ID_NO_422 | SGGG-GGYGG G- | -------- | GGGYGGGGR | ------EGGY | -----S-GGG | 130 |
| SEQ_ID_NO_506 | GGGGRRESGG | ---------- | GGGYGGSR- | --------GY | -----G-GGG | 129 |
| SEQ_ID_NO_433 | GGGG----- | ---------- | --------- | --------------- | ------------ | 103 |
| SEQ_ID_NO_376 | SGGG-GGYGR --R- | ------- | EGGYGGGRR EGVFWNGGY | DG---G-GGG | 141 |
| SEQ_ID_NO_440 | REGG-GGYSR GGG- | ------- | GGGYGGG- | ------GGGY | G----G-GNG | 134 |

Figure 14 (continued)

| | | | | | | | |
|---|---|---|---|---|---|---|---|
| SEQ_ID_NO_475 | RGNFG - GQG | | GYGD | NRFGNDNFGG | SYGGRGGYRG | -PRGPSAEEN | 169 |
| SEQ_ID_NO_436 | SNRGG - GGG | | | | | | 142 |
| SEQ_ID_NO_420 | GGYGA - -PGG | | GYGX | - - -WWWL-RR | RCWWLRC- - - | | 174 |
| SEQ_ID_NO_473 | MGTGG- - - - | | | - - - - - -AK | AVVRLPR- - - | | 134 |
| SEQ_ID_NO_369 | SGYGG - SRG | G- - - - - | GYG- | - - - - - - -GG | GGGGYGG - R | -GG- - - - - - - | 148 |
| SEQ_ID_NO_371 | GGYGG - GGG | | GYG- | - - - - - - -GG | GGSRYGG- - - | -GG- - - - - - - | 147 |
| SEQ_ID_NO_372 | SGGGGYSGGG | RERSER | GYGG | GSRN- - - -GG | GYGGYSG- GG | -GGGSRYGGG | 171 |
| SEQ_ID_NO_373 | GGYGG - GSG | G- - - - - | GYGG | - - -RRE- -GG | GGGGYGG- G | -GGGGYRG- - | 155 |
| SEQ_ID_NO_458 | GGYGG - GGG | | GYGG | SRGGS- - -GG | GGGGYGGSRG | -G- - - - - - - | 163 |
| SEQ_ID_NO_507 | GGYGSRDGGG | G- - - - - | GYL- | - - - - - - -GG | GGGGYGG- S | RGG- - - - - - | 153 |
| SEQ_ID_NO_455 | GGYGGREGGG | | GYGG | - - - - - - -GG | GYGGNRG- - - | | 160 |
| SEQ_ID_NO_477 | GGYGG - GGG | GGRREG | GYG- | - - - - - - -GG | GYGSRG- - - | | 150 |
| SEQ_ID_NO_465 | GGYGG - GGG | | GYGG | - - - - - - -GN | RGGGYGN- - - | | 149 |
| SEQ_ID_NO_488 | GGYGGGRGGG | G- - - - - | GYG- | - - - - - - -GS | RGGGYGG- - - | | 155 |
| SEQ_ID_NO_494 | GGRGG - GGG | | GYG- | - - - - - - -GS | RGGGYGG- - - | | 145 |
| SEQ_ID_NO_374 | GGYGG - GGG | | GYCG | - - - - - - -GR | REGGYGG- G | -GGDRYARG- | 160 |
| SEQ_ID_NO_441 | GGYGG - GGG | | GYGG | RR- - - - - -EG | GDGGYGG- - - | | 150 |
| SEQ_ID_NO_444 | GGYGG - GDR | | GYG- | - - - - - - -GG | GGGGSRYSRG | -GG- - - - - - - | 156 |
| SEQ_ID_NO_451 | GGYSG - GGG | | GYGG | GRREGGY- GG | GGGGYGGGDR | YSDRSSRGGG | 168 |
| SEQ_ID_NO_505 | GGYGG - GGG | G- - - - - | GYCG | - - - - - - -GR | REGGYGG- - - | | 148 |
| SEQ_ID_NO_474 | GGYGG - GGG | | YGG | - - - - - - -GR | REGGYGG- - - | | 148 |
| SEQ_ID_NO_447 | GGYGG - GRR | | | - - - - - - -EG | GGGGYGG- - - | | 139 |
| SEQ_ID_NO_450 | RREGG - GGG | | GYGG | GRRE- - - -GG | GGGGYGG- - - | | 153 |
| SEQ_ID_NO_434 | GGYGG - GRD | R- - - - - | GYGG | - - - - - - -GG | GDRGYGG- GG | -GGDRYSRGG | 180 |
| SEQ_ID_NO_437 | GGYGG - GGG | | GYG- | - - - - - - -GG | RDRGYGGGGD | -GGSRYSRGG | 156 |
| SEQ_ID_NO_438 | GGYGG - GRD | Q- - - - - | GYGG | - - - - - - -GG | GGSRYSR- - G | -GG- - - - - - - | 156 |
| SEQ_ID_NO_454 | - - - - - - GGG | | | | | | 99 |
| SEQ_ID_NO_392 | YGSGG - GGG | | GYG- | - - - - - - -GG | RDRGYGD- - - | - -GGSRYSSR | 160 |
| SEQ_ID_NO_425 | GGYGG - GGG | GYGGGG | GYGG | - - - - - - -GG | RDRGYGG- -D | -GGSRYSRGG | 172 |
| SEQ_ID_NO_504 | GGYGS - GGG | | GYGG | G- - - - - - -GR | REGGYGGGEG | -GGARYSRGS | 168 |
| SEQ_ID_NO_368 | -GRRE- GGG | | GYG- | - - - - - - -GG | EGGGYGG- S | -GG- - - - - - - | 144 |
| SEQ_ID_NO_422 | GGYSSRGGGG | G- - - - - | GYGG | GGRRD- - -GG | EGGGYGG- S | -GG- - - - - - - | 162 |
| SEQ_ID_NO_506 | GGYGGREGG | YSRDG- | GYG- | - - - - - - -GD | GGSRYSR- S | -GA- - - - - - - | 159 |
| SEQ_ID_NO_433 | | | | | | | 103 |
| SEQ_ID_NO_376 | GGYGG - GGG | | GYG- | - - - - - - -GG | GGGGY- - - - | | 159 |
| SEQ_ID_NO_440 | GGYGG - GRE | QR- - - - | GYGD | - - - - - - -SG | GGSRYSR- - - | | 157 |

Figure 14 (continued)

| SEQ_ID | Sequence | # |
|---|---|---|
| SEQ_ID_NO_475 | NSNNYGGY- | 177 |
| SEQ_ID_NO_436 | ----GGGW- | 146 |
| SEQ_ID_NO_420 | --SSWWLWRR WLQCSRWWLR RWLILWWKCC WWRLWR | 208 |
| SEQ_ID_NO_473 | ----SEGWAS | 140 |
| SEQ_ID_NO_369 | --PSSGNWRN DRQPEY---- | 162 |
| SEQ_ID_NO_371 | --SEGGSWRR | 155 |
| SEQ_ID_NO_372 | GVSDDGGWRS | 181 |
| SEQ_ID_NO_373 | --NSDGNWRN | 163 |
| SEQ_ID_NO_458 | --SGGNWRE | 171 |
| SEQ_ID_NO_507 | --SGGGNWRE | 181 |
| SEQ_ID_NO_455 | --DSGGNWRN | 168 |
| SEQ_ID_NO_477 | --DSGGNWRN | 158 |
| SEQ_ID_NO_465 | ---SDGNWRN | 156 |
| SEQ_ID_NO_488 | --DSGGNWRN | 163 |
| SEQ_ID_NO_494 | --DSGGNWRN | 153 |
| SEQ_ID_NO_374 | --NSDSDWRN | 168 |
| SEQ_ID_NO_441 | ----GGGGSR W- | 157 |
| SEQ_ID_NO_444 | --ASDGNWRN | 164 |
| SEQ_ID_NO_451 | GGSSDGNWRN | 178 |
| SEQ_ID_NO_505 | --GSEG--- | 152 |
| SEQ_ID_NO_474 | --GSEGNWRN | 156 |
| SEQ_ID_NO_447 | --GGYGGGGR Y- | 148 |
| SEQ_ID_NO_450 | --GGYGGGDR Y- | 162 |
| SEQ_ID_NO_434 | GADSGGNWRD | 190 |
| SEQ_ID_NO_437 | G-ASEGNWRS | 165 |
| SEQ_ID_NO_438 | --ESDGNWKN | 164 |
| SEQ_ID_NO_454 | --DSGGNWRN | 107 |
| SEQ_ID_NO_392 | GESEGGSWRS | 170 |
| SEQ_ID_NO_425 | GCSDGGSWRN | 162 |
| SEQ_ID_NO_504 | GCSEGGSWRS | 178 |
| SEQ_ID_NO_366 | ----GGGW- | 148 |
| SEQ_ID_NO_422 | ----GGGW- | 166 |
| SEQ_ID_NO_506 | --SDGGSWRN | 167 |
| SEQ_ID_NO_433 | ----GG--- | 105 |
| SEQ_ID_NO_376 | ----GG--- | 161 |
| SEQ_ID_NO_440 | -DSDGGNWRS | 166 |

Figure 15

| | | | | | | | |
|---|---|---|---|---|---|---|---|
| SEQ_ID_NO_527 | | ---MAGLSV | VVVVAFLHI | LAFVLAIGAE | NRRST----- | ---------- | 32 |
| SEQ_ID_NO_529 | | MGDVGRSSL | VHILVIALCL | AAFGFAIAAE | RRRST----- | ---------- | 35 |
| SEQ_ID_NO_530 | | MGDTERSSL | VHILVIALCL | TAFGFAIAAE | RRRSTVKSTY | LRYILNFVFE | 50 |
| SEQ_ID_NO_531 | | MGDTERSSL | VHILVIALCL | TAFGFAIAAE | RRRST----- | ---------- | 35 |
| SEQ_ID_NO_510 | | MGE-GKASTL | VFILVVALSL | VAFGFSIAAE | RRRSI----- | ---------- | 34 |
| SEQ_ID_NO_525 | | MGE-GKGSTL | VFILVIALCL | VAFGFSIAAE | RRRSI----- | ---------- | 34 |
| SEQ_ID_NO_521 | | MAE-GRGSTL | VHLLVVVLCL | VAFGFAIAAE | RRRSV----- | ---------- | 34 |
| SEQ_ID_NO_513 | | MGE-GKGSTL | VHLLVVVLSL | VAFGFAIAAE | RRRSV----- | ---------- | 34 |
| SEQ_ID_NO_517 | | MEE-GKGSTL | VHLLVVVLSL | VAFGFAIAAE | RRRSI----- | ---------- | 33 |
| SEQ_ID_NO_511 | | ----MASKL | LLIAMFVLDL | IAFGLAVAAE | QRRST----- | ---------- | 30 |
| SEQ_ID_NO_523 | | -----MASIL | VQVSALLLNL | IAFGLAVAAE | QRRSK----- | ---------- | 30 |

| | | | | | | | |
|---|---|---|---|---|---|---|---|
| SEQ_ID_NO_527 | ---------- | ---GKVVPDE | YDERTFCAYD | SDASTAYGLS | AFGLLLLSQA | | 69 |
| SEQ_ID_NO_529 | ---------- | ---GSIVTDS | S-NTTFCVYD | SDIATGYGVG | AFLFLLSGHS | | 71 |
| SEQ_ID_NO_530 | FMDGVFFTIY | IVQGSIVTDS | F-NSTFCVYD | SDIATGYGVG | AFLFLLSGQS | | 99 |
| SEQ_ID_NO_531 | ---------- | ---GSIVTDS | F-NSTFCVYD | SDIATGYGVG | AFLFLLSGQS | | 71 |
| SEQ_ID_NO_510 | ---------- | ---GKSIQDP | ITNTTFCVYD | SDVATGYGVG | AFLFLLSSES | | 71 |
| SEQ_ID_NO_525 | ---------- | ---GKSIQDP | ITNATYCVYS | SDVATGYGVG | AFLFLLSSES | | 71 |
| SEQ_ID_NO_521 | ---------- | ---GTMHIKIE | GTNETFCSYS | SDVATGYGVG | AFLFLLSXES | | 71 |
| SEQ_ID_NO_513 | ---------- | ---GTVVKDD | ITNSTYCVYN | SDVATGYGVG | AFLFLLSGES | | 71 |
| SEQ_ID_NO_517 | ---------- | ---------- | ---------- | ------YGVG | AFLFLLSSES | | 47 |
| SEQ_ID_NO_511 | ---------- | ---AKIVQDS | EVNYNYCVYD | SYSTGYGVG | AFLFLMVSQA | | 67 |
| SEQ_ID_NO_523 | ---------- | ---ATVTPDL | AKEYDYCVYD | SDVATGYGVG | ALLLLVAAQA | | 67 |

| | | | | | | |
|---|---|---|---|---|---|---|
| SEQ_ID_NO_527 | VMSAATRCLC | FGRGLSAGGP | RTCAIASFVV | SWISFLVAEV | CLLAGSARNA | 119 |
| SEQ_ID_NO_529 | LLMGLTKCMC | FGAPLAPGGS | RAWSIIYFAS | SWVTFAIAEA | CLIAGATKNA | 121 |
| SEQ_ID_NO_530 | LLMVVTKCMC | FGKPLAPGGS | RAWSIIYFAS | SWVTFMIAES | CLIAGATKNA | 149 |
| SEQ_ID_NO_531 | LLMVVTKCMC | FGKPLAPGGS | RAWSIIYFAS | SWVTFMIAES | CLIAGATKNA | 121 |
| SEQ_ID_NO_510 | LLMSVTKCMC | FGRPLAPGSD | RAWSIIYFIS | SWMTFLVAEA | CVIAGATKNA | 121 |
| SEQ_ID_NO_525 | LLMGVTKCMC | FGRPLSPGSD | RAWSIIYFIS | SWMTFLVAEA | CLIAGATKNA | 121 |
| SEQ_ID_NO_521 | LXMGVTKCMC | FGRPLTPGVN | RAXSIXYFLS | SWVTFXVAEA | CLIAGATKNA | 121 |
| SEQ_ID_NO_513 | LLMGVTKCMC | FGRPLAPGSD | RAWSIIYFVS | SWLTFLVAEA | CLIAGATRNA | 121 |
| SEQ_ID_NO_517 | LLMGITKCMC | FGRSLAPGGD | RAWAIIYFVS | SWATFLVAEG | CLIAGAKKNA | 97 |
| SEQ_ID_NO_511 | LIMAASKCFC | CGKGLNPSGS | RAWAVILFIV | CMLFFLIAEI | CLLAGSVRNA | 117 |
| SEQ_ID_NO_523 | VVMLASRCFC | CGRGLKPGGS | RACALMLFLF | SWLTFLVAAA | CLLAGSVRNA | 117 |

Figure 15 (continued)

| | | | | | | | |
|---|---|---|---|---|---|---|---|
| SEQ_ID_NO_527 | YHTKYVGYYA | KKDLSSCTAL | RKGVFAAGAT | FVLLSMISSL | LYYMSYSKA- | 168 |
| SEQ_ID_NO_529 | YHTKYRDMVY | AGNW-TCQSL | RKGVFIAGAV | FVVFTMILDV | YFYMYYAKA- | 169 |
| SEQ_ID_NO_530 | YHTRYRHMVY | VGSW-TCESL | RKGVFIAGAV | FVVFTMILNV | YFYMYYTKS- | 197 |
| SEQ_ID_NO_531 | YHTRYRHMVY | VGSW-TCESL | RKGVFIAGAV | FVVFTMILNV | YFYMYYTKS- | 169 |
| SEQ_ID_NO_510 | YHTKY--LS | SCTF-SCASL | RKGIFIAGAV | FIVATMVLNV | YYYMYFTKSV | 167 |
| SEQ_ID_NO_525 | YHTKY--LS | AQAF-SCESL | RKGIFIAGAV | FTVATMILNV | YYYFHFTKFV | 167 |
| SEQ_ID_NO_521 | YHTKYRGMIY | AHNF-SCEAL | RKGXFIAGAV | FVVATMILNV | YYYMYFTKAM | 170 |
| SEQ_ID_NO_513 | YHTKYRGMIY | AGNF-SCETL | RKGVFIAGAV | FVVATMILNV | YYYMYFAKAT | 170 |
| SEQ_ID_NO_517 | YHTKYRGMIY | AGNF-TCETL | RKGVFIAGAV | FVVATMILNV | YYYMYFSKAT | 146 |
| SEQ_ID_NO_511 | YHTKYRTFS | EQPP-SCETV | RKGVFGAGAA | FIFLNAIVNK | FYYICYSSA- | 185 |
| SEQ_ID_NO_523 | YHTRYRGLFN | GDPL-SCETL | RKGVFAAGAA | FTFFTALLSE | FYYISYSKS- | 185 |

| | | | | | |
|---|---|---|---|---|---|
| SEQ_ID_NO_527 | -DMGGWVKHQ | NEGGVGMAEF | GPEKRGLGNT | NG | 199 |
| SEQ_ID_NO_529 | TSQAAKKISK | TTPSVGMTGY | A--------- | -- | 190 |
| SEQ_ID_NO_530 | TSQAAKKINK | TTPNVGMTGY | A--------- | -- | 218 |
| SEQ_ID_NO_531 | TSQAAKKINK | TTPNVGMTGY | A--------- | -- | 190 |
| SEQ_ID_NO_510 | SSPPAHKANR | SSSNIGMAGY | A--------- | -- | 188 |
| SEQ_ID_NO_525 | FFPPTHKANR | SSSNIGMAGY | A--------- | -- | 188 |
| SEQ_ID_NO_521 | TXPVXHKANR | VSSTVGMAGY | A--------- | -- | 191 |
| SEQ_ID_NO_513 | TTMPAHKANR | TNSTVGMAGY | A--------- | -- | 191 |
| SEQ_ID_NO_517 | ASKAAHKTNR | TSS-VGMTGN | P--------- | -- | 166 |
| SEQ_ID_NO_511 | -RDKSFQAYG | GETGVGMGTY | K--------- | -- | 185 |
| SEQ_ID_NO_523 | -RDAAGGAPY | GGSSIGMGPY | T--------- | -- | 185 |

Figure 16

| | | | | | | | |
|---|---|---|---|---|---|---|---|
| SEQ_ID_NO_546 | ----MSSSLE | RKKGKTVI-- | ---------- | M LRSCSQCGSN | GHN------ | | 28 |
| SEQ_ID_NO_542 | ---------- | ---------- | ---------- | M GRKCSHCGNI | GHN------ | | 14 |
| SEQ_ID_NO_547 | ---------- | ---------- | ---------- | M TRRCSHCSTN | GHN------ | | 14 |
| SEQ_ID_NO_533 | ----MESVVA | T--------- | ---------- | W SREEEKAFEN | AI ALHCV-- | | 25 |
| SEQ_ID_NO_539 | ----MSSGGT | I--------- | ---------- | W SYDEEKAFEN | AI AMHM--- | | 25 |
| SEQ_ID_NO_535 | ----MAGSVS | ---------- | ---------- | W SREEEKAFEN | AI AMHM--- | | 24 |
| SEQ_ID_NO_538 | ----MASVGT | ---------- | ---------- | W TRDEEKTFEN | AI AMHM--- | | 24 |
| SEQ_ID_NO_553 | ----MTSQAA | TTTTTAAAAA | A-------- | W TREDDKAFEN | ALAACAAPPP | | 38 |
| SEQ_ID_NO_550 | ----MAAEEA | SSSGGGEEGS | GAGAGG---  | W TREQEKAFEN | ALATV----- | | 38 |
| SEQ_ID_NO_552 | ----MAVNEA | SSSGGGEEGC | GS-------  | W TREQEKAFEN | AVATMGG--- | | 36 |
| SEQ_ID_NO_536 | ----METLYP | SSHLSSSAWF | VLDNPS-TKW | TKEENKMFES | ALAI Y---- | | 40 |
| SEQ_ID_NO_543 | MDRGEILSP | ASYLQNSNWL | FPETRA-TKW | TPEENKQFEN | ALALY----- | | 44 |
| SEQ_ID_NO_548 | ----MEILAP | SSYFSSSSWF | LEESRSTTRW | TAAENKAFEN | ALAVF----- | | 41 |
| | | | | | | | |
| SEQ_ID_NO_546 | --SRTCGESS | SAAGNGADG | EFMLFGVRVK | VDPMRKSVSM | NDLSD-YELP | | 75 |
| SEQ_ID_NO_542 | ---------- | SR-TCNSLRG | SGGFVGVRLF | GYQLDLSSSC | VSMKKSFSMD | | 53 |
| SEQ_ID_NO_547 | --SRTCPNRG | VK-LFGVRLT | -DGL RKSAS | MGNLTHFASG | SGGGS-TPLN | | 59 |
| SEQ_ID_NO_533 | -EEEI TEDQW | NK-MSSMVPS | -KALEEVKKH | YQLLEDVKA | ENGQ-VPLP | | 71 |
| SEQ_ID_NO_539 | -EESSKEQW | EK-I ASAVPS | -KSMEEVKQH | YQVLVEDVSA | EAGH-I SFP | | 70 |
| SEQ_ID_NO_535 | -DKEECEEQW | EK-I ASTVPI | -KSLEELKLH | YELLVEDVTA | EAGH-VPLP | | 70 |
| SEQ_ID_NO_538 | --DEDSNEQW | EK-I ASMVPS | -KSLEELKLH | YKI LVEDVCA | EAGN-VPI P | | 69 |
| SEQ_ID_NO_553 | ADGGAPDDW | FAALAASVPG | ARSAEEVRRH | YEALVEDVAA | DAGR-VPLP | | 87 |
| SEQ_ID_NO_550 | -DEEEGEAMW | DK-I ADAVEG | -KTPEEVRRH | YELLVEDVDG | EAGR-VPLL | | 84 |
| SEQ_ID_NO_552 | --EEDGDARW | EK-LAEAVEG | -KTPEEVRRH | YELLVEDVDG | ESGR-VPLP | | 81 |
| SEQ_ID_NO_536 | --DKETPDRW | FK-VAALI PG | -KTVSDVI KQ | YKELEEDVCE | EAGR-FPVP | | 85 |
| SEQ_ID_NO_543 | --DKDEPDRW | DK-VAAVI PG | -KTVGDVI KQ | YRELEEDVSD | EAGL-I PI P | | 89 |
| SEQ_ID_NO_548 | --DENTPNRW | ER-VAERVPG | -KTVGDVMRQ | YKELEDDVSS | EAGF-VPVP | | 86 |

Figure 16 (continued)

| | | | | | | | |
|---|---|---|---|---|---|---|---|
| SEQ_ID_NO_546 | SNVN------ | QNGVDNSKNS | NDSDKVVADD | VVTAGAGYV- | ---------S | | 109 |
| SEQ_ID_NO_542 | SFPT------ | ---SSSSPTS | SFSSSRLTID | DRASIGYLSD | GL-------- | | 86 |
| SEQ_ID_NO_547 | GVVH------ | DSPGDTPDHP | A-VGGGSADG | YASEDFVAG- | ---------- | | 91 |
| SEQ_ID_NO_533 | RYHHRKGLIV | DEAAAAATSP | ANRDSHSSGS | SEKKPNPGTS | GIS------S | | 115 |
| SEQ_ID_NO_539 | NYAS------ | DETTSSNKD- | FHGSSKATSS | DKRSNCNYGS | GFSGLGLDST | | 113 |
| SEQ_ID_NO_535 | CYKG------ | EEPSSSAKDY | FHGPSMAPNS | DRRSNSGYGN | GFSGLTLDST | | 114 |
| SEQ_ID_NO_538 | NYEG------ | EEAASSTKD- | LHGLSGTMTT | VKKLNCGYGS | GFVGLGHESS | | 112 |
| SEQ_ID_NO_553 | RYAG------ | EESAAPPDGA | GAAAAGKDG | GHRRDERKGG | G--------G | | 123 |
| SEQ_ID_NO_550 | VYAG------ | DGDEGGSGGG | AGGSGGGGGG | GGKKSGGGG | ---------G | | 118 |
| SEQ_ID_NO_552 | AYAA------ | ---------- | -DGAAEEGGG | GGKKGSGGG | ---------G | | 104 |
| SEQ_ID_NO_536 | GYDL------ | ----ASSFSF | EFVDDRNFDV | YRRKSSVG-- | ---------- | | 113 |
| SEQ_ID_NO_543 | GYSS------ | ---SDAFTLE | WFNNNQGYDG | FRHYYTPGG | ---------- | | 119 |
| SEQ_ID_NO_548 | GYST------ | ----SSPFTL | EWGSGHGFDG | FKQSYGTGG | ---------- | | 115 |

| | | | | | | | |
|---|---|---|---|---|---|---|---|
| SEQ_ID_NO_546 | ADDAVQHQ-- | STGGRERKRG | IPWTEEEHKL | FLLGLQKVGK | GDWRGI | SRNF | 157 |
| SEQ_ID_NO_542 | ---------- | IVRTQERKKG | VPWTEEEHRK | FLVGLEKLGK | GDWRGI | SRNY | 126 |
| SEQ_ID_NO_547 | ---------- | SSSSRERKKG | VPWTEEEHRM | FLLGLQKLGK | GDWRGI | ARNY | 131 |
| SEQ_ID_NO_533 | SNGGRSGG-- | SRAEQERRKG | IPWTEEEHRL | FLLGLDKFGK | GDWRSI | SRNF | 163 |
| SEQ_ID_NO_539 | THSSGKGGLS | RSSEQERRKG | IPWTEEEHRL | FLLGLDKFGK | GDWRSI | SRNF | 163 |
| SEQ_ID_NO_535 | GHGCKQS--- | SRSDQERRKG | IPWTEEEHRL | FLLGLDKFGK | GDWRSI | SRNF | 161 |
| SEQ_ID_NO_538 | GHGGKGA--- | SRSEQERRKG | IPWTEEEHRL | FLLGLDKFGK | GDWRSI | SRNF | 159 |
| SEQ_ID_NO_553 | GYDGGKSC-- | SKAEQERRKG | IPWTEEEHRL | FLLGLDKFGK | GDWRSI | SRNF | 171 |
| SEQ_ID_NO_550 | GHGEKGSS-- | KSAEQERRKG | AWTEDEHRL | FLLGLEKYGK | GDWRSI | SRNF | 166 |
| SEQ_ID_NO_552 | THGDKRSA-- | KSAEQERRKG | AWTEDEHRL | FLLGLEKYGK | GDWRSI | SRNF | 152 |
| SEQ_ID_NO_536 | ---------- | RGSEHERKKG | VPWTEEEHKQ | FLRGLLKYGK | GDWRNI | SRNF | 153 |
| SEQ_ID_NO_543 | ----KRTTAA | RSSEQERRKG | VPWTEEEHRQ | FLMGLQKYGK | GDWRNI | SRNF | 165 |
| SEQ_ID_NO_548 | ----RKSSSG | RPSEQERRKG | VPWTEEEHKL | FLMGLKKYGK | GDWRNI | SRNF | 161 |

Figure 16 (continued)

| | | | | | | |
|---|---|---|---|---|---|---|
| SEQ_ID_NO_546 | VKTRTPTQVA | SHAQKYYLRK | NNLNRRRRRS | SLFDITTDSV | PGGLPMDDVK | 207 |
| SEQ_ID_NO_542 | MTTRTPTQVA | SHAQKYFIRL | ATLNKKKRRS | SLFDMVGSGK | TN-KTVD--- | 172 |
| SEQ_ID_NO_547 | VISRTPTQVA | SHAQKYFIRQ | SNMSRRKRRS | SLFDIVADES | GDTPMVSR-- | 179 |
| SEQ_ID_NO_533 | VISRTPTQVA | SHAQKYFIRL | NSMNRDRRRS | SIHDITTVNN | QA-------- | 205 |
| SEQ_ID_NO_539 | VISRTPTQVA | SHAQKYFIRL | NSMNRDRRRS | SIHDITSVNN | GD-------- | 205 |
| SEQ_ID_NO_535 | VISRTPTQVA | SHAQKYFIRL | NSMNRDRRRS | SIHDITSVNN | GD-------- | 203 |
| SEQ_ID_NO_538 | VISRTPTQVA | SHAQKYFIRL | NSMNRDRRRS | SIHDITSLNN | GD-------- | 201 |
| SEQ_ID_NO_553 | VISRTPTQVA | SHAQKYFIRL | NSMNRDRRRS | SIHDITSVTA | GDQV------ | 215 |
| SEQ_ID_NO_550 | VISRTPTQVA | SHAQKYFIRL | NSMNRERRRS | SIHDITSVNL | GE-------- | 207 |
| SEQ_ID_NO_552 | VISRTPTQVA | SHAQKYFIRL | NSMNRERRRS | SIHDITSVNN | GD-------- | 194 |
| SEQ_ID_NO_536 | VNSKTPTQVA | SHAQKYFMRQ | LSGGKDKRRP | SIHDITTVNL | TE-------- | 195 |
| SEQ_ID_NO_543 | MTTRTPTQVA | SHAQKYFIRQ | STGGKDERRS | SIHDITTVNL | PDTKS----- | 210 |
| SEQ_ID_NO_548 | VITRTPTQVA | SHAQKYFIRQ | LSGGKDKRRA | SIHDITTVNL | SDNQTPS--- | 208 |

| | | | | | | |
|---|---|---|---|---|---|---|
| SEQ_ID_NO_546 | NHQDKSVPKV | LQHSQVPHAE | KPNMNGYTIA | PFPLAVGPIL | LPVQVHNPME | 257 |
| SEQ_ID_NO_542 | ---------- | ------PNNS | SKSKSGDSVC | RHDHEVEKDA | TLSL---LIN | 203 |
| SEQ_ID_NO_547 | ---------- | ------DFLA | DDPAQAEMQS | ----NNLLPP | TPAVDEECES | 209 |
| SEQ_ID_NO_533 | ---------- | ------PANT | GGGQQPQVVK | ----HRPAQP | QPQP---Q-- | 230 |
| SEQ_ID_NO_539 | ---------- | ------VASS | QAPITGLHSS | -----TISSN | TMGV------ | 228 |
| SEQ_ID_NO_535 | ---------- | ------TSH | QAPITGQQAN | --------TN | SPGA---AVM | 225 |
| SEQ_ID_NO_538 | ---------- | ------VSSH | QAPITGQQAN | ----TSPAGP | APAM------ | 225 |
| SEQ_ID_NO_553 | ---------- | ------AAQQ | GAPITGHQAT | ----GNPAAA | ALGP---PGM | 242 |
| SEQ_ID_NO_550 | ---------- | ------ASAA | QGPITG---- | ----TNGQAA | VPGK---S-- | 228 |
| SEQ_ID_NO_552 | ---------- | ------PSTA | QGPITGQ--- | ----TNGQAA | NPGK---P-- | 216 |
| SEQ_ID_NO_536 | ---------- | ------PTAS | ENEKLSSMDQ | ---FSKLPSL | QKSP---CYQ | 223 |
| SEQ_ID_NO_543 | ---------- | ------PSPD | EKKSSPDHST | TSLQSQPQQK | MVGM---A-- | 239 |
| SEQ_ID_NO_548 | ---------- | ------PDNK | KPSSPDHSM | ----AQQQTS | STSI---H-- | 233 |

Figure 16 (continued)

| | | | | | | | |
|---|---|---|---|---|---|---|---|
| SEQ_ID_NO_546 | NKAFHWGDHQ | L-QNGPGMLL | RTVPFIPVAN | S- | | SSAR | 292 |
| SEQ_ID_NO_542 | SLQQQTKSDD | Y-DMQKIEDD | SEEAEHKDVP | D- | | WLHPL | 238 |
| SEQ_ID_NO_547 | MGSAASANSI | DGEHAPIPE | SSQYQHPLVY | PAYVAPFYPM | PYPCWPGYTA | | 259 |
| SEQ_ID_NO_533 | PQPQQHHPPT | --MAGLGMYG | GAPVGQPIIA | PI- | | PDHMG | 264 |
| SEQ_ID_NO_539 | GQSLKHRVQG | HIPPGLGMYG | TPVGHPVAA | PI- | | PGHMA | 263 |
| SEQ_ID_NO_535 | GQSVKHRAQP | H-LPGLGMYG | APVGRPIAA | A- | | PGHIG | 259 |
| SEQ_ID_NO_538 | GPPVKHRTQA | H-MPGLAMYG | P-PLGHPVAP | PI- | | PGHMA | 259 |
| SEQ_ID_NO_553 | KHHHHHHPGG | A-PPPMPMYS | AAPMGHPVA- | | | GHMV | 274 |
| SEQ_ID_NO_550 | PKQSPHQPGN | L-PPGVDAFG | T-TIGQPVGG | PI- | | LV- | 259 |
| SEQ_ID_NO_552 | SKQSP-QPAN | T-PPGVDAYG | T-TIGQPVGG | PI- | | LV- | 246 |
| SEQ_ID_NO_536 | KLLFDWNRSS | --NGGLLGLG | S-NYGDRLMS | F- | | PSGA | 256 |
| SEQ_ID_NO_543 | KGLIDWKPQN | EGGGAAGVFS | Q-ANGNLLMA | PI- | | LCGI | 273 |
| SEQ_ID_NO_548 | KLPFQWDQTS | N-ETIMGFAS | SGHHGNMFQS | N- | | PFGM | 267 |

| | | | | | | | |
|---|---|---|---|---|---|---|---|
| SEQ_ID_NO_546 | DLNLN-QRVL | ----EGEPSS | P- | | LS | LKLSLSSSDN | 319 |
| SEQ_ID_NO_542 | TKSLN-MTLV | LPNSSNVAP | P- | | DL | ELTLAGSKSN | 269 |
| SEQ_ID_NO_547 | EPAIAETHEV | LKPIAVHSKS | PINVDELVGM | SKLSLGESIG | DAAKPPSLSL | | 309 |
| SEQ_ID_NO_533 | -SAVGITPVM | LPPPMGTHHH | H- | | HH | HHLGVAPYAV | 295 |
| SEQ_ID_NO_539 | -SAVGITPVM | LPPGPHPHPH | P- | | HH | HAHPHPPYVL | 294 |
| SEQ_ID_NO_535 | -SAVGITPVM | L-PPAHHPHS | P- | | | PPYIV | 282 |
| SEQ_ID_NO_538 | -SAVGITPVM | LPPPGHHPH | | | | PPYVV | 281 |
| SEQ_ID_NO_553 | PAAVGITPVV | F-PPGH- | | | | APYVV | 293 |
| SEQ_ID_NO_550 | -SAVGITPVT | LPVAAPPHM | G- | | YA | MHAPVPGTVV | 289 |
| SEQ_ID_NO_552 | -SAVGITPVT | LPVSAPPHL | A- | | YG | MRAPVPGAVV | 276 |
| SEQ_ID_NO_536 | ANGK-N- | --EQDQELNS | A- | | YY | GTYSKPHKSI | 283 |
| SEQ_ID_NO_543 | -SSYGQRL | --QEQNLLRG | T- | | LP | GYQFAPYNLI | 301 |
| SEQ_ID_NO_548 | -NSYGFKM | --QGQQMQRG | G- | | FC | DTYLGSQNMA | 295 |

Figure 16 (continued)

| | | | | |
|---|---|---|---|---|
| SEQ_ID_NO_546 | SQSSSTRHST | GFQAMAATSF | SKGGDSIISV A-- | 350 |
| SEQ_ID_NO_542 | NMEQDKTSSS | SFLIGPISVT | ---------- --- | 289 |
| SEQ_ID_NO_547 | KLVEGSSRQS | AFHANPSSGS | SGMNSSHNPI HAV | 342 |
| SEQ_ID_NO_533 | PA-------- | -YPVPPLPQQ | HPAPSTMH-- --- | 314 |
| SEQ_ID_NO_539 | PLA------- | -YPMAPPTMH | Q--------- --- | 307 |
| SEQ_ID_NO_535 | PVA------- | -YPMAPPPMH | Q--------- --- | 295 |
| SEQ_ID_NO_538 | PVA------- | -YPTAPPKTA | ---------- --- | 293 |
| SEQ_ID_NO_553 | PVG------- | -YPAPPAKMH | Q--------- --- | 306 |
| SEQ_ID_NO_550 | PRAPM----- | -YPMPPPPSR | ---------- --- | 303 |
| SEQ_ID_NO_552 | PGAPVNIAPM | PYPMPPPPSH | G--------- --- | 297 |
| SEQ_ID_NO_536 | ---------- | -FQFEPSRYQ | IYG------- --- | 295 |
| SEQ_ID_NO_543 | ---------- | -FQMQPMQRQ | ---------- --- | 310 |
| SEQ_ID_NO_548 | ---------- | -FQMQSGLHF | PNA------- --- | 307 |

Figure 17

| | | | | | | | |
|---|---|---|---|---|---|---|---|
| SEQ_ID_NO_559 | -----MENK | -------TP | FFSLS FLS | LNCA GG--- | -------ND | 27 |
| SEQ_ID_NO_586 | -----MQTA | ---------- | -LFF LVT CT | ITCTLGD--- | -------VNL | 23 |
| SEQ_ID_NO_591 | ---------- | ------MLG | ICIL VFLNN | FTCA ID--- | -------DDL | 23 |
| SEQ_ID_NO_581 | -----MART | PRTTILHLV | TLCC LWQN | TPSLAST--- | ---ASAIDEF | 38 |
| SEQ_ID_NO_588 | -----MARA | PR--ILHLL | ALCSLSSSV | AVAVASA--- | ---SGAADAF | 36 |
| SEQ_ID_NO_589 | -----MTTT | SR-ALALVL | SSCCLLVAVD | AAYAKKP--- | ---NLSKNDF | 37 |
| SEQ_ID_NO_590 | MARTSMTTTS | RA--LALVL | SSCCLLVAVD | AAYAKKP--- | ---NLSKNDF | 42 |
| SEQ_ID_NO_584 | -----MANS | RA---FALV | LFCALSSCQ | VAFSYFP--- | ---PPAAKEDF | 36 |
| SEQ_ID_NO_583 | -----MATS | RP--LALAL | LLCALSACSH | AAISYPPSAM | STAAPANNGF | 41 |
| SEQ_ID_NO_585 | -----MARS | RA---FAFAL | LICAVAASCH | VALSAPP--- | PYAKQVERDF | 38 |
| SEQ_ID_NO_560 | -----MNCS | A----FSFWF | VCKI FFLS | FN QISI--- | ---ANPQENF | 34 |
| SEQ_ID_NO_577 | -----MKTL | -----SCYYT | FATV ALLFS | FTPSSAD--- | ------THENF | 31 |
| SEQ_ID_NO_569 | -----MPNP | -----MRPYL | ILSV FFFNL | YHSMAVP--- | ---DPTHQAL | 33 |
| SEQ_ID_NO_575 | -----MEKS | -----NSLPF | LSVI VLLHV | SNSLTTP--- | -TRESIHDTF | 35 |
| SEQ_ID_NO_576 | -----MDTM | GK---LFFLT | ATLT VLFNS | TTAATSP--- | -------IQHF | 32 |
| SEQ_ID_NO_578 | -----MAN | TSSFNMQTS | LTLLLLLST | QSSATSR--- | ----SITDRF | 37 |
| SEQ_ID_NO_579 | -----MAIT | YS-FNFKSY | FPLL VLLST | HSSATST--- | ----SIIDRF | 36 |
| SEQ_ID_NO_558 | -----MTS | -----LTTQT | LIIT FLLT | PTSFASP--- | ---PSLEDVF | 32 |
| SEQ_ID_NO_571 | -----MKSP | -------FVF | FSVLLISVSL | PNSIALP--- | -------DNF | 27 |

| | | | | | | | |
|---|---|---|---|---|---|---|---|
| SEQ_ID_NO_559 | LSCLTFNGVR | N------HT | VFSADSDSDF | NRFLHLSIQN | PLFQNSLISK | 70 |
| SEQ_ID_NO_586 | SSCLTSNGVS | N------FTA | LSTSSDS-DY | HRLLYVSMON | QIFTRPKYPR | 66 |
| SEQ_ID_NO_591 | PSCLT HGVH | N------YTT | HQGTSNSDAY | HRLLYVSMON | QIFTRSIFPD | 67 |
| SEQ_ID_NO_581 | LGCLSAD-IP | G------GL | QTPATPSSY | SALLLSTRN | LRYVLPDTSK | 80 |
| SEQ_ID_NO_588 | VGCLTAAGVP | P------GL | QTPASP-SY | DALLRSSVRN | LRYVAPGTPW | 78 |
| SEQ_ID_NO_589 | LSCLAAG-IP | A------RQ | LYAKGSP-SY | GSVLTSTIRN | LRYLSSKTCN | 78 |
| SEQ_ID_NO_590 | LSCLAAG-IP | A------RQ | LYAKGSP-SY | GSVLTSTIRN | LRYLSSKTCN | 83 |
| SEQ_ID_NO_584 | LGCLVKE-IP | P------RL | LYAKSSP-AY | PSVLGQTIRN | SRWSSPDNVK | 77 |
| SEQ_ID_NO_583 | LSCLIKS-VP | P------RL | LHGKSSR-AY | GSIMESTVRN | VKFVSDKTVK | 82 |
| SEQ_ID_NO_585 | LTCLTKD-IP | P------RQ | LYAKSSP-AY | ASVWSSTVRN | IKFLSDKTVK | 79 |
| SEQ_ID_NO_560 | LKCFSEY-IP | NNPANP--KF | YTQHDQ-LY | MSVLNSTIQN | LRFTSDTTPK | 60 |
| SEQ_ID_NO_577 | LQCLYSYPHN | T---NSISSV | LYTQTNS-SY | FSVLDATMON | LRF-SDSRK | 75 |
| SEQ_ID_NO_569 | LQCLTDS-IP | T---DTASSI | VSKSNP-SY | TSVLRAYLRN | ARFNTSBTPK | 78 |
| SEQ_ID_NO_575 | LHCLQSH-TT | NQPDH-VSNI | VYADTNT-SY | TSVLRAFARN | ARFSAPSTCK | 82 |
| SEQ_ID_NO_576 | LNCLPHSLVS | E-------V | TYTPNNA-SF | STILNMKIQN | KRFKTATTPK | 73 |
| SEQ_ID_NO_578 | LQCLHDRADP | G---FPITGE | VYTPGNS-SF | PTVLQNYIRN | LRFNETTTPK | 83 |
| SEQ_ID_NO_579 | TQCLNNRADP | G---FPLSGQ | LYTPDNS-SF | PSVLQAYIRN | LRFNESTTPK | 82 |
| SEQ_ID_NO_558 | AQCVTDF-KP | GNPKSPIQNY | YTQRSP-NF | LTILNNYVRN | LRYFNNMTRK | 80 |
| SEQ_ID_NO_571 | LQCLTENSQP | T---NPISDA | IHTPDNP-SF | TTVLQSYARN | LRFLTLSTPK | 73 |

Figure 17 (continued)

| SEQ_ID | Sequence 1 | Pos |
|---|---|---|
| SEQ_ID_NO_559 | PSA I LPGSK EELSNTI RC RKGSWT RLR SGGHSYEGLS YTS - - - DTP | 116 |
| SEQ_ID_NO_586 | PSM I LPQSK EELAASVVCS NRGLWT RLR SGGHSYEGLS YVA - - - DTP | 112 |
| SEQ_ID_NO_591 | PRV I LPESM DQLANVI SCC TRGSWT RLR SGGHSYEGLS HI A - - - DNP | 113 |
| SEQ_ID_NO_581 | PLG I AATEH AHAQT TVRCG RRHGVRVRVR SGGHDYEGLS YASVHLHNRN | 130 |
| SEQ_ID_NO_588 | PLA VAATEP AHAQAAVRCG RRHGVRVRTR SGGHDYEGLS YASL - - - DPR | 125 |
| SEQ_ID_NO_589 | PLY VTPTDV KHI QVAVSCG RRHNVRI RVR SGGHDYEGLS YRS - - - EI P | 124 |
| SEQ_ID_NO_590 | PLY VTPTDV KHI QVAVSCG RRHNVRI RVR SGGHDYEGLS YRS - - - EI P | 129 |
| SEQ_ID_NO_584 | PLY I TPTNV SHI QSAVVCG RRHSVRI RVR SGGHDYEGLS YRS - - - LQP | 123 |
| SEQ_ID_NO_583 | PVY I TPTEA AHI QATVACG RXHGL RVRVR SGGHDYEGLS YRS - - - AKP | 128 |
| SEQ_ID_NO_585 | PLY I TPTNA SHI QAAVVCG RRHGMRI RVR SGGHDYEGLS YRS - - - EKP | 125 |
| SEQ_ID_NO_560 | PLV VTPSNV SHI QASI LCS KKVGLQI RTR SGGHDAEGLS YI S - - - QVP | 126 |
| SEQ_ID_NO_577 | PLV VTPQVV SHI QATI KCS QRHGLQI RTR SGGHDYEGLS YVA - - - RVP | 121 |
| SEQ_ID_NO_569 | PLI I TPLDE SHVSAAVI CS QKLGFDLKI R SGGHDYEGLS YVF - - - DNP | 124 |
| SEQ_ID_NO_575 | PLL VTPLSE NQVQATVVCA KSI GLQLKI R SGGHDFEGVS YI S - - - QVP | 128 |
| SEQ_ID_NO_576 | PLA I TAKDD SHI QETI KCA KSMN QI RLR SGGHDYEGFS YVS - - - DVP | 119 |
| SEQ_ID_NO_578 | PEL I TAEHV SHI QAAVVCG KQNRL LKTR SGGHDYEGLS YLT - - - NTN | 129 |
| SEQ_ID_NO_579 | PI L I TAL HP SHI QAAVVCA KTHRL LMKTR SGGHDYEGLS YVT - - - NSN | 128 |
| SEQ_ID_NO_558 | PVA VAAADV THI QATI TCA KKLGLQLRI R SGGHDYDGMS YLS - - - TI D | 126 |
| SEQ_ID_NO_571 | PLA I AAKHE SHVQATI I CS KKLGLQI RI R SGGHDYDGLS YVS - - - DVA | 119 |

| SEQ_ID | Sequence 2 | Pos |
|---|---|---|
| SEQ_ID_NO_559 | - - FI LI DLMN LNRVSI DLES ETAWESGST LGELYYA TE SSSKL GFTA | 163 |
| SEQ_ID_NO_586 | - - FVVI DLMN LNRI SI DLES KTAWESGAT LGEI YCA SE ASDTL GFSG | 159 |
| SEQ_ID_NO_591 | - - FVI I DLMN LNG SI DLDT QTAWESGAT LGEI YHA GK SSGTM AFSR | 160 |
| SEQ_ID_NO_581 | EPFAVLDLAA LRAI HVDAAR AEAWWESGAT VGELYYANGA ASRSL GFPA | 179 |
| SEQ_ID_NO_588 | ESFAVLDLAA FREVRVDAAR AEAWAGSGAT LGEVYYANGA ASRAL AFPA | 174 |
| SEQ_ID_NO_589 | EPFAI VDLVN MRNVTVDGKA RTAWWESGAQ GELYYG SK ASPTL AFPA | 173 |
| SEQ_ID_NO_590 | EPFAI VDLVN MRNVTVDGKA RTAWWESGAQ GELYYG SK ASPTL AFPA | 178 |
| SEQ_ID_NO_584 | ETFAVVDLNK MRAVMDGKA RTAWWDSGAQ LGELYYA YK ASPTL AFPA | 172 |
| SEQ_ID_NO_583 | ETFAVVDLSM MRQVRI DGKA ATAWWDSGAQ LGELYYAVAK MTPSL GFPA | 177 |
| SEQ_ID_NO_585 | EPFAVVDMNK MRAVSI DSKA ATAWWDSGAQ LGDLYYG AK ASPKL GFPA | 174 |
| SEQ_ID_NO_560 | - - FAI VDLRN MHTVKVDI HS QTAWWEAGAT LGEVYYM NE MNENF - SFPG | 173 |
| SEQ_ID_NO_577 | - - FVI LDLLN FREI KVDVEN RTAWQVGAT LGELYYT SQ ASKTL GFPA | 168 |
| SEQ_ID_NO_569 | - - FFVLDMFN LRSI TVNMAD ETAWGAGAT LGELYYN MK NSKVH- GFPA | 171 |
| SEQ_ID_NO_575 | - - FI LDMFN FQDVTVDVQN EI AVI QAGAS LGQVYYR NE KSKVH- GFPA | 175 |
| SEQ_ID_NO_576 | - - FI LDMFH LNSVDI NLQE STAWESGAT LGKI YYN AN KSNKL AFPS | 166 |
| SEQ_ID_NO_578 | QPFFI VDMFN LRSI NVDI EQ ETAWQAGAT LGEVYYR AE KSNKH- GFPA | 178 |
| SEQ_ID_NO_579 | QPFFVVDMFN LRSI NVSL ED ETAWQAGAT LGEVYYR AE KSNSH- AFPA | 177 |
| SEQ_ID_NO_558 | - - FVVLDMFN LRSI NI DPKL DTAWQSGAT LGEI YYGVAN KSNDLRGFPA | 174 |
| SEQ_ID_NO_571 | - - FI LDMFN LRSI NI DI ED ESAWQAGAT LGEVYYR AE KSNVH- GFPA | 166 |

Figure 17 (continued)

| | | | | | | | |
|---|---|---|---|---|---|---|---|
| SEQ_ID_NO_559 | GWCPTVGTGG | HISGGGFGMM | SRKYGLAADN | VVDALLIDAN | GALLDRQAMG | 213 |
| SEQ_ID_NO_586 | GYCPTVGSGG | HISGGGFGMM | SRKYGLAADN | VIDALLVDAN | GAVLDRSSMG | 209 |
| SEQ_ID_NO_591 | GYCPTGSSGG | HIAPGGFGMM | SRKYGLAADN | VVDALLVDAN | GNVLDRESMG | 210 |
| SEQ_ID_NO_581 | GSCPTMGVGG | HLSGGGFGSL | ARKYGLSADN | VLDAVVVDAD | GRLVNRSTMG | 229 |
| SEQ_ID_NO_588 | GVCPTVGVGG | HLGGGGFGTL | MRRYGLAADN | VLDAVLVDAD | GRLLNRTTMG | 224 |
| SEQ_ID_NO_589 | GVCPTIGVGG | HFSGGGFGML | LRKFGLASDN | VLDVKVVDAN | GKVQDRKSMG | 223 |
| SEQ_ID_NO_590 | GVCPTIGVGG | HFSGGGFGML | LRKFGLASDN | VLDVKVVDAN | GKVQDRKSMG | 228 |
| SEQ_ID_NO_584 | GVCPTIGVGG | NFAGGGFGML | LRKYGIAAEN | VIDVKLVDAN | GKLHDKKSMG | 222 |
| SEQ_ID_NO_583 | GVCATIGVGG | HFSGGGFGML | LRKYGTAGDN | VIDAKVVDAN | GTLLDRKSMG | 227 |
| SEQ_ID_NO_585 | GVCITIGVGG | HFSGGGFGML | LRKYGTAADN | VIDAKVVDAQ | GRLLDRKAMG | 224 |
| SEQ_ID_NO_560 | GYCPTVGVGG | HFSGGGYGAL | MRNYGLAADN | IDAHLVNVD | GKVLDRKSMG | 223 |
| SEQ_ID_NO_577 | GVCYSVGAGG | HISGGGYGFL | MRKYGLAADN | VIDAHIDVN | GNLLDRKAMG | 218 |
| SEQ_ID_NO_569 | GVCPTVGVGG | HLSGAGYGTL | IRKYGLSVDH | VVDAKLVDVN | GKILDRKTMG | 221 |
| SEQ_ID_NO_575 | GACPTVGVGG | HLSGGGYGNM | IRKYGLSVDH | VVDAKIVDVK | GRILDKESMG | 225 |
| SEQ_ID_NO_576 | GVCFTLGAGG | HFSGGGYGNL | MRKFGLSVDN | IDAKMVDVK | GNLLDRKSMG | 216 |
| SEQ_ID_NO_578 | GVCPTVGVGG | HFSGGGYGNL | MRKYGLSVDN | VDAQIIDVN | GKLLDRKSMG | 228 |
| SEQ_ID_NO_579 | GVCPTVGVGG | HFSGGGYGNL | MGKYGLSVDN | VDAQLIDVN | GKLLNRKSMG | 227 |
| SEQ_ID_NO_558 | GICPGLGAGG | HFSGGGYGNM | MRKYGLSIDN | IDAKIVDAK | GKVLDRSSMG | 224 |
| SEQ_ID_NO_571 | GVCPTLGVGG | HFSGGGYGNM | MRKYGLSVDN | VDAQIIDVR | GRILDRKSMG | 216 |

| | | | | | | | |
|---|---|---|---|---|---|---|---|
| SEQ_ID_NO_559 | EDVFWAIRGG | GGGVMGAIYA | WKIKLLPVPE | KVTVFRVTKN | VAIDE--ATS | 261 |
| SEQ_ID_NO_586 | EDVFWAIRGG | GGGVMGAIYA | WKLQLLPVPK | QVTVFKLVKN | FDNIE-EASK | 258 |
| SEQ_ID_NO_591 | EDVFWAIRGG | GGGVMGAVYA | WKLQLVPVPK | NVTIFRLVKH | SEVED--ASK | 258 |
| SEQ_ID_NO_581 | EDHFWALCGG | GGESFGVVLS | AKVRLVPVPE | TVTVFSIVRS | RSDS---AVE | 276 |
| SEQ_ID_NO_588 | EDLFWAIRGG | GGESFGVVLS | AKLRLVPVPE | TVTVFTVRRS | RNQS---ASE | 271 |
| SEQ_ID_NO_589 | EDYLWAVRGG | GGSSFGIVVS | AKLRLLPVPA | TVTVLQMPKM | VNEG---AVD | 270 |
| SEQ_ID_NO_590 | EDYLWAVRGG | GGSSFGIVVS | AKLRLLPVPA | TVTVLQMPKM | VNEG---AVD | 275 |
| SEQ_ID_NO_584 | DDHFWAVRGG | GGESFGIVVA | WQVKLLPVPP | TVTIFKISKT | VSEG---AVD | 269 |
| SEQ_ID_NO_583 | EDYFWAIRGG | GGESFGIMVS | WQVQLVPVPP | KVTVFQIHRG | VKDG---AID | 274 |
| SEQ_ID_NO_585 | EDHFWAIRGG | GGESFGIVAS | WQVKLLPVPP | KVTVFQVHKG | IKES---AID | 271 |
| SEQ_ID_NO_560 | EDLFWAIRGG | GGENFGIIAA | AKIKLVVNPS | KAIIFSVKKN | MELHG--LVK | 271 |
| SEQ_ID_NO_577 | EDLFWAIRGG | GGASFGIVVS | AKIKLVPVPS | TVTVFNVERI | LEEN---ATE | 265 |
| SEQ_ID_NO_569 | EDLFWAIRGG | GAASFGVVLS | YKIKLVPVPE | TVTVFRIERL | LTEN---ATD | 268 |
| SEQ_ID_NO_575 | EDLFWAIRGG | GGASFGVILS | YITKLVPVPE | NVTVFQIDKT | LEEN---ATD | 272 |
| SEQ_ID_NO_576 | EDLFWAIRGG | GGASFGVILS | AKLQLVPVTP | QVIVFDVKRN | VSEG---ATD | 263 |
| SEQ_ID_NO_578 | EDLFWAITGG | GGVSFGVVLA | YKIKLVRVPE | VVTVFTIERR | EEQN---LST | 275 |
| SEQ_ID_NO_579 | EDLFWAITGG | GGVSFGVVVA | YKIKLVRVPT | TVTVFNVQRT | SEQN---LST | 274 |
| SEQ_ID_NO_558 | EDLFWALRGG | GAASFCVVLA | AKIKLVPVPA | KVTVFNIETF | GNTGSVNTTE | 274 |
| SEQ_ID_NO_571 | EDLFWAIRGG | GAASFGVILS | AKIKLVPVPE | IVTVFSVDRT | LEEG---VSD | 263 |

Figure 17 (continued)

| SEQ_ID_NO_559 | LLHKWQFV-A | EELEEDFTLG | VLGGADEK-- | -------QVW | LTMLGFHFGL | 301 |
| SEQ_ID_NO_586 | MLHKWQVV-A | PALEDDFTLS | VLAGADTN-- | -------G W | FSFLGLYLGP | 298 |
| SEQ_ID_NO_591 | LLHKWQLV-A | PKLEDDFSLA | VLAGTNKDS- | -------SIW | LTFLGLYLGP | 299 |
| SEQ_ID_NO_581 | LITKWQEM-A | PASPQELYLR | VLVL------ | -------NQQ | ANFQALFLGR | 312 |
| SEQ_ID_NO_588 | LITKWQEI-A | PALPRDLLR | VVQ------ | -------GRH | AQFEALFLGR | 307 |
| SEQ_ID_NO_589 | LLTKWQSL-A | PTFPEDLMR | VMAQ------ | -------AQK | ANFEGLYLGT | 306 |
| SEQ_ID_NO_590 | LLTKWQSL-A | PTFPEDLMR | VMAQ------ | -------AQK | ANFEGLYLGT | 311 |
| SEQ_ID_NO_584 | INKWQVV-A | PQLPADLMR | IAQ------ | -------GPK | ATFEAMYLGT | 305 |
| SEQ_ID_NO_583 | LINKWQQV-A | PSLPDDLMR | MAM------ | -------EQD | AMFEALYLGT | 310 |
| SEQ_ID_NO_585 | LVTKWQTV-A | PALPDDLMR | MAM------ | -------GQG | AMFEALYLGT | 307 |
| SEQ_ID_NO_560 | LENKWQN-A | YKYDKDLMLT | THFRTRNITD | NHGKNKTTVH | GYFSSIFLGG | 320 |
| SEQ_ID_NO_577 | IEKWQLV-A | NKLDERFLR | NDLARANSS- | QHGKL--ALQ | ANFVAMFQGG | 311 |
| SEQ_ID_NO_569 | TFKWQT-A | PTTDENLFMR | MLQPVTRN- | --KKK--TAR | ISVIALYLGD | 312 |
| SEQ_ID_NO_575 | LVWQWQKV-A | PHTDDRLYLR | LVLQPVSSNF | VKGKK--TIR | ASVEALFLGE | 319 |
| SEQ_ID_NO_576 | VYKWQL-A | PKLHKDLFIR | AQPNVVQIG- | QEGKK--VVQ | ISFIGQFLGK | 309 |
| SEQ_ID_NO_578 | AERWQV-A | DKLDRDLFLR | MTFSVINDT- | NGG-K--TVR | AFPTLYLGN | 320 |
| SEQ_ID_NO_579 | AHRWI QV-A | DKLDNDLFLR | MTFNVINNT- | NGE-K--TIR | GLFPTLYLGN | 319 |
| SEQ_ID_NO_558 | LVAKWQE-A | DKIDNDLFI R | LTLGSSNK-- | -------TVK | ASFMGMYLGN | 314 |
| SEQ_ID_NO_571 | LAWKWQQ AA | DKLDNDLFI R | LMLQPVNGT- | QEGKK--TIQ | ASFVAMFLGR | 310 |

| SEQ_ID_NO_559 | KTYAKSTFDL | LFPELGLVEE | DYLEMSWGES | FAYLAGLE-- | -----TVSQL | 344 |
| SEQ_ID_NO_586 | KELAISSVDQ | NFPELNLVME | DCKEMSWVES | FAHLAGLN-- | -----SVEEM | 341 |
| SEQ_ID_NO_591 | KELASSSMHK | KFPELNLLLE | DCMEMSWVEA | TAELAGLK-- | -----SVSEL | 342 |
| SEQ_ID_NO_581 | CGGLHRLMQD | RFPELGMTEQ | DCEEVSWVQS | TAFFGFSTTS | V----PPEQL | 358 |
| SEQ_ID_NO_588 | CSRVLEHMRA | HFPELGVARA | DCEEISWIQS | TVYFAFYSSS | K----PPELL | 353 |
| SEQ_ID_NO_589 | CDALLPLVTS | RFPELGVNRS | HCNEMSWVQS | IAFIHLGKNA | T----VKDI | 351 |
| SEQ_ID_NO_590 | CDALLPLVTS | RFPELGVNRS | HCNEMSWVQS | IAFIHLGKNA | T----VKDI | 356 |
| SEQ_ID_NO_584 | CKTLTPLMSG | KFPELGMNPD | HCNEMSWIQS | IPFVHLGHRD | A----LEDDL | 351 |
| SEQ_ID_NO_583 | CKDLLPLMAS | RFPELGVKQE | DCNEMPWI QS | VAFIPMGKSA | T----VMDL | 355 |
| SEQ_ID_NO_585 | CKDLVLLNTA | RFPELGMNAT | HCKEMTWI ES | VPYLPMGPKG | T----VRDL | 352 |
| SEQ_ID_NO_560 | VDSLVDLMNK | SFPELGIKKT | DCKELSWI DT | TIFYSGVVNY | NTANFKKEL | 370 |
| SEQ_ID_NO_577 | VEELIPLMQK | NFPELGLKRK | DCTETSWI GS | AVFTNGALIG | SSGHEAPEVL | 361 |
| SEQ_ID_NO_569 | SDSLVSLLQK | DFPELSI GKS | NCNETTWI DS | VLWWANFNLG | T----PPTAL | 358 |
| SEQ_ID_NO_575 | ADELVKLLGQ | EFPLI GLKKE | LCHEMRWI DS | VVWWANYNDG | S----SVNAL | 365 |
| SEQ_ID_NO_576 | IERLLTLMNK | EFPELGLNKS | DCFSMPWI NS | TLFWYGEPIG | T----PLEVL | 355 |
| SEQ_ID_NO_578 | SRNLVTLLNK | DFPELGLQES | DCTEMSWVES | VLYYTGFPSG | T----PTTAL | 366 |
| SEQ_ID_NO_579 | STALVALLNK | DFPELGVEI S | DCIEMSWI ES | VLFYTNFPIG | T----PTTAL | 365 |
| SEQ_ID_NO_558 | SSNLLEIMNA | KFPELGLI KR | ECIEMKWI ES | VLFWLGIPPG | TA---PTTSM | 361 |
| SEQ_ID_NO_571 | AERLLSVMNE | SFPELGLQAK | DCAEMRWI ES | VLSAVGMPKG | T----PLEVL | 356 |

Figure 17 (continued)

| | | | | | | | |
|---|---|---|---|---|---|---|---|
| SEQ_ID_NO_559 | NNRFLKFDER | AFKTKVDLTK | EPLPSKAFYG | LL-ERLSK- | EPNGFIALNG | 391 |
| SEQ_ID_NO_586 | NNRFLKYDDR | AFKTKVDFVK | EPIPLEGIKS | AL-TMLTK- | ELRGFMAFNG | 388 |
| SEQ_ID_NO_591 | KDRFLRYDDR | AFKTKVDFPK | EAPLEGIQG | AL-EILKK- | EQRGFMVMNG | 389 |
| SEQ_ID_NO_581 | LNR-SSNPSY | YLKAKSDHVQ | EPIPRDVMES | LWTTWLEK- | PEAALLMLDP | 405 |
| SEQ_ID_NO_588 | LDR-IGETGR | YVKAKSDYVQ | EPIPRHAMES | TM-SWLEK- | PEAGLLILDP | 399 |
| SEQ_ID_NO_589 | LNR-TSSIRA | FGKYKSDYVT | DPLSKATMDT | YKDWFSK- | PGSGIMIMDP | 398 |
| SEQ_ID_NO_590 | LNR-TSSIRA | FGKYKSDYVT | DPLSKATMDT | YKDWFSK- | PGSGIMIMDP | 403 |
| SEQ_ID_NO_584 | LNR-NNSFKP | FAEYKSDYVY | DPFPKTVMEQ | LNTWLVK- | PGAGIMIFDP | 398 |
| SEQ_ID_NO_583 | LNR-TSNIKA | FGKYKSDYVK | DPIPRDVMEK | Y-TWLAK- | PGAGVMIMDP | 401 |
| SEQ_ID_NO_585 | LNR-TSNIKA | FGKYKSDYVL | EPIPKSDMEK | F-TWLVK- | PGAGVMIMDP | 398 |
| SEQ_ID_NO_560 | LDR-SAGKKT | AFSIKLDYVK | KL-PETAMVK | L-EKLYEEE | VGVGMYVLYP | 418 |
| SEQ_ID_NO_577 | LNR-TQIRSG | KYKGKSDYVR | KPIPVDGLRG | LW-RWLNDDK | VQYSQLQFAP | 409 |
| SEQ_ID_NO_569 | LDR-DLNDAG | FLKRKSDYYQ | TPIPKSGLES | LW-QKMIE- | LGKVGMVFNA | 404 |
| SEQ_ID_NO_575 | LDR-NHYSVH | SNKRKSDYYQ | TPISKDGFTW | W-KKMIE- | LGKVSIVFNP | 411 |
| SEQ_ID_NO_576 | LDEPKDPQPL | YQKNKSDYVK | KPIPREALES | W-KLME- | GENFLMQMNP | 402 |
| SEQ_ID_NO_578 | LSR-TPQRLN | PFKIKSDYYQ | NPISKRQFEF | F-ERMKE- | LENQMLAFNP | 412 |
| SEQ_ID_NO_579 | LSR-TPQRLN | PFKIKSDYVK | NTISKQGFES | F-ERMKE- | LENQMLAFNP | 411 |
| SEQ_ID_NO_558 | RNR-IPQKQI | YLKRKSDYYQ | KPISRTGLES | F-KIMTE- | NENVTMAFNP | 407 |
| SEQ_ID_NO_571 | LDR-IPKGVS | YLKRKSDYVK | EPISKEGLES | W-KVMTE- | VGEYAMLWNP | 402 |

| | | | | | | | |
|---|---|---|---|---|---|---|---|
| SEQ_ID_NO_559 | FGGQMSKISS | DFTPFPHRSG | TRLMVEYIVA | ANDSEQKKKT | EFLDWLEKVY | 441 |
| SEQ_ID_NO_586 | QGGLMSRISS | DSTPFPHRKP | TLMMMEYIVA | ADRDEDAKSV | EFIGMLHGFY | 438 |
| SEQ_ID_NO_591 | QGGWMDRIST | DASPFPHRSG | TLSMVEYIVA | ADKHEDLHSN | EFIHWLHQLF | 439 |
| SEQ_ID_NO_581 | YGGVMSSIPP | SETPFPHRQG | NLYDLQYYSF | AYENGTAAAE | KRMSWVRGLY | 455 |
| SEQ_ID_NO_588 | YGGRMASISP | SATPFPHRKG | NLYNLQYYSF | AFENGTAAME | KRMNWVRGLY | 449 |
| SEQ_ID_NO_589 | YGATISKPGE | ADTPFPHRKG | MLYNIQYITF | WFGEGAPAEA | -PIKMIRDFY | 447 |
| SEQ_ID_NO_590 | YGATISKPGE | ADTPFPHRKG | MLYNIQYITF | WFGEGAPAEA | -PIKMIRDFY | 452 |
| SEQ_ID_NO_584 | YGATISATPE | SATPFPHRKG | VLFNIQYVNY | WFAPGAAAAL | -PLSWSKDIY | 446 |
| SEQ_ID_NO_583 | YGARISSIPQ | DATPFPHRQG | VLFNIQYVSY | WFGEGDGAAL | -PTQMSRDMY | 449 |
| SEQ_ID_NO_585 | YGGIASVPE | SATPFPRRSG | VLFNIQYVVY | WFGEGAAAL- | -PTQNTRDIY | 446 |
| SEQ_ID_NO_560 | YGGLMDEISE | SAIPFPHRAG | IMYELWYTAT | WEKQEDNEK- | -HINWVRSVY | 466 |
| SEQ_ID_NO_577 | YGGKMDNISE | SEIPFAHRSG | YIFHIHYVYV | WQEEGDEATQ | RHVNMRRLY | 459 |
| SEQ_ID_NO_569 | YGGRMDDIKP | DEIPFPHRAG | NLYKIQYSVN | ADQPGSEADK | NFTTQAKLLH | 454 |
| SEQ_ID_NO_575 | YGGKMNEVPS | DATPFPHRAG | NLYKIQYTVS | WQEPGAAVEK | SFLSDIRVLH | 461 |
| SEQ_ID_NO_576 | YGGRMEEILP | SETPFSHRAG | NLFLIQYLNI | ASNESSEVSE | RHVNFSRSFF | 452 |
| SEQ_ID_NO_578 | YGGRMSEISE | FAKPFPHRSG | NIAKIQYEVN | AEDLSDEAEN | RYLNFTRLMY | 462 |
| SEQ_ID_NO_579 | YGGRMSEISE | FAKPFPHRSG | NIAKIQYEVN | ADELGVEAAN | RYLNFTRVMY | 461 |
| SEQ_ID_NO_558 | YGGRMSEIPS | TETAFPHRAG | NMFKIQYAAN | WFVPGEAVAK | DCLSQTERLF | 457 |
| SEQ_ID_NO_571 | YGGKMSEISE | TETAFPHRAG | NIFKIQYSVN | AKQEGIDTTN | HYVNLTRTLF | 452 |

Figure 17 (continued)

| | | | | | | | | |
|---|---|---|---|---|---|---|---|---|
| SEQ_ID_NO_559 | EFMKPFVSKN | PRLGYVNHID | LDLGGIDW-- | -GNKTVVNN- | AIEISRS- | WG | 486 |
| SEQ_ID_NO_586 | NYMGQFLPSD | PRIAYVNHVD | LDLGRLDW-- | -TNSTIASN- | AIEIART- | WG | 483 |
| SEQ_ID_NO_591 | DYMGKFVSNN | PRVGYVNHVD | LDLGRIDW-- | -VNKTISSGR | AIEIART- | WG | 485 |
| SEQ_ID_NO_581 | KEMEPYVSKN | PRAVYVNYRD | LDLGINELD- | -GDVT---- | SYEKARVS | WG | 498 |
| SEQ_ID_NO_588 | REMEPYVSKN | PRTGYVNYRD | LDLGTNELE- | -GNVT---- | SYAKARI- | WG | 491 |
| SEQ_ID_NO_589 | AFMEPYVTKN | PRQAYVNYRD | LDLGVNAVEA | GANVS---- | CYQVGKV- | WG | 491 |
| SEQ_ID_NO_590 | AFMEPYVTKN | PRQAYVNYRD | LDLGVNAVEA | GANVS---- | CYQVGKV- | WG | 496 |
| SEQ_ID_NO_584 | NYMEPYVSKN | PRQAYANYRD | IDLGRNEVV- | -NDVS---- | TYASGKV- | WG | 488 |
| SEQ_ID_NO_583 | AFMEPYVSKN | PRQAYANYRD | LDLGVNEVV- | -GDVS---- | TYDSGRV- | WG | 491 |
| SEQ_ID_NO_585 | DFMTPYVSKN | PRQAYVNYRD | LDLGVNQVV- | -GNVS---- | TYASGKV- | WG | 488 |
| SEQ_ID_NO_580 | NFTTPYVSQN | PRLAYLNYRD | LDLGKTNP-- | -ESPN---- | NYTQARI- | WG | 507 |
| SEQ_ID_NO_577 | KYMEPYVSNS | PRAAYVNYRD | LDIGVNN--- | -NGYT---- | SYHQAS|- | WG | 499 |
| SEQ_ID_NO_569 | DFMTPFVSKN | PRSAYFNYRD | DVG--S--- | -TKKW---- | SYEEGKV- | YG | 492 |
| SEQ_ID_NO_575 | NYMTPFVSKN | PRSAYFNYRD | LDIGINS--- | -HGKD---- | NFEDGKV- | YG | 501 |
| SEQ_ID_NO_576 | EFMTPYVSTS | PREAFLNYRD | ADIGANHP-- | -SNVT---- | RFDIAKT- | YG | 493 |
| SEQ_ID_NO_578 | DYMTPFVSKN | PREAFLNYRD | LDIGINS--- | -HGRN---- | AYTEGMV- | YG | 502 |
| SEQ_ID_NO_579 | DYMTPFVSKN | PREAFLNYRD | LDIGVNS--- | -HGKN---- | AYGEGMV- | YG | 501 |
| SEQ_ID_NO_558 | EAMSPYVSKN | PREAFLNYRD | VDIGK----- | -SLNS---- | TYEEGKV- | YG | 495 |
| SEQ_ID_NO_571 | EAMTPYVSKN | PREAFLNYRD | DIGSIGS--- | -HGNG---- | TFQEASV- | YG | 493 |

| | | | | | | |
|---|---|---|---|---|---|---|
| SEQ_ID_NO_559 | ESYFLS-NYE | RLIRAKTLID | PNNVFNHPQS | PPMANFDYL | EKTLGSDGGE | 535 |
| SEQ_ID_NO_586 | EKYFLS-NYE | RLVRAKTLID | PKNVFHHPQS | PPMPQDDLR | PNGIWRTEEM | 532 |
| SEQ_ID_NO_591 | EKYFMS-NYD | RLVRAKTMID | PKNVFNHPQS | PPLLEIMLD | NVKENDVIYK | 534 |
| SEQ_ID_NO_581 | DKYFKG-NFK | RLAAVKTMVD | PHDFFRNEQS | PPLPTAKMM | IDSI------ | 541 |
| SEQ_ID_NO_588 | EKYFRG-NFE | RLAAVKAMVD | PDDFFRNEQS | PPLPAAKGW | SSI------- | 533 |
| SEQ_ID_NO_589 | EKYFKG-NFE | RLARTKAKVD | PTDFFRNEQS | PPLLA---- | ---------- | 526 |
| SEQ_ID_NO_590 | EKYFKG-NFE | RLARTKAKVD | PTDFFRNEQS | PPLLA---- | ---------- | 531 |
| SEQ_ID_NO_584 | QKYFKG-NFE | RLAITKGKVD | PTDYFRNEQS | PPLIKKY-- | ---------- | 525 |
| SEQ_ID_NO_583 | EKYYNG-NFE | RLARTKAKVD | PCDYFRNEQS | PPLLK---- | ---------- | 526 |
| SEQ_ID_NO_585 | EKYFKG-NFE | RLARTKGKID | PEDYFRNEQS | PPLL----- | ---------- | 522 |
| SEQ_ID_NO_580 | EKYFGK-NFN | RLVKVKTKAD | PNNFFRNEQS | PPLPPHHH- | ---------- | 545 |
| SEQ_ID_NO_577 | LKYFSN-NFK | RLATVKTKVD | PHNFFRNEQS | PTLSKE--- | ---------- | 535 |
| SEQ_ID_NO_569 | ESYFNG-NYE | RLVDVKTAVD | ANNFFRNEQS | PPRSSKI-- | ---------- | 529 |
| SEQ_ID_NO_575 | IKYFNK-NFE | RLVKVKSAID | PENFFMNEQS | PTYPRSNA- | ---------- | 539 |
| SEQ_ID_NO_576 | SKFFKG-NFE | RLVSVKTKVD | PQNFFRYEQS | PTRSL---- | ---------- | 528 |
| SEQ_ID_NO_578 | HKYFKETNYK | RLVSVKTKVD | PDNFFRNEQS | PTLSS---- | ---------- | 538 |
| SEQ_ID_NO_579 | HKYFKETNYK | RLIMVKTRVD | PSNFFRNEQS | PTLSSSWK- | ---------- | 540 |
| SEQ_ID_NO_558 | FKYFKD-NFE | KLVKIKSRVD | PDNFFRYEQS | PVLSSH--- | ---------- | 531 |
| SEQ_ID_NO_571 | HKYFKD-NFD | RLVQIKTRVD | PDNFFGYEQS | PTQSSSYRP | DLCAWQQPRK | 542 |

Figure 17 (continued)

| SEQ_ID_NO_559 | VVI                                                                            | 538 |
| SEQ_ID_NO_586 | FFLE-                                                                          | 536 |
| SEQ_ID_NO_591 | L                                                                              | 535 |
| SEQ_ID_NO_581 |                                                                                | 541 |
| SEQ_ID_NO_588 |                                                                                | 533 |
| SEQ_ID_NO_589 |                                                                                | 526 |
| SEQ_ID_NO_590 |                                                                                | 531 |
| SEQ_ID_NO_584 |                                                                                | 525 |
| SEQ_ID_NO_583 |                                                                                | 526 |
| SEQ_ID_NO_585 |                                                                                | 522 |
| SEQ_ID_NO_560 |                                                                                | 545 |
| SEQ_ID_NO_577 |                                                                                | 535 |
| SEQ_ID_NO_569 |                                                                                | 529 |
| SEQ_ID_NO_575 |                                                                                | 539 |
| SEQ_ID_NO_576 |                                                                                | 528 |
| SEQ_ID_NO_578 |                                                                                | 538 |
| SEQ_ID_NO_579 |                                                                                | 540 |
| SEQ_ID_NO_558 |                                                                                | 531 |
| SEQ_ID_NO_571 | RTLGARTSER AWQQHQAADT WRRAVMPYGL GKLARLAKHP KRRFTGPPAW                         | 592 |

| SEQ_ID_NO_559 |                                                                                | 538 |
| SEQ_ID_NO_586 |                                                                                | 536 |
| SEQ_ID_NO_591 |                                                                                | 535 |
| SEQ_ID_NO_581 |                                                                                | 541 |
| SEQ_ID_NO_588 |                                                                                | 533 |
| SEQ_ID_NO_589 |                                                                                | 526 |
| SEQ_ID_NO_590 |                                                                                | 531 |
| SEQ_ID_NO_584 |                                                                                | 525 |
| SEQ_ID_NO_583 |                                                                                | 526 |
| SEQ_ID_NO_585 |                                                                                | 522 |
| SEQ_ID_NO_560 |                                                                                | 545 |
| SEQ_ID_NO_577 |                                                                                | 535 |
| SEQ_ID_NO_569 |                                                                                | 529 |
| SEQ_ID_NO_575 |                                                                                | 539 |
| SEQ_ID_NO_576 |                                                                                | 528 |
| SEQ_ID_NO_578 |                                                                                | 538 |
| SEQ_ID_NO_579 |                                                                                | 540 |
| SEQ_ID_NO_558 |                                                                                | 531 |
| SEQ_ID_NO_571 | VCRHVLWQT PTSGSAATRA WGMCPALLTL QTWALGADSH ARVNCDPHLS                          | 642 |

Figure 17 (continued)

| | | |
|---|---|---|
| SEQ_ID_NO_559 | .......... .......... .......... .......... .......... | 538 |
| SEQ_ID_NO_586 | .......... .......... .......... .......... .......... | 536 |
| SEQ_ID_NO_591 | .......... .......... .......... .......... .......... | 535 |
| SEQ_ID_NO_581 | .......... .......... .......... .......... .......... | 541 |
| SEQ_ID_NO_588 | .......... .......... .......... .......... .......... | 533 |
| SEQ_ID_NO_589 | .......... .......... .......... .......... .......... | 526 |
| SEQ_ID_NO_590 | .......... .......... .......... .......... .......... | 531 |
| SEQ_ID_NO_584 | .......... .......... .......... .......... .......... | 525 |
| SEQ_ID_NO_583 | .......... .......... .......... .......... .......... | 526 |
| SEQ_ID_NO_585 | .......... .......... .......... .......... .......... | 522 |
| SEQ_ID_NO_560 | .......... .......... .......... .......... .......... | 545 |
| SEQ_ID_NO_577 | .......... .......... .......... .......... .......... | 535 |
| SEQ_ID_NO_569 | .......... .......... .......... .......... .......... | 529 |
| SEQ_ID_NO_575 | .......... .......... .......... .......... .......... | 539 |
| SEQ_ID_NO_576 | .......... .......... .......... .......... .......... | 528 |
| SEQ_ID_NO_578 | .......... .......... .......... .......... .......... | 538 |
| SEQ_ID_NO_579 | .......... .......... .......... .......... .......... | 540 |
| SEQ_ID_NO_558 | .......... .......... .......... .......... .......... | 531 |
| SEQ_ID_NO_571 | RTQEEYIKLG PAQQDPFKLG SALEGPKIAR LDPLALALVA LMGPVLSKTH | 692 |

| | | |
|---|---|---|
| SEQ_ID_NO_559 | .......... . | 538 |
| SEQ_ID_NO_586 | .......... . | 536 |
| SEQ_ID_NO_591 | .......... . | 535 |
| SEQ_ID_NO_581 | .......... . | 541 |
| SEQ_ID_NO_588 | .......... . | 533 |
| SEQ_ID_NO_589 | .......... . | 526 |
| SEQ_ID_NO_590 | .......... . | 531 |
| SEQ_ID_NO_584 | .......... . | 525 |
| SEQ_ID_NO_583 | .......... . | 526 |
| SEQ_ID_NO_585 | .......... . | 522 |
| SEQ_ID_NO_560 | .......... . | 545 |
| SEQ_ID_NO_577 | .......... . | 535 |
| SEQ_ID_NO_569 | .......... . | 529 |
| SEQ_ID_NO_575 | .......... . | 539 |
| SEQ_ID_NO_576 | .......... . | 528 |
| SEQ_ID_NO_578 | .......... . | 538 |
| SEQ_ID_NO_579 | .......... . | 540 |
| SEQ_ID_NO_558 | .......... . | 531 |
| SEQ_ID_NO_571 | QRSLKKKISL M | 703 |

Figure 18

| | | | | | | | |
|---|---|---|---|---|---|---|---|
| SEQ_ID_NO_603 | MAAAT-SSS | AMAVSTPQGV | AERRGIPAAS | FVEDVETYLR | QAGLEVNSAL | | 48 |
| SEQ_ID_NO_605 | MAAAA----- | -SASTPQGV | AERRGIPAAA | FVEDVEAYLR | QAGLDVNSAL | | 43 |
| SEQ_ID_NO_610 | MAAAAASSSS | SSAAATPQGV | TERRGIPAAS | FVEDVETYLR | QAGLDVNSGL | | 50 |
| SEQ_ID_NO_593 | MSSSS----- | -PSGSGSDL | TERRGIPAAK | FIQDVETYLS | QSGLDPNSAL | | 43 |
| SEQ_ID_NO_595 | MASSS---S | TAVATATETT | TERRGIPGAQ | FVEDVETYLN | QSGLDVNSAL | | 46 |
| SEQ_ID_NO_599 | MASSS----- | -----SESAM | SERRGIPGAQ | FVEDVQTYLT | QSGLDVSSAL | | 40 |
| | | | | | | | |
| SEQ_ID_NO_603 | AFLQERLQQY | KMVEMKLLAQ | QRELQAKIPD | EKCLDIVAT | LKAKKALGEA | | 98 |
| SEQ_ID_NO_605 | AFLQERLQQY | KIVEMKLLAQ | QRDLQAKIPD | EKCLDIVST | LQAKKDLGEA | | 93 |
| SEQ_ID_NO_610 | AFLQERLQQY | KIVEMKLLAQ | QRDLQAKIPD | EKCLDIVAT | LQAKKALGEA | | 100 |
| SEQ_ID_NO_593 | AFHQERLQQY | KVVEMKLLAQ | QRDLQAKIPD | EKCLEVVAT | LEAKKGTGEA | | 93 |
| SEQ_ID_NO_595 | SFLQERLQQY | KLVEMKLLAQ | QRDLQAKIPD | EKCLDVVAT | LQAKKGTGEP | | 96 |
| SEQ_ID_NO_599 | AFLQERLQQY | KVVEMKLLAQ | QRDLQAKIPD | EKCLDVVAT | LKAKKGTGEE | | 90 |
| | | | | | | | |
| SEQ_ID_NO_603 | LIADFELSEG | YSRAKIEDS | DSVCLWLGAN | VMLEYSCDEA | NELLKSNLEN | | 148 |
| SEQ_ID_NO_605 | LIADFELSEG | YSCAKIEDT | DSVCLWLGAN | VMLEYSCDEA | NALLKKNLEN | | 143 |
| SEQ_ID_NO_610 | LTADFELSEG | YSRAKIEDT | DSVCLWLGAN | VMLEYSCDEA | NALLKKNLEN | | 150 |
| SEQ_ID_NO_593 | LLADFEVSEG | YSRACIEDT | DSVCLWLGAN | VMLEYSCEEA | SALLKNNLEN | | 143 |
| SEQ_ID_NO_595 | LIADFEVSEG | YSQARIEDA | ESVCLWLGAN | VMLEYSCEEA | NDLLQKNLDN | | 146 |
| SEQ_ID_NO_599 | LIADFEVSEG | YSRARIEET | NSVCLWLGAN | VMLEYSLEEA | TGLLQKNLDN | | 140 |
| | | | | | | | |
| SEQ_ID_NO_603 | ARASLEVLVG | DLHFLRDQQT | ITQVTIARIF | NWDVHQ-RRS | KQ----SVM | | 192 |
| SEQ_ID_NO_605 | AKASLEVLVA | DLQFLRDQQT | ITQVTIARVF | NWDVHH-RRS | KQ-----AV | | 186 |
| SEQ_ID_NO_610 | AKASLEVLVA | DLQFLRDQQT | ITQVTIARVF | NWDVHQ-RRS | KQ-----AI | | 193 |
| SEQ_ID_NO_593 | AKASLEVLVA | DLQFLRDQVT | VTQVTIARVY | NWDVHQ-RRV | KQVTPTAIAV | | 192 |
| SEQ_ID_NO_595 | AKASLEVLVA | DLLFLRDQVT | ITQVTIARVY | NWDVHQKRRM | RE---AVTAE | | 193 |
| SEQ_ID_NO_599 | ARASLEVLIA | DLQFLRDQVT | ITQVTIARVY | NWDVHQ-RRV | QQ---AVATT | | 186 |
| | | | | | | | |
| SEQ_ID_NO_603 | KET | 195 | | | | | |
| SEQ_ID_NO_605 | KEP | 189 | | | | | |
| SEQ_ID_NO_610 | KET | 196 | | | | | |
| SEQ_ID_NO_593 | ADS | 195 | | | | | |
| SEQ_ID_NO_595 | KDS | 196 | | | | | |
| SEQ_ID_NO_599 | AQD | 189 | | | | | |

Figure 19

| | | | | | | | |
|---|---|---|---|---|---|---|---|
| SEQ_ID_NO_622 | ----MAFSNA | RSAAKLVAS | SESSLSNSVS | RGFHSTGMKR | M-GGHGHDE | | 45 |
| SEQ_ID_NO_613 | ----MALSTS | RSVSKIISS | SEASVSRSVT | RSFHSTGVKK | MSGGHGGYD | | 46 |
| SEQ_ID_NO_620 | ----MALNTG | RSISKIIAF | SEASVSRSVS | RSFHSTGAKK | M-SGGHGHDE | | 45 |
| SEQ_ID_NO_626 | ----MALNTG | RSVSRLIAS | SESSVSRSVS | RSFHSTGAKK | M-SGGHGHDE | | 45 |
| SEQ_ID_NO_643 | ----MAAAAA | --------AA | GEEE--GEAS | RGFHATGVKR | M--GGHGHDE | | 34 |
| SEQ_ID_NO_644 | MATATALNRG | LRSGIRLLAT | GAEA-SKTDS | RGFHATGVKR | M--GGHGHDE | | 47 |
| SEQ_ID_NO_624 | --MATALNRG | LRSGIRLLAT | GAEA-SKPAS | RGFHATGVKR | M--SGHGHDE | | 45 |
| SEQ_ID_NO_636 | --MATALNRG | LRSGIRLLAA | GAEA-SKPAS | RGFHATGVKR | M--GGHGHDE | | 45 |
| SEQ_ID_NO_634 | ----MALSRG | IRSGLKLLSH | SEAALPRSVT | HEFHATSMKR | M--GGHGHDE | | 44 |
| SEQ_ID_NO_615 | ----MAMIRG | GSGIKLLTS | SEAALFRSVT | REFHATGMKR | M--GGHGHDE | | 44 |

| | | | | | | |
|---|---|---|---|---|---|---|
| SEQ_ID_NO_622 | PYYLHAKHMY | NLDRMKHQGL | KMSLAVFTAF | SIGVAVPVYA | VIFQQKKTAS | 95 |
| SEQ_ID_NO_613 | EYYLHAKHMY | NLDRMKYQAL | KMSLGVFTAF | SIGVGVPIFA | VVFQQRKTQS | 96 |
| SEQ_ID_NO_620 | PYYLHAKHMY | NLDRMKYQGL | KMSLGVFTAF | SIGVGVPIFA | VVFQQRKTAS | 95 |
| SEQ_ID_NO_626 | PYYLHAKHMY | NLDRMKFQGL | KMSLAVFTAF | SIGVGVPIFA | VVFQQRKTAS | 95 |
| SEQ_ID_NO_643 | PYYLHAKHMY | NLHRMKHQKP | KVYLSVLGAV | GIGIAVPVYA | VVFQQKKTAS | 84 |
| SEQ_ID_NO_644 | PYYLHAKHMY | NLHRMKHQKP | KVYLSVLGAV | GIGIAVPVYA | VVFQQKKTAS | 97 |
| SEQ_ID_NO_624 | PYYLHAKHMY | NLHRMKHQKL | TAWTSYLGAV | SIGIGVPVFA | VVFQQKKTSS | 95 |
| SEQ_ID_NO_636 | PYYLHAKHMY | NLHRMKHQGL | KVTLSVLGAV | SIGVGVPVYA | VIFQQKKTAS | 95 |
| SEQ_ID_NO_634 | PFYIHAKHMY | NLDRMKHQKL | KVTLGVLSAF | SIGVVPIYA | VIFQQKKAAS | 94 |
| SEQ_ID_NO_615 | PYYLHAKHMY | NLDQMKHQKL | KVALSVWSAF | GIGMAVPVYA | VMFQQKKAAS | 94 |

| | | |
|---|---|---|
| SEQ_ID_NO_622 | S | 96 |
| SEQ_ID_NO_613 | G | 97 |
| SEQ_ID_NO_620 | G | 96 |
| SEQ_ID_NO_626 | G | 96 |
| SEQ_ID_NO_643 | G | 85 |
| SEQ_ID_NO_644 | G | 98 |
| SEQ_ID_NO_624 | G | 96 |
| SEQ_ID_NO_638 | G | 96 |
| SEQ_ID_NO_634 | G | 95 |
| SEQ_ID_NO_615 | A | 95 |

Figure 20

| | | | | | | |
|---|---|---|---|---|---|---|
| SEQ_ID_NO_685 | MGFISFVGRV | LFASLFLLSA | YQEFLEFGND | GGPAAKTLKP | KFNLFVKLVS | 50 |
| SEQ_ID_NO_679 | MGFVSFAGRV | LFASVFLLSA | YQEFSEFGAD | GGPAAKALRP | KYNVFTKNIS | 50 |
| SEQ_ID_NO_681 | MGFVSFAGRV | LFASVFLLSA | YQEFSEFGAD | GGPAAKALRP | KYNVFTKNIS | 50 |
| SEQ_ID_NO_668 | MGFVSFVGRV | LFVAAFLLSA | YQEFNEFGAD | GGPAAKALRP | KFNVFVKNVS | 50 |
| SEQ_ID_NO_676 | MGFVSFVGRV | LFVAAFLLSA | YQEFNEFGTD | GGPAAKALQP | KFNVFVKNIS | 50 |
| SEQ_ID_NO_646 | MELASFLGRA | LFVSVFLLSA | WQEFNDFGED | GGRSAKSLKP | KFNAFVNHVT | 50 |
| SEQ_ID_NO_648 | MALVSFVGRV | LFASVFILSA | WQEFNEFGVD | GGPAAKALKP | KFNVFSKTVT | 50 |
| SEQ_ID_NO_656 | MAFTSFLGRV | LFASVFILSA | YQEFNEFGVD | GGPAAKALKP | KFGVFTSHVD | 50 |
| SEQ_ID_NO_660 | MAFASFLGRV | LFASVFILSA | YQEFNEFGVD | GGPAAKALRP | KFDAFTHRVH | 50 |

| | | | | | | |
|---|---|---|---|---|---|---|
| SEQ_ID_NO_685 | KNTGLGVPHI | DIKTVIAATM | FLKGFGGLLF | LSSSFGAFL | LLIYLAFMTP | 100 |
| SEQ_ID_NO_679 | AHLGVAVPHV | ELKHIVAATI | GLKGLGGLLF | LSSSFGAYL | LLIYLAFITP | 100 |
| SEQ_ID_NO_681 | AHLGVAVPHV | ELKHIVAATI | GLKGLGGLLF | LSSSFGAYL | LLIYLAFITP | 100 |
| SEQ_ID_NO_668 | AHLGVAVPHI | ELKHVIAATI | GLKGLGSLLF | LSSSLGAYL | LLLYLALITP | 100 |
| SEQ_ID_NO_676 | SHLGVAVPHI | ELKHVIAATI | ALKGLGGLLF | LSCSLGAYL | LLLYLAIVTP | 100 |
| SEQ_ID_NO_646 | THTGQQLPPV | DMKILVAAAI | ALKGIGGLLF | VFGSSLGAYL | LLHQAVATP | 100 |
| SEQ_ID_NO_648 | AHTGVEVPEF | DIKVLVAAAV | AFKGVGGILF | FGSTIGAYL | LAQQVVTT | 100 |
| SEQ_ID_NO_656 | SHAGIDVPEI | EIKHLVSAAI | FLKGIGGILF | IGSSLGAYL | LIIHDLAIP | 100 |
| SEQ_ID_NO_660 | SDVGFQLPEI | DLKFLIAGAL | ALKGLGGVLF | FGSSFGALL | LLHDLATP | 100 |

| | | | | | | |
|---|---|---|---|---|---|---|
| SEQ_ID_NO_685 | VYDFYNYEM | ESEQFVQLFF | KFTQNLAFIG | ALLFFLGMKN | SIPRRRSK | 148 |
| SEQ_ID_NO_679 | VVYDFYNYNM | EKSEFVQLFM | KFTQNLALFG | ALLFFLGMKN | SIPKRQAK | 148 |
| SEQ_ID_NO_681 | VVYDFYNYDM | EKSEFVQLFM | KFTQNLALFG | ALLFFLGMKN | SIPKRQAK | 148 |
| SEQ_ID_NO_668 | IHDFYNYDM | EKAEFAGLFA | KFTQDLALIG | ALLFFLGMKN | SIPKROGGK | 149 |
| SEQ_ID_NO_676 | IVHDFYNYDM | EKAEFAQIFG | KFTQDLALIG | ALLFFLGMKN | SIPKRQSK | 148 |
| SEQ_ID_NO_646 | LYDFYNYDV | DRKEFGQLFS | KFTQSLALLG | GLLFFIGMKN | SRKHGRQLR | 149 |
| SEQ_ID_NO_648 | LYDFYNYDT | EKKEFGLLFS | KFSQNLALLG | ALLFFIGMKN | SIPSRQLK | 148 |
| SEQ_ID_NO_656 | LYDFYNYDB | EEKEFNQLFI | KFTQNMALYG | ALLFFIGMKN | SFPRRQHK | 148 |
| SEQ_ID_NO_660 | HYDFYNYDS | EDKEFTQLFI | KFTQNMALFG | ALLFFIGMKN | SIPRR-VP | 147 |

| | | |
|---|---|---|
| SEQ_ID_NO_685 | GRTTKTKTN | 157 |
| SEQ_ID_NO_679 | KKAPKSKTN | 157 |
| SEQ_ID_NO_681 | KKAPKSKTN | 157 |
| SEQ_ID_NO_668 | KKAPKAKTN | 158 |
| SEQ_ID_NO_676 | KKAPKAKTN | 157 |
| SEQ_ID_NO_646 | KKAPKAKAN | 158 |
| SEQ_ID_NO_648 | KKAPKTKTV | 157 |
| SEQ_ID_NO_656 | KKVPKTKTG | 157 |
| SEQ_ID_NO_660 | KKAPKTKTY | 156 |

Figure 21

| | | | | | | |
|---|---|---|---|---|---|---|
| SEQ_ID_NO_708 | MDEI MNKMGS | YWL GQRANKE | MSSAGDDI ES | LSTSVGDGAK | MLVNKLKGKM | 50 |
| SEQ_ID_NO_728 | MDQI FNKVGS | YWL GQKANKE | FNSVGDDI NS | VGSSI GDGTK | MLVNKLKGKM | 50 |
| SEQ_ID_NO_718 | MDQI LNKVGS | YW NKRANKE | SSVGDDLNS | LSSSI EGGAK | MLVNKLKGKM | 50 |
| SEQ_ID_NO_687 | MDQI FNKVGS | YWL GQKANKQ | FDSVGNDLNS | VSTSI EGGTK | MLVNKI KGKM | 50 |
| SEQ_ID_NO_699 | MDQVF XKVGS | YWL GQKANKQ | FDSVGKDVSS | LSTSI EGGTK | ML VNKFKGTM | 50 |
| SEQ_ID_NO_689 | MDQI LNKVGS | YWL GQKANKE | DSVGDDLNS | LSTSI EGGAK | ML VNKI KGKM | 50 |
| SEQ_ID_NO_691 | MDAVLNKVGS | YWL GQKASKE | FNSVGDDI NS | LSTSI EGGTK | MLVNKLKGKM | 50 |
| SEQ_ID_NO_703 | MDQI FNKVGS | YWFNQKASSQ | LNSVGDDI NS | MTNSI XGGTK | MLVNKI KGKM | 50 |
| SEQ_ID_NO_706 | MDQVFNKVGS | YWFNQKASKE | LNSVGDEI NS | LSNSI EGGTK | MLVNKVKGKM | 50 |
| SEQ_ID_NO_721 | MDQI MGKVGG | YWFKQNAGKE | NNI GDDI NS | SSSI GDGAK | MMVNKI KGKM | 50 |
| SEQ_ID_NO_712 | MDQVLNKVGS | YWFSKRASKE | DSI GDDLNS | VSSSI GGGAK | MMVNKI KGKL | 50 |
| SEQ_ID_NO_724 | MDQVLNKVGS | YWFSKRASKE | DSI GDDI SS | STSI GTGAK | MMVNKI KGKM | 50 |
| | | | | | | |
| SEQ_ID_NO_708 | QKPLAELLQE | HDLPAGLFPR | EATNYEFEPE | TRRLTVHI PA | VCEVGYRDGS | 100 |
| SEQ_ID_NO_728 | QKPLPELLKD | YDLAVGI FPR | DATHYEFDER | QGKLTVYVPQ | I CEVGYKDSS | 100 |
| SEQ_ID_NO_718 | QKSLPELLRE | YDMPI GLFPQ | DATHYEFNEE | TGKLTVFI PS | I CEVGYRDSS | 100 |
| SEQ_ID_NO_687 | QKPLPELLKE | YDLPI GI FPG | DATNYEFDEE | TKKLTVL PS | I CEVGYKDSS | 100 |
| SEQ_ID_NO_699 | QKPLAELLKD | YDLPVGI FPR | DATNYEFDEQ | TKKLTVL PS | VCEVGYKDSS | 100 |
| SEQ_ID_NO_689 | QKPLPELLRE | YNLPI GI FPR | DATNYEFNEE | TGKLTVFI PA | I CEVGYKDSS | 100 |
| SEQ_ID_NO_691 | QKPLPDLLKE | YDLPI GI FPR | DATNYEFNEE | TRKLTVFI PS | I CEVGYKDSS | 100 |
| SEQ_ID_NO_703 | QKALPELLKE | YDLPI GI FPR | DATNYEFNEE | TGKLMYI PQ | VCEVGYKDSS | 100 |
| SEQ_ID_NO_706 | QKPLPELLKE | YDLPI GI FPR | DATNYEFNEE | TGKLEVFI PQ | VCEVGYKDSS | 100 |
| SEQ_ID_NO_721 | QKPLPEFLKE | YDLPVGLFPQ | DATNYEFNEE | TKKLTVYI SS | VCEVGYKDSS | 100 |
| SEQ_ID_NO_712 | QKALPDLLKE | YDMPAGLFPR | DTTNYEFNEE | TKKLTVYI PS | ACDVGYKDSS | 100 |
| SEQ_ID_NO_724 | QKALPDLLKE | YDMPAGLFPR | DATNYEFNEE | TKKLTVYI PS | ACDVGYKDSS | 100 |
| | | | | | | |
| SEQ_ID_NO_708 | ELRFDTTVTG | TLDKGSLTGV | EGLKAKVLVW | ARVTAVKADA | AKVYFAVGI K | 150 |
| SEQ_ID_NO_728 | VLRFFAI VTG | YLEKGKLADI | EGLKTKI I I W | VKVTAI TSEG | SKLHFTAGVK | 150 |
| SEQ_ID_NO_718 | VLRFLNI VTG | YLEKGKLVDI | EGI KTKVLI W | SKVTR STEG | SKI HFTGVK | 150 |
| SEQ_ID_NO_687 | VLKFI TTVTG | HLEKGKLTDV | EGI KTKVMI W | VKVTSI STDA | SKVYFTAGMK | 150 |
| SEQ_ID_NO_699 | VLKFI TTVTG | RLEKGKLGDL | EGMKTKVMI W | VKVTSI SADS | SKVYFTAGVK | 150 |
| SEQ_ID_NO_689 | F-----CASS | PLL-------- | ---------- | ---------- | ---------- | 107 |
| SEQ_ID_NO_691 | VVRFLTTVTG | YLEKGKI ADI | EGMKTKVMI W | VKVTCI ASTS | SKLNFTAGMK | 150 |
| SEQ_ID_NO_703 | VLRFXTTVTG | YLEKGKLADI | EGMKTKVLI W | VKVTT LSXS | XKAYVTAGXK | 150 |
| SEQ_ID_NO_706 | VLRFFTTVTG | YLEKGKLADI | EGMKTKVI I W | VKVTT FSEG | SKLYVTAGMK | 150 |
| SEQ_ID_NO_721 | VLRFSTTVTG | YLENGKLSEV | EGLKTKI LI W | TKVTAVRTEA | TKVHFAAGMN | 150 |
| SEQ_ID_NO_712 | VVRFFTCVTG | YLEKGKLSDI | EGMKTKVLVW | TKVTSI KTEG | SKVHFTAGMK | 150 |
| SEQ_ID_NO_724 | VLRFFTCVTG | YLEKGKLSDI | EGLKTKVLVW | TKVTAI KTEG | SKVHFTAGVK | 150 |

Figure 21 (continued)

| | | | | |
|---|---|---|---|---|
| SEQ_ID_NO_708 | KSRSREAYEV | VRGAI TVDEF | | 170 |
| SEQ_ID_NO_728 | KTRSREAYQV | LRDGVLVDKF | | 170 |
| SEQ_ID_NO_718 | KTRSRDAYQV | LRAGI TVDKF | | 170 |
| SEQ_ID_NO_687 | KSRSRDAYEV | QRNGLRVDKF | | 170 |
| SEQ_ID_NO_699 | KSRNRDAYEV | LRDGVRADKF | | 170 |
| SEQ_ID_NO_689 | .......... | .......... | | 107 |
| SEQ_ID_NO_691 | KTRDRGAYEV | LRDGVGI DKF | | 170 |
| SEQ_ID_NO_703 | KTRSREAYEV | TRXGVCI DKF | | 170 |
| SEQ_ID_NO_706 | KTRSREAYDV | TRDGVPVDKF | | 170 |
| SEQ_ID_NO_721 | KARNRDAYEV | VRDGVGI DKF | | 170 |
| SEQ_ID_NO_712 | KTRSRDAYEV | VRDGI I DKF | | 170 |
| SEQ_ID_NO_724 | KTRSRDAYEV | VRDGI P DKF | | 170 |

Figure 22

```
SEQ_ID_NO_737   ··MDEL GGGG G····KKGKA WPWWL GASAA QI TGAL VMFR RGKGG SDMTM   44
SEQ_ID_NO_738   ···MEE GGGG E·····EAER WPWWA GASAA QVAAG VAWFR RGRGG ANFAM   42
SEQ_ID_NO_742   ··MDDR GGGG G····GEAER WPWWA AASAA QAAAG VAWFR RGRGG TAVAM   44
SEQ_ID_NO_735   MKMEE AAGSG N····SDGGN KWWWG VASAA QMGLG I RTFA KGHGG DSRLM   46
SEQ_ID_NO_730   MEEQN AGTGA GESSLL DGSG HWWWA LGSGA QI MWGI RLI R RGYAG DVRLM   50
SEQ_ID_NO_732   ···MEN GCGG G····I ETQW WWWWA MASMA KF GWGI SAYK RGF AG DSRLM   43

SEQ_ID_NO_737   PFRAFAVASL FVGAGATTVT AGVSAAGVGS VEEMKGL GAR RKWSRVPPR   94
SEQ_ID_NO_738   PFKAFAI ATL FVGAGATAVT AGVL AAGVGS VDEMKGVGAS RRWMGAPPR   92
SEQ_ID_NO_742   PFKAFAI ASL FVGAGATAVS AGVL AAGVGS VEEMKGVGAS RRWMGAPPR   94
SEQ_ID_NO_735   PFKAFVVASL FVSSAASASV LLL QANGI HR VEDL MKAGAN LRAKL GLRPR   96
SEQ_ID_NO_730   PLKAFGVASL FVGSL ATSSV ALVRATGI HT VQDAI DLGAN RTNL GVTPQ   100
SEQ_ID_NO_732   PLKAFAVASL FVGSAASASI ASL QASGI HK VQDLI ELGAN RTGL GVPPR   93

SEQ_ID_NO_737   RVEGGE·····   100
SEQ_ID_NO_738   RRVEGGGDP··   101
SEQ_ID_NO_742   RAGGSD·····   100
SEQ_ID_NO_735   TQNKNMDDS··   105
SEQ_ID_NO_730   I PDKQI TERD G   111
SEQ_ID_NO_732   VAKE·······   97
```

Figure 23

| | | | | | | |
|---|---|---|---|---|---|---|
| SEQ_ID_NO_765 | MSPMSNPSFD | HSY---E--L | PLRRNLLLL | DLLGRLRFI A | EVLLDRLGVA | 45 |
| SEQ_ID_NO_763 | MMLSSAYSTP | AADELGGPPP | LPPPPGADVS | VIVGALTGVL | LGLFLFL--- | 47 |
| SEQ_ID_NO_758 | -----MGFP | VGY--PE--V | SVPNIFLYTL | SLLSFLRSLT | ISFLBLLHLS | 40 |
| SEQ_ID_NO_761 | -----MGFP | VGY--SE--L | LLPRLLLQVL | LLLGHLHRFL | LAAFHAVGLG | 40 |
| SEQ_ID_NO_762 | -----MGFP | VGY--SE--L | LLPRLLLQVL | LLLGHLHRFL | LAAFHAVGLG | 40 |
| SEQ_ID_NO_755 | -----MGFY | AEDPLSG--L | TIGQAI YEVA | LMIAVLRWL | CLIFRV--- | 39 |
| SEQ_ID_NO_748 | -----MGFF | VEE--SG--L | VFHLLYKAA | LVLAVLRWAL | AWALRFK--- | 37 |
| SEQ_ID_NO_746 | -----MTFF | IED--TS--L | ISHVLYKTA | LIITVLRWI F | AWLRYR--- | 37 |
| SEQ_ID_NO_751 | -----MTFF | IED--TS--L | IBHVLYKTA | LIITVLRWI F | AWLRYR--- | 37 |
| SEQ_ID_NO_753 | -----MSFF | IQD--SG--L | VFQLLYQMA | VFTLLRWI F | SWLRYR--- | 37 |
| SEQ_ID_NO_760 | -----MSFF | LED--SG--L | VFQLLYQMA | VLITLLRWI F | TMLRYR--- | 37 |

| | | | | | | |
|---|---|---|---|---|---|---|
| SEQ_ID_NO_765 | SW-----QG | EVHLPGQLWG | WGGEHASDAT | LEHFLEARLW | ETGTRSPLTT | 89 |
| SEQ_ID_NO_763 | ---------- | --IYAKHCRQ | RGRGGARGAA | GGLGLGFRAS | STCDRCRSGV | 85 |
| SEQ_ID_NO_758 | DL-------- | ---------- | ---------L | DTDFSTTTLP | DSHIHRPTLS | 63 |
| SEQ_ID_NO_761 | DLIDNPPGLA | ATEQDMML QG | RGGGMAEGWA | SSSALQHRRP | EFRAIPPM- | 88 |
| SEQ_ID_NO_762 | DLIDNPPGLA | ATEQDLMLQG | RGGGMAEGWA | SSSALQHRRP | EFRAIPPM- | 88 |
| SEQ_ID_NO_755 | ---------- | ---------- | ---------- | NDRRTCSDE | TPTPEPCSQM | 59 |
| SEQ_ID_NO_748 | ---------- | ---------- | ---------N | RTHLASPSND | SLRRSHPVPS | 58 |
| SEQ_ID_NO_746 | ---------- | ---------- | ---------- | SRSSSSSBS | SQSSBSPSIS | 57 |
| SEQ_ID_NO_751 | ---------- | ---------- | ---------- | --SRBSSBS | SQSSBSPSIS | 55 |
| SEQ_ID_NO_753 | ---------- | ---------- | ---------- | ------SKS | RTSSAPPVL-S | 49 |
| SEQ_ID_NO_760 | ---------- | ---------- | ---------- | ----SRSTSS | SSSBTPPL-S | 52 |

| | | | | | | |
|---|---|---|---|---|---|---|
| SEQ_ID_NO_765 | TRYRRRVAL | AQPADGKLAA | EGDAEGAA-- | AVCAICVAGL | ESCDLEIVVE | 137 |
| SEQ_ID_NO_763 | SLSVVDALPV | VRFGD---MG | GAAAAQP-- | -ECAVCLGTF | DPAADELLRV | 129 |
| SEQ_ID_NO_758 | AILROFLPI | ITFND---LA | EGDSSPPV-- | -GCAVCLNEF | --AGEEEIRC | 105 |
| SEQ_ID_NO_761 | --AIEEALPV | VRFDE---LV | ASAPAAVCGG | GDCAVCLSGI | --CGRDEVRR | 131 |
| SEQ_ID_NO_762 | --AIEEALPV | VRFDE---LV | ASAPAAVCGG | GDCAVCLSGI | --CGRDEVRR | 131 |
| SEQ_ID_NO_755 | TRDKDSILLL | TTFGE---IK | ERLPETE--- | ETCAVCLSQL | --SVEDEVRE | 101 |
| SEQ_ID_NO_748 | SQQRDGLL | TTFGD---VT | ERMPLGVC-- | DTCAVCLSQL | --RDQDEVRE | 100 |
| SEQ_ID_NO_746 | SQTIKESLAV | FAFRD---AV | ERSPAAIN-- | DMCAVCLGDL | --EDEDEIRE | 100 |
| SEQ_ID_NO_751 | SQTIKESLAV | SAFRD---AV | ERSPAAIN-- | DMCAVCLGDL | --EDEDEIRE | 98 |
| SEQ_ID_NO_753 | SQAIKESLSV | TTFHD---AL | ERKPELIS-- | DTCAVCLGDL | --EDGDEVRE | 92 |
| SEQ_ID_NO_760 | SQTIKESLAV | TTFRD---AA | DRSPELIS-- | DTCAVCLGDL | --EDGDEVRE | 95 |

Figure 23 (continued)

| SEQ_ID_NO_765 | LCSCSHAFHD ACIDAWRSG D--------- -DDAATCPLC RAPCCPRRG- | 176 |
|---|---|---|
| SEQ_ID_NO_763 | LPKCRHAFHA DCVDTMLEA- ---------- ---HSTCPVC RRRVGKEDA- | 164 |
| SEQ_ID_NO_758 | MANCRHMFHR TCVDRWIDHD ---------- ---QKTCPLC RTHFVPYHK- | 141 |
| SEQ_ID_NO_761 | LSNCRHVFHR GCLDRWMAHE ---------- ---QRTCPLC RAPLIPDELL | 168 |
| SEQ_ID_NO_762 | LSNCRHVFHR GCLDRWMAHE ---------- ---QRTCPLC RAPLIPDELL | 168 |
| SEQ_ID_NO_755 | LMNCYHVFHR ECIDRWLEHE HE-------- -NHSATCPIC RAPLLSSSC- | 141 |
| SEQ_ID_NO_748 | LRNCCHVFHR DCIDRWVDHD HEHD------ -ENHNTCPLC RAPLLTTSQ- | 142 |
| SEQ_ID_NO_746 | LRNCTHVFHR DCIDRWLDYE CCGGDD---- -DNHRTCPLC RTPLLPSFT- | 144 |
| SEQ_ID_NO_751 | LRNCTHVFHR DCIDRWLDYE CCGGDD---- -DNHRTCPLC RTPLLPSFT- | 142 |
| SEQ_ID_NO_753 | LRNCSHVFHR ECIDRWLDYE CCGGDGNEGE EDNHRTCPLC RTPLLAADT- | 141 |
| SEQ_ID_NO_760 | LRNCSHVFHR ECIDRWLDYE CCGGDDNDGE EDNHRTCPLC RTPLLAANT- | 144 |

| SEQ_ID_NO_765 | ---------- ---------- TTTGGEQSLS R----VLKGV CVSVP | 197 |
|---|---|---|
| SEQ_ID_NO_763 | ---------- -----FAVIP ELEAADADIY PAREAEMQIV VRRPA | 194 |
| SEQ_ID_NO_758 | ----MEDYN QRLWNDAASE DDIDDDMSLF SHRHDYYYI A NASL- | 180 |
| SEQ_ID_NO_761 | PAASGLPDPS DYDLSYYPSP LPLAPTPTLL RPHELLLNGL GGFQ- | 212 |
| SEQ_ID_NO_762 | PAASGLPDPS DYDLSYYPSP LPLAPTPTLL RPHELLLNGL GGFQ- | 212 |
| SEQ_ID_NO_755 | ---------- ----HHSSAT CLPPPQPSWA VERLLYLFGD DLLPC | 172 |
| SEQ_ID_NO_748 | ---------- --------SL ARTRAEPSWA VERILYLFGD DLVM- | 168 |
| SEQ_ID_NO_746 | ---------- --------D YSTVTQTSWA VERLLYLFGD DLLP- | 169 |
| SEQ_ID_NO_751 | ---------- --------D YSTVTQTSWA VERLLYLFGD DLLP- | 167 |
| SEQ_ID_NO_753 | ---------- -----SSCGD WPVKTEPSWA VERLLYLFGD DLLV- | 170 |
| SEQ_ID_NO_760 | ---------- -----SSCAD WPVKNEPSWA VERLLYLFGD DLLV- | 173 |

Figure 24

| | | |
|---|---|---|
| SEQ_ID_NO_779 | MVLESIL SS S--KSPSF------RRQF AKHELGSWST LKRHRFLLF | 39 |
| SEQ_ID_NO_783 | MVLDSILSSS PCLKSPSF------SRQF ARHELGSWST VKRHCFLLS | 42 |
| SEQ_ID_NO_769 | MVLDGLV SS PSRRQCL------KKQW--DELGSWST LIQRHQYLLT | 39 |
| SEQ_ID_NO_777 | MVLDGIV SS PLRRHQSL------KKQW--EDLGSCST VVNRHRYLLT | 39 |
| SEQ_ID_NO_773 | MVLDSMI TS PHRRSPSF------RKPF PRDELGSWST LLRRHRFLLT | 41 |
| SEQ_ID_NO_771 | MVLDGIV SS PLRRSAST------RRQS SRDEFGSWST VERHRFLLT | 41 |
| SEQ_ID_NO_789 | MVLDSL--SS PHRRSQNTVF LASPSKKQQS GFNEPGSWST IYERHRFLLT | 48 |
| SEQ_ID_NO_785 | MVLDSL--SS PHRRSQNTFF VSSA-KKPQS SRDD--SWSA LVERHRFLLT | 45 |
| SEQ_ID_NO_790 | MVLDSL--SS PHRRSQNTFF LSSP-KKLQS SKDDVGSWSA LVERHRFLLT | 47 |

| | | |
|---|---|---|
| SEQ_ID_NO_779 | ALALLTVLCT IYLYFAVTFA AN--DSCSGL NGPLKDSCHM EHVKASVAKS | 87 |
| SEQ_ID_NO_783 | ALALLTVLCT IYLYFAVTFA AN--DSCSGL SGSLRDSCHM EHVMDSEAKS | 90 |
| SEQ_ID_NO_769 | ALALLAFLCT VYLYFAVTLG ARH-SSCYGL TGKDKAMCQL -QLVQALSKG | 87 |
| SEQ_ID_NO_777 | ALLLGFLCT VYLYFAVTLD ARHNSSCYGL AGKEKAMC-----QAISKG | 83 |
| SEQ_ID_NO_773 | AFALLAFLCT IYLYFAVTLG AT--ESCSGL TGTKKTLCRL ELAKDSVGNG | 89 |
| SEQ_ID_NO_771 | ALGLLAFLCT IYLYFAVTLG AT--DTCSGL KGTEKATCNL QHVSSTLSHG | 89 |
| SEQ_ID_NO_789 | MLALLAFLCT IYLYFAVTLG AT--GSCSGM SGAEKALC- -QAKSSLHKG | 93 |
| SEQ_ID_NO_785 | TLLVLAFLCT VYLYFAVTLG AS--DACTGL TGAEREC- -QARSVLQHG | 90 |
| SEQ_ID_NO_790 | TLVVLVFLCT IYLYFAVTLG AP--DACSGL AGTEKAVC- -RAKSALRHG | 92 |

| | | |
|---|---|---|
| SEQ_ID_NO_779 | KLKGLRHF | 95 |
| SEQ_ID_NO_783 | KLKGLRHL | 98 |
| SEQ_ID_NO_769 | KLK---FF | 92 |
| SEQ_ID_NO_777 | KLK---LF | 88 |
| SEQ_ID_NO_773 | KLK---FF | 94 |
| SEQ_ID_NO_771 | KLK---FL | 94 |
| SEQ_ID_NO_789 | KLK---FF | 98 |
| SEQ_ID_NO_785 | KLK---FR | 95 |
| SEQ_ID_NO_790 | KLK---FF | 97 |

Figure 25

```
SEQ_ID_NO_799    - - MI AE - SM LLNPTSHI ST N DSLDDPSP A- - - - - - - - - - - - - - - - -   26
SEQ_ID_NO_819    MMMMGE- - -  - - - GVSSVPP M- - - - SHL PV SGMDVLGGGG G- - - - - - - GG     32
SEQ_ID_NO_821    MMMMGE- - -  - - - GVSSVPP M- - - - SHL PV SGMDVLGGGG G- - - - - - - GG     32
SEQ_ID_NO_810    MMMMGE- - -  - - - - RAHAPP M- - - - QHSPA A- - - - - - SGV T- - - - - - - DA  25
SEQ_ID_NO_816    MMMMGE- - -  - - - - GAHAPP MQQQQQQPAA S- - - - - - AGM V- - - - - - - DG     29
SEQ_ID_NO_801    - MMI GELSHH RSNPTVQI PQ MDPYEEQTTT SPSLSPI PTS P- - - - - - - - F         41
SEQ_ID_NO_792    - MMI GE SHR GFNPTVHI PP M- PLSEDLTV SDI YGSPDGG S- - - - - - - - -           38
SEQ_ID_NO_794    - MML GE THR P- NPTVHVPP M- PDLDDDQT DVVYSPI HYN ATDNNLSSNG                46
SEQ_ID_NO_808    - MML GEPPHR T- NPTVHVPP M- PTLNNPTA E- FSPLTSN D- - - - - - DY             39
SEQ_ID_NO_805    - MML GE THR P- NPTVHVPP M- - - - - - - - A PEL FSPYTGN A- - - - - - DY        32

SEQ_ID_NO_799    - - - - - I SSYF GTAHVSPLDS PTAALMDFDS SL WEDPDLPA PVDAYSCDQF          71
SEQ_ID_NO_819    DEMTPY- VI A ALRDYLPAND VGVGA- DEEE EAAAMAA- - - AVDAYACDEF           77
SEQ_ID_NO_821    DEMTPY- VI A ALRDYLPAND VGVGA- DEEE EAAAMAA- - - AVDAYACDEF           77
SEQ_ID_NO_810    DDASPYALLA ALQHYLPSNE V- - AAFDEDD EEAALAAATA AVDAYACDEF           73
SEQ_ID_NO_816    DDASPYSLLV ALRHFLPSNE AAAAAYDEDD EL - - - - EALA AVDAYACDEF         74
SEQ_ID_NO_801    TNFNALDSLT SLHRYLPSNE PDP- - - TFED ELDL - - - - - - PVDAFSCDHF      82
SEQ_ID_NO_792    - - - SMMEALA ELQRYLPSNE PDP- - - DSDP DLSGPDS- - - PI DAYTCDHF      79
SEQ_ID_NO_794    NPFYLHEALS ALQRYLPSNG PDV- - - ELDS EFPGLDGPDS PVDAYSCDHF           93
SEQ_ID_NO_808    SQFYMQEALS AFQHYVNENN DS- - - - DSDS EI FPTHE- - - SVDSYSNDHF         82
SEQ_ID_NO_805    SPYSMQEALS ALQHYESTDA - - - - - - ESDS EVPSREP- EV PVDAYSCDHF         75

SEQ_ID_NO_799    RMYEFKVRSC ARGRSHDWTK CPYAHTGEKA RRRDPRKFNY SGAECPDLRH               121
SEQ_ID_NO_819    RMYEFKVRRC ARGRSHDWTE CPFAHPGEKA RRRDPRKYHY SGTACPDFRK               127
SEQ_ID_NO_821    RMYEFKVRRC ARGRSHDWTE CPFAHPGEKA RRRDPRKYHY SGTACPDFRK               127
SEQ_ID_NO_810    RMYEFKVRRC GRGRNHDWTA CPYAHPGEKA RRRDPRRYHY SGAACPDFRK               123
SEQ_ID_NO_816    RMYEFKVRRC GRGRSHDWTD CPYAHPGEKA RRRDPRRYHY SGTACPDYRK               124
SEQ_ID_NO_801    RMYEFKVKRC ARGRSHDWTE CPYAHPGEKA RRRDPRRYHY SGTACPEFRK               132
SEQ_ID_NO_792    RMYEFKVRRC ARGRSHDWTE CPYAHPGEKA RRRDPRKFHY SGTACPEFRK               129
SEQ_ID_NO_794    RMYEFKI RRC ARGRSHDWTE CPYAHPGEKA RRRDPRKYHY SGTACPDFRK              143
SEQ_ID_NO_808    RMFEFKI RRC ARGRSHDWTE CPFSHPGEKA RRRDPRKYNY SGTSCPDFRK              132
SEQ_ID_NO_805    RMFEFKVRRC ARCRSHDWTD CPYAHPGEKA RRRDPRKYHY SGTACPDFRK               125
```

Figure 25 (continued)

| | | | | | | | |
|---|---|---|---|---|---|---|---|
| SEQ_ID_NO_799 | GCCKKGDACE | YAHGTFELWL | HPDRYRTQPC | RDGTGCRRRV | CFFAHTSEQL | | 171 |
| SEQ_ID_NO_819 | GGCKRGDACE | YAHGVFECWL | HPARYRTQPC | KDGTACRRRV | CFFAHTPDQL | | 177 |
| SEQ_ID_NO_821 | GGCKRGDACE | YAHGVFECWL | HPARYRTQPC | KDGTACRRRV | CFFAHTPDQL | | 177 |
| SEQ_ID_NO_810 | GGCKRGDACE | LAHGVFECWL | HPSRYRTQPC | KDGTGCRRRV | CFFAHTPDQL | | 173 |
| SEQ_ID_NO_816 | GGCKRGDACE | FAHGVFECWL | HPSRYRTQPC | KDGTACRRRV | CFFAHTPDXL | | 174 |
| SEQ_ID_NO_801 | GGCKKGDACE | FAHGVFECWL | HPARYRTQPC | KDGPACRRRV | CFFAHTPEQL | | 182 |
| SEQ_ID_NO_792 | GCCKRGDACE | FSHGVFECWL | HPARYRTQPC | KDGGNCRRRV | CFFAHSPDQI | | 179 |
| SEQ_ID_NO_794 | GNCRKGDSCE | FAHGVFECWL | HPARYRTQPC | KDGSGCRRRV | CFFAHTPDQL | | 193 |
| SEQ_ID_NO_808 | GSCKKGDSCE | FAHGVFECWL | HPSRYRTQPC | KDGTSCRRPV | CFFAHTTEQL | | 182 |
| SEQ_ID_NO_805 | GSCKKGDACE | YAHGVFECWL | HPARYRTQPC | KDGTSCRRRV | CFFAHTPDQL | | 175 |

| | | | | | | | |
|---|---|---|---|---|---|---|---|
| SEQ_ID_NO_799 | RIPGKQSVR | SPRAREM--- | ---------- | ---------- | ---APAVSS | | 194 |
| SEQ_ID_NO_819 | RVLPAQQS- | SPRSVAS--S | PLAESYD-GS | PLRRQAFESY | LTKTI-MSSS | | 221 |
| SEQ_ID_NO_821 | RVLPAQQS- | SPRSVAS--S | PLAESYD-GS | PLRRQAFESY | LTKTI-MSSS | | 221 |
| SEQ_ID_NO_810 | RVPPPRQS- | SPRGAAAA-S | PLAESYD-GS | PLRRQAFESY | LTKSGIVSSP | | 219 |
| SEQ_ID_NO_816 | RVLPPQQSSA | SPRGAGAAPS | PLAESYD-GS | PLRRQAFESY | LTKTGIMSSS | | 223 |
| SEQ_ID_NO_801 | RLLPQQ--- | SPKGNGSGSG | LGGGEYDFGS | PVIHPFDSY | MTKAGIFVSS | | 227 |
| SEQ_ID_NO_792 | RVLPNQ--- | SPDR------ | --VDSFDVLS | PTIRRAFQ- | -----FSIS | | 209 |
| SEQ_ID_NO_794 | RLVSS----- | ---------- | --TDTYD-GS | PL-------- | CGKTLTFASS | | 216 |
| SEQ_ID_NO_808 | RAPTQQ--- | SPRSVPS--- | --VDSYD-GS | PLRLAFESS | CVKTLQFMSS | | 221 |
| SEQ_ID_NO_805 | RVLPQQ--- | SPRS------ | --ADSYD-GS | PLRHAESS | CAKSHPEVAS | | 211 |

| | | | | | | | |
|---|---|---|---|---|---|---|---|
| SEQ_ID_NO_799 | PTSLLSPSS | ------DSP | PLSPLSP--V | SGG------ | ESLSRLVALM | | 229 |
| SEQ_ID_NO_819 | PTSTLMSPPK | SPPS---ESP | PLSPDGAA-A | RRGSMPGVG | SPVNDYLASF | | 267 |
| SEQ_ID_NO_821 | PTSTLMSPPK | SPPS---ESP | PLSPDGAA-A | RRGSMPGVG | SPVNDYLASF | | 267 |
| SEQ_ID_NO_810 | PTSTLVSPPR | SPPS---ESP | PMSPDAAA-A | LRRGSMPGVG | SPVNEVLASM | | 265 |
| SEQ_ID_NO_816 | PTSTLVSPPR | SPPS---ESP | PMSPDAAAGA | LRRGSMPGVG | SPVNEVVASL | | 270 |
| SEQ_ID_NO_801 | PTSLLTSPPV | SPPS---DSP | PMSPGSP--Q | VGGSGPGSL | NSMSALLASM | | 272 |
| SEQ_ID_NO_792 | PSSN--SPPV | SPRG------ | --DSDSSCSL | SRSLGSNLG | ---NDVVASL | | 246 |
| SEQ_ID_NO_794 | PGSS--SPPV | SPRAESCSSP | PVSPMAQ--S | LSRSLGSASI | NEM---VTSL | | 259 |
| SEQ_ID_NO_808 | PGSV--SPPV | ------ESP | PMSPMTR--S | LGRSVGS--- | SSVNEMVASL | | 257 |
| SEQ_ID_NO_805 | PGSA--SSPV | ------ESP | PMSPMT--- | ---------- | VSVNEMVASL | | 238 |

Figure 25 (continued)

| SEQ_ID_NO_799 | HSLRLDELK ........... ........... ........... TNPGVSSF-- | 246 |
| SEQ_ID_NO_819 | RQLRLNKVK -SSPSGGWSY PSSS------ AVYGSPKAA- --TGLYSLPT | 306 |
| SEQ_ID_NO_821 | RQLRLNKVK -SSPSGGWSY PSSS------ AVYGSPKAA- --TGLYSLPT | 306 |
| SEQ_ID_NO_810 | RQLRLGGGS- PRSAPSGGSF LGGG------ YPFGSPKSP- ---AGLYSLPS | 305 |
| SEQ_ID_NO_816 | RQLRLGGGGS PRSAPSGGSF LVG------- YPFGSPKSP- --AALYSLPS | 310 |
| SEQ_ID_NO_801 | RGLQVGKAK- MGSPVGSWGV QSG------- FRFGSPRGSS LRPGFCSLPS | 314 |
| SEQ_ID_NO_792 | RNLQLNKVK -SSLSSSYNN QFGGYG---- SGFGSPRGSV LGPGFRSLPT | 290 |
| SEQ_ID_NO_794 | RNLQLGKGK ------SWKT QVGCCSPSSP SSFGSPRAAM RPGFCSLPS | 302 |
| SEQ_ID_NO_808 | RNLQLGTMK --SLPSSWNV QMGS------ PRFGSPRGPV RPGFCSLPS | 298 |
| SEQ_ID_NO_805 | RNLQLGKVK --SLPSSWNV -MGS------ SGFGSPRGPM RPGFFSLPT | 278 |

| SEQ_ID_NO_799 | SPNL------ -RRSSGAAF- -DLWDRG- -N EEEPAMERVE SGRNLRAQMY | 285 |
| SEQ_ID_NO_819 | TPLASTATVT TASSFMPNL- -EPLDLGL- G DEEPV-DRVE SGRALREKVF | 353 |
| SEQ_ID_NO_821 | TPLASTATVT TASSFMPNL- -EPLDLGL- G DEEPV-DRVE SGRALREKVF | 353 |
| SEQ_ID_NO_810 | TPTRPSPVTV TTASGATVLT VERLNLGL- G DEEPVMERVE SGRALREKVF | 355 |
| SEQ_ID_NO_816 | TPTRPAAVTV TTPSGATVMT VERLNLGL- G DEEPVMERVE SGRALREMVF | 360 |
| SEQ_ID_NO_801 | TPTR---TM ASRSGLSQL- -DI MGDGVTC EEEPAMERVE SGRDLRAKIY | 358 |
| SEQ_ID_NO_792 | TPTRP----- ------GFM -NI MENG- -L EEEPAMERVE SGRELRAQLF | 325 |
| SEQ_ID_NO_794 | TPTR---NL -TRPGISYP- -DSMDKA- -C EEEPVMERVE SGRDLRAKMF | 343 |
| SEQ_ID_NO_808 | TPTQ----V PSRGRVNHF- -DLMDQS- -C EEEPVMERVE SGRDIRVKMF | 339 |
| SEQ_ID_NO_805 | TPTQ----A PTRGGVNYF- -DDMDQS-CC EEEPVMERVE SGRSIRARMF | 320 |

| SEQ_ID_NO_799 | AKLMRENSVD RVRPMISA- ---------- GSLN----- ........... | 307 |
| SEQ_ID_NO_819 | ERLSRDGAIY GDATAFATAG -----VGLDV DWSDLIN- ........... | 386 |
| SEQ_ID_NO_821 | ERLSRDGAIS GDATAFATAG -----VGLDV DWSDLIN- ........... | 386 |
| SEQ_ID_NO_810 | ERLSKEATYP SDTAASANVE GAA--PAPDV GWSDLIN- ........... | 391 |
| SEQ_ID_NO_816 | ERLSKEATYP NDAAASANAE GAAPAAAPDV GWSDLIN- ........... | 398 |
| SEQ_ID_NO_801 | AKLSKENSVD RDRGDSGVSS ------PDV GWSELVK-- ........... | 389 |
| SEQ_ID_NO_792 | EKLSKENDMG RIEPDPDQGA G----DTPDV GWSDLVM-- ........... | 359 |
| SEQ_ID_NO_794 | EKLSKENSLE RVNPDQSSGG ------PDL NWSDLGKQA MGIIVMVDIV | 386 |
| SEQ_ID_NO_808 | EKLSKENSFN GSGMGSGSGL GEVV-EDPDV GWSELVSPF LGD------ | 381 |
| SEQ_ID_NO_805 | EKLSKENHLD GSGSGSSQIG ------VPDV GWSELVSR- ........... | 353 |

Figure 25 (continued)

| | | |
|---|---|---|
| SEQ_ID_NO_799 | - - - - - - | 307 |
| SEQ_ID_NO_819 | - - - - - - | 386 |
| SEQ_ID_NO_821 | - - - - - - | 386 |
| SEQ_ID_NO_810 | - - - - - - | 391 |
| SEQ_ID_NO_816 | - - - - - - | 398 |
| SEQ_ID_NO_801 | - - - - - - | 389 |
| SEQ_ID_NO_792 | - - - - - - | 359 |
| SEQ_ID_NO_794 | LFIKYF | 392 |
| SEQ_ID_NO_808 | - - - - - - | 381 |
| SEQ_ID_NO_805 | - - - - - - | 353 |

Figure 26

```
SEQ_ID_NO_1709        MA PPLSSWP  MASLG KYF  LGPLVWKVA  QEWAE -QGG AP -LGSRWL       45
SEQ_ID_NO_826         MA APLSSWP  MTSLGDYKYA LLGPLAMKVV QEWREDQGR LP VLGSWWL       49
SEQ_ID_NO_1713        MA PPLSSWP  MASLGQYKYV LGRLVWKVV  QEWRE -QGG LP -LGSWWL       45
SEQ_ID_NO_824         MAPPPLSSWP  MASLGQYKYV LLGPLVWKVL QEWRE -QAG LP -LGSWWL       48

SEQ_ID_NO_1709        HLLLLFSARG LTYQFWFSYS HMLFL RRRR VVPDGVDFRQ VDHEWDW- -      92
SEQ_ID_NO_826         HLLLLFAVRG LTYQFWFTYG HMLFFTRRRR VVADGVDFRQ DAEWDW- -      96
SEQ_ID_NO_1713        HLLVLFAVRG LTYQFWFTYG HMLFFTRRRR VVADGVDFRQ DAEWDW- -      92
SEQ_ID_NO_824         HLLLLFAARG LTYQFWFSYG HMLFFTRRRR VVADGVDFRQ DAEWDWKKI      98

SEQ_ID_NO_1709        .......... .......... .......... ..........    92
SEQ_ID_NO_826         .......... .......... .......... ..........    96
SEQ_ID_NO_1713        .......... .......... .......... ..........    92
SEQ_ID_NO_824         LWI PPPNNQP WSPSDTGNAQ AHLAGI GRLF FLRLVPAFG    135
```

Figure 27

| | | | | | | |
|---|---|---|---|---|---|---|
| SEQ_ID_NO_828 | ---MGRKP-- | DAVAKSYHSG | GGGAAASS-- | ---------- | --PRAARKAS | 31 |
| SEQ_ID_NO_845 | ---MGRKP-- | DPSKPHY--- | GGGAS----- | ---------- | --PRAARRTQ | 25 |
| SEQ_ID_NO_847 | ---MGRKP-- | DPSKPHY--- | GGGAS----- | ---------- | --PRAARRTQ | 25 |
| SEQ_ID_NO_832 | -MLSLLSE-- | KPNLALYNQS | NGKHYQYHQN | IYNDWRWWRS | SATQQHRRKV | 47 |
| SEQ_ID_NO_837 | --MGVVAEVW | RSSVRLLTNS | PQLNGGSHKS | ALWKWRFF-- | ---SAQPKRTV | 44 |
| SEQ_ID_NO_840 | --MKRRKQ-- | RSHEKLFLVL | QIILHTLIF- | ---------- | --KRRRRIHH | 33 |
| SEQ_ID_NO_842 | ---MVLPR-- | RRGGHNHH-- | ---------- | ---------- | --PCPRRAVL | 21 |
| SEQ_ID_NO_844 | ---MGSRR-- | RRHHHHHG-- | ---------- | ---------- | --PMLVPAVA | 21 |
| SEQ_ID_NO_839 | MFMAPRRGLL | DGGEDRYGLM | SFGTKDI--- | ---------- | --FTMRRKIR | 35 |
| SEQ_ID_NO_850 | ---MSEAEKF | IYHRKLMEVK | GISVGESKAE | KLRSY----- | --LVSRSRMK | 40 |

| | | | | | | |
|---|---|---|---|---|---|---|
| SEQ_ID_NO_828 | PSP------- | VFLGTALFVL | GFVSLFTGHV | VTDADW---- | ARIRSRWRPK | 70 |
| SEQ_ID_NO_845 | PSP------- | VFLGTALFVL | GFVSLFTGHI | VTDADW---- | SRIRSRWRSK | 64 |
| SEQ_ID_NO_847 | PSP------- | VFLGTALFVL | GFVSLFTGHI | VTDADW---- | SRIRSRWRSK | 64 |
| SEQ_ID_NO_832 | PWS------- | LVCGLMLFGL | GLVSLFTGHV | ASDLEW---- | YSQRLVKRSL | 66 |
| SEQ_ID_NO_837 | MWT------- | WVCGFMLFSL | GVLSLFTGHV | VSHLEW---- | YSQQLSKRSL | 83 |
| SEQ_ID_NO_840 | LLP------- | LKAALTGGIL | FFFVLFSPPI | TSQHH----- | HLLNPIWFNN | 71 |
| SEQ_ID_NO_842 | PAA------- | ALLLL--FLL | AAVTLLYVSP | PPLSDHPALA | YSRRRSPHAL | 62 |
| SEQ_ID_NO_844 | PAA------- | AAFAAAGLLL | VVWAFHCFLS | PPLGDGGGGA | RVVRRPNPPF | 64 |
| SEQ_ID_NO_839 | YWQKQFKQRH | LFGGLMVLLL | MCVITKFILW | NMFSDQ---- | LDLDTAIPSN | 81 |
| SEQ_ID_NO_850 | LWM------- | IRAVTILLLW | SCVV----HL | MALGEFWG-- | PRLLKGWPSC | 77 |

| | | | | | | |
|---|---|---|---|---|---|---|
| SEQ_ID_NO_828 | -----QHRNY | EP-------- | ---------D | WESKYSSMY | YGCSERSASF | 99 |
| SEQ_ID_NO_845 | -----QVRNN | EP-------- | ---------N | WKSRYSNLY | YGCSRRSVNF | 93 |
| SEQ_ID_NO_847 | -----QVRNN | EP-------- | ---------N | WKSRYSNLY | YGCSRRSVNF | 93 |
| SEQ_ID_NO_832 | FYSRLEGRRR | EA-------- | ---------D | WKSKYSNLF | YGCSERGRNF | 120 |
| SEQ_ID_NO_837 | ----LDMSRR | EP-------- | ---------D | VWKSKYSKFF | YGCSERGRNF | 113 |
| SEQ_ID_NO_840 | GTELQMNLQK | EH----VFRV | PMGGGSLSGD | WTSKQSLLY | HGCSNSSYKF | 117 |
| SEQ_ID_NO_842 | LNSSGGGSLV | EPGRREISRV | PKGGWSATDG | LWGSKLASKF | YGCSNSSSKF | 112 |
| SEQ_ID_NO_844 | LLKKPAEVAR | SVIGAVDFTV | PSGGSKHGQE | LWESKATGNF | FGCSNATKHF | 114 |
| SEQ_ID_NO_839 | VVQDEPSPNN | WP-------- | -------TLE | LWKHPNSDNY | FNCMGRAK-- | 114 |
| SEQ_ID_NO_850 | ---------- | ---------- | -------FN | HHDLPVAAET | ASLPMKA-- | 97 |

Figure 27 (continued)

| | | | | | | | |
|---|---|---|---|---|---|---|---|
| SEQ_ID_NO_828 | RSAVPENSST | GYLLIATSGG | LNQQRIGITD | AVVVAMLNA | TLVVPELDHH | 149 |
| SEQ_ID_NO_845 | RSAVPENSST | GYLLIGTSGG | LNQQRIGITD | AVVVARILNA | TLVVPELDHH | 143 |
| SEQ_ID_NO_847 | RSAVPENSST | GYLLIGTSGG | LNQQRLGITD | AVVVARILNA | TLVVPELDHH | 143 |
| SEQ_ID_NO_832 | PPAVRERASN | GYLLIAASGG | LNQQRTGITD | AVVVARILNA | TLVVPELDHH | 170 |
| SEQ_ID_NO_837 | LPAVQEQSSN | GYLLIAASGG | LNQQRTGITD | AVVVARILNA | TLVVPELDHH | 163 |
| SEQ_ID_NO_840 | PSADVNTHPN | RYLMIATSGG | LNQQRTGIVD | AVVAAHILNA | VLVVPKLDQK | 167 |
| SEQ_ID_NO_842 | LDSGVMTHPD | RYLMIVTSGG | LNQQRTGIID | AVVAARILNA | TLVVPKLDQT | 162 |
| SEQ_ID_NO_844 | AOAKAVTKLD | RYLMIATSGG | LNQQRTGIID | AVVAARILNA | TLVIPKLDEE | 164 |
| SEQ_ID_NO_839 | KDIRQGNNTN | GYLLVHANGC | LNQMKTGISD | MVAIAKIMNA | TLVFPTLDHN | 164 |
| SEQ_ID_NO_850 | LPPKRVYKNN | GYLMVSCNGC | LNQMRAACD | MVTLARYMNV | TLIVPELDKT | 147 |

| | | | | | | | |
|---|---|---|---|---|---|---|---|
| SEQ_ID_NO_828 | SFWKDDSDFS | DIFDVEWFIS | HLSKDVTIVK | RIPYEVMLSM | DKLPWTMRAP | 199 |
| SEQ_ID_NO_845 | SFWKDDSDFS | DIFDVDWFIS | YLSKDVTIVK | RIPYEVMMSM | DKLPWTMRAP | 193 |
| SEQ_ID_NO_847 | SFWKDDSDFS | DIFDVDWFIS | YLSKDVTIVK | RIPYEVMMSM | DKLPWTMRAP | 193 |
| SEQ_ID_NO_832 | SYWKDDSDFV | NIFDVDWFIS | YLAKDVTIVK | RVPDKVMRSM | EKPPYTMRVP | 220 |
| SEQ_ID_NO_837 | SYWKDDSDFS | DIFDVNWFIS | SLAKDVTIVK | RVPDRVMRAM | EKPPYTTRVP | 213 |
| SEQ_ID_NO_840 | SYWKDSSNFS | EIFDVDRFIS | HLSKDVKIIR | DIPR--IGDK | VITPYTTRVP | 215 |
| SEQ_ID_NO_842 | SFWKDASDFA | EIFNADWFIS | FLSKDVRIVK | ELPK--IGGK | LWAPHRMRVP | 210 |
| SEQ_ID_NO_844 | SFWNDASDFA | QIFDVDSFIY | SLSNDVKVIR | QLPD--MNGK | KLSPYKMRIP | 212 |
| SEQ_ID_NO_839 | SFWTDPSDFK | EIFNMKNFVE | VLNEDVCVVE | SLPPELAAIK | P----ALKAP | 210 |
| SEQ_ID_NO_850 | SFWSDPSEFD | DIFDVDHFIT | SLRDEVRILK | ELPPRLKRRF | ELGMYYSFPP | 197 |

| | | | | | | | |
|---|---|---|---|---|---|---|---|
| SEQ_ID_NO_828 | RK-SVPEFYI | DEVLPILMRR | RALQLTKFDY | RLTSD-LDED | LQKLRCRVNF | 247 |
| SEQ_ID_NO_845 | RK-SMPDFYI | DEVLPILMRR | RALQLTKFDY | RLTNE-LDEE | LQKLRCRVNF | 241 |
| SEQ_ID_NO_847 | RK-SMPDFYI | DEVLPILMRR | RALQLTKFDY | RLTNE-LDEE | LQKLRCRVNF | 241 |
| SEQ_ID_NO_832 | RK-SPPEYYL | DQVLPILLRR | RVVQLTKFDY | RLASN-LDEE | LQKLRCRANY | 268 |
| SEQ_ID_NO_837 | RK-STLEYYL | DQVLPILTRR | HVLQLTKFDY | RLAND-LDED | MQKLRCRVNY | 261 |
| SEQ_ID_NO_840 | RK-CNAKCYQ | TRILPILKKK | HAVQLTKFDY | RLSNR-LDID | MQKLRCRVNF | 263 |
| SEQ_ID_NO_842 | RK-CTQRCYL | NRVLPALVKK | HVVRLTKFDY | RLANR-LDSD | LQKLRCRVNY | 258 |
| SEQ_ID_NO_844 | RK-CTPKCYE | NRVLPALLKK | HVVQLTKFDY | RVSNR-LETD | LQKLRCRVNY | 260 |
| SEQ_ID_NO_839 | VSWSKASYYR | TDMLQLLKKH | KVIKFTHTDS | RLVNNGLASS | IQRVRCRAMV | 260 |
| SEQ_ID_NO_850 | ISWSDISYYB | NQILPLVKKY | KVVHLNKTDT | RLANNGLSLD | IQKLRCRVNF | 247 |

Figure 27 (continued)

| | | | | | | |
|---|---|---|---|---|---|---|
| SEQ_ID_NO_828 | HALKFTSSH | AMGQKLVQKL | RLMNTRYVAI | HLRFEPDMLA | FSGCYYGGGE | 297 |
| SEQ_ID_NO_845 | HALRFTNSI Q | TLGEKLVRKL | RSMSSRYVAV | HLRFEPDMLA | FSGCYYGGGD | 291 |
| SEQ_ID_NO_847 | HALRFTNSI Q | TLGEKLVRKL | RSMSSRYVAV | HLRFEPDMLA | FSGCYYGGGD | 291 |
| SEQ_ID_NO_832 | HALRFTKPI Q | EIGERLVTKM | RKMAKRYI AI | HLRFEPDMLA | FSGCYFGGGE | 318 |
| SEQ_ID_NO_837 | HALRFTKRI Q | SVGMKVYKRM | RKMAKRFI AV | HLRFEPDMLA | FSGCDFGGGE | 311 |
| SEQ_ID_NO_840 | HALKFTDPI I | EMGRKLVERI | RMKSKHFVAL | HLRFEPDMLA | FSGCYYGGGD | 313 |
| SEQ_ID_NO_842 | HALRFTDPI Q | EMGEKI I QRV | RERSTYFI AL | HLRFEPDMLA | FSGCYYGGGE | 308 |
| SEQ_ID_NO_844 | HALQFTDPI L | RMGELLVQRM | KEKSGRFI AL | HLRFEPDMLA | FSGCYYGGGD | 310 |
| SEQ_ID_NO_839 | EALRFAVPI E | ELGKKLVNRL | RENNTPYI AL | HLRYEKDMLA | FTGCSHNLTK | 310 |
| SEQ_ID_NO_850 | NALRFTPQ E | ELGRRVVRI L | REK- GPFLVL | HLRYEMDMLA | FSGCSHGCNP | 296 |

| | | | | | | |
|---|---|---|---|---|---|---|
| SEQ_ID_NO_828 | KERKELGEI R | ---KRWDTLP | ELSAEDERSR | GKCPLTPHEV | GLMLRALGFG | 344 |
| SEQ_ID_NO_845 | KERRELGEI R | ---KRWDTLP | ELSAEDERSR | GKCPLTPQEI | GLMLRALGFS | 338 |
| SEQ_ID_NO_847 | KERRELGEI R | ---KRWDTLP | ELSAEDERSR | GKCPLTPQEI | GLMLRALGFS | 338 |
| SEQ_ID_NO_832 | KERFELGEI R | ---KRWATLP | DLSPDSERER | GKCPLTPHEV | GLMLRALGFA | 365 |
| SEQ_ID_NO_837 | KERAELAEI R | ---KRWDTLP | DLDPLEERKR | GKCPLTPHEV | GLMLRALGFT | 358 |
| SEQ_ID_NO_840 | KETKELGKI R | ---KRWKTLH | ATNPDKERRH | GKCPLTPEEI | GLMLRALGFG | 360 |
| SEQ_ID_NO_842 | KEKRELGVI R | ---KRWKTLH | ASNPEKERRH | GRCPLTPEEV | GLMLRALGYR | 355 |
| SEQ_ID_NO_844 | IERRELGEI R | ---KRWKTLH | ASNPDRERRH | GKCPLTPEEV | GLMLRALGFG | 357 |
| SEQ_ID_NO_839 | EETQELKKMR | YSVKHWKE-K | EI DSKSKRLK | GSCPMTPREV | AVFLEALGYP | 359 |
| SEQ_ID_NO_850 | DEEEELTRMR | YAYPWAKE-K | VI NSELKRKD | GLCPLTPEET | ALALNALGD | 345 |

| | | | | | | |
|---|---|---|---|---|---|---|
| SEQ_ID_NO_828 | NDTLLYVASG | EI YGGDSTLQ | PLRGLFPNFY | TKEKLAG-DD | LNPFLPFSSR | 393 |
| SEQ_ID_NO_845 | NDTYLYVASG | EI YGGEETLQ | PLRDLFPNYY | TKEMLAG-ND | LKLFLPFSSR | 387 |
| SEQ_ID_NO_847 | NDTYLYVASG | EI YGGEETLQ | PLRDLFPNYY | TKEMLAG-ND | LKPFLPFSSR | 387 |
| SEQ_ID_NO_832 | NDTYLYVASG | EI YGGEETLR | PLRELFPNFY | TKEMLAL-EE | LKSFFPFSSR | 414 |
| SEQ_ID_NO_837 | NDTYI YVASG | EI YGGEKTLK | PLRELFPNFY | TKEMLAN-DE | LKPLLPYSSR | 407 |
| SEQ_ID_NO_840 | NDVHI YVASG | EI YGGEETLA | PLKALFPNFY | SKETI ASKEE | LAPFSSFSSR | 410 |
| SEQ_ID_NO_842 | KNVHI YVASG | DI YGGAKTLA | PLKALFPNLH | TKETVTSKDE | LAPFSKYSSR | 405 |
| SEQ_ID_NO_844 | KDVHLYVASG | DVYGGEETLA | PLKALFPNFH | SKETLASKEE | LAPFLPYSSR | 407 |
| SEQ_ID_NO_839 | VDTKI YVAAG | VI YGSEG-MK | PLQKKFPNLL | WHSSLATKEE | LQPFEGHLNQ | 408 |
| SEQ_ID_NO_850 | RNVQI YI AAG | EI YGGERRMK | ALAEAFPNVV | RKETLLEPSD | LKFFQNHSSQ | 395 |

Figure 27 (continued)

```
SEQ_ID_NO_828    LAAIDFIVCD ESDVFVTNNN GNMAKVLAGR RRYMGHKRTI RPNAKKLNVL    443
SEQ_ID_NO_845    LAAIDFIVCD GSDVFVTNNN GNMAKVLAGR RRYMGHKRTI RPNAKKLNLL    437
SEQ_ID_NO_847    LAAIDFIVCD GSDVFVTNNN GNMAKVLAGR RRYMGHKRTI RPNAKKLNLL    437
SEQ_ID_NO_832    MAAIDYIVCD ESDVFVTNNN GNMAKILAGR RRYAGHKRTI RPNAKKLSAL    464
SEQ_ID_NO_837    LAAIDYIVSD ESDVFITNNN GNMAKILAGR RRYMGHKRTI RPNAKKLSAL    457
SEQ_ID_NO_840    MAALDFMVCD ESDVFVSNNN GNMARMLAGR RRYFGHKPTI RPNAKKLYKL    460
SEQ_ID_NO_842    MAALDFIVCD GSDAFVTNNN GNMAKILAGR RRYLGHKRTI RPNARKLYSL    455
SEQ_ID_NO_844    MAALDFIVCD RSDVFVTNNN GNMARMLAGR RRYFSHRRTI RPNAKKLYSL    457
SEQ_ID_NO_839    LAALDYYITV ESDVFVYSYD GNMAKAARGH RKFDGFKKTI SPDKDRFVRL    458
SEQ_ID_NO_850    MAALDYLVSL ESDIFVPTYD GNMAKVVEGH RRFLGFKKTI LLDRKLLVNL    445

SEQ_ID_NO_828    FQTRNQ-LS WDTFSRKVQR VQRGLMGEPD DI----RPK QDD-FHEFP-    484
SEQ_ID_NO_845    FKRRKQ-MG WDIFSQKVKK VQRGLMGEPD DI----RPG RDD-FNEFP-    478
SEQ_ID_NO_847    FKRRKQ-MG WDIFSQKVKK VQRGLMGEPD DI----RPG RDD-FNEFP-    478
SEQ_ID_NO_832    FKARDR-MD WDTFAKKVKA SQRGFMGEPD EV----RPG RGD-FHEYP-    505
SEQ_ID_NO_837    FMDREK-ME WQTFAKKVKS CQRGFMGDPD EF----KPG RGE-FHEYP-    498
SEQ_ID_NO_840    FLSRNN--MT WEEFASQVRT SQIGFMGEPN EV----KPG RGE-FHENP-    501
SEQ_ID_NO_842    FLSRGN--MS WDAFSSKVHM AQKGFMGEPK EL----RPG RGE-FHENP-    496
SEQ_ID_NO_844    FLNRTS--MS WDTFASKVLT FQKGFMGEPN EI----KPG RGE-FHEHP-    498
SEQ_ID_NO_839    IDQLDNGLIS WNDFSTKVKS HAKKKGAPQ AR-KIHRHPK FEE-TFYANPF    507
SEQ_ID_NO_850    IDQYTEGLLS WDEFSSFVKE VHEDRMGSPK KRLVIPDKPK EEDYFYANPF    494

SEQ_ID_NO_828    SSCICSRK-- ---------- ---------- ---------- ----------    492
SEQ_ID_NO_845    SSCICQR--- ---------- ---------- ---------- ----------    486
SEQ_ID_NO_847    SSCICQR--- ---------- ---------- ---------- ----------    486
SEQ_ID_NO_832    -SCICEKPFT DDENRKGEDL LSDRIHMNLK ENVDSKYVGE NQGDKSLQRL    554
SEQ_ID_NO_837    QSCICQRP-- ---------- ---------- ---------- ------FSYD    510
SEQ_ID_NO_840    SACICADS-- ---------- ---------- ---------- ----------    509
SEQ_ID_NO_842    TTCICENT-- --------D PKTPTKPNPR SEQGLINGTE GRKAITEPTV    535
SEQ_ID_NO_844    MDCICAKA-- ---------- ---------- -NGKIGQSRH HQIKRAGKGA    525
SEQ_ID_NO_839    PGCICQK--- ---------- ---------- ---------- ----------    514
SEQ_ID_NO_850    HECLQLL--- ---------- ---------- ---------- ----------    501
```

Figure 27 (continued)

| | | |
|---|---|---|
| SEQ_ID_NO_828 | .......... .......... .......... .......... .......... | 492 |
| SEQ_ID_NO_845 | .......... .......... .......... .......... .......... | 486 |
| SEQ_ID_NO_847 | .......... .......... .......... .......... .......... | 486 |
| SEQ_ID_NO_832 | KKRSIEEPIS LRENKDVTVI GSANELGLCT GDRYVKVNGT CLVASTKSDL | 604 |
| SEQ_ID_NO_837 | KTSTDDEEED MSEENHNSTS PGHVHLSS-- .......... .......... | 538 |
| SEQ_ID_NO_840 | DANDREDASL FGTHSIISEI DTGSSTNSAR RDMVEVTDGQ ASEEEQEWS- | 558 |
| SEQ_ID_NO_842 | ANHTNEELVG SSAEEDDASV EKEDDTSAEK EDDTSEEKEE IADPEAEDDA | 585 |
| SEQ_ID_NO_844 | ENHSSDGDLD WRDLDYGEHT PLGRDSSNES ESDDIRVGGS .......... | 565 |
| SEQ_ID_NO_839 | .......... .......... .......... .......... .......... | 514 |
| SEQ_ID_NO_850 | .......... .......... .......... .......... .......... | 501 |

| | | |
|---|---|---|
| SEQ_ID_NO_828 | --------PG NISATT---- . | 500 |
| SEQ_ID_NO_845 | --------PV NRSVTARAEN L | 499 |
| SEQ_ID_NO_847 | --------PV NRSVTARAEN L | 499 |
| SEQ_ID_NO_832 | LCHHVLSFST PFLDETGSGM L | 625 |
| SEQ_ID_NO_837 | --------AD NERDEVFPD- - | 549 |
| SEQ_ID_NO_840 | --------DT EYMETELEI- - | 569 |
| SEQ_ID_NO_842 | LVRP----DD PELEEVLSD- - | 600 |
| SEQ_ID_NO_844 | --------DI PELEDMMSD- - | 576 |
| SEQ_ID_NO_839 | --------PT HLMAETNHES L | 527 |
| SEQ_ID_NO_850 | --------DE PLRTTRLSMF L | 514 |

Figure 28

| | | | | | | | | |
|---|---|---|---|---|---|---|---|---|
| SEQ_ID_NO_876 | ----MGPVVL | TQLATGLSML | AGAALVKSVM | DQN--TMMGP | GSD---RF-- | | | 39 |
| SEQ_ID_NO_855 | ----MSPIVI | TQLATGISVL | AGAVFIKSVM | DQK-----P | MAG---QF-- | | | 35 |
| SEQ_ID_NO_862 | ----MGPIVL | TQLATGLSVL | AGAVLVKSVM | DQK-----P | MAG------ | | | 33 |
| SEQ_ID_NO_858 | ----MVPIVL | TQMATGLGVL | AGAVFVKSVM | DQK-----P | MAG---PF-- | | | 35 |
| SEQ_ID_NO_856 | ----MFPAVL | TQVATGLSVL | AGAVLVKSVM | DQK-----P | MAG---PF-- | | | 35 |
| SEQ_ID_NO_885 | MVVVVAPIAV | A--SAGLGML | AGVAMASRSS | NSSSSSGRTS | SPAALLRWGA | | | 48 |
| SEQ_ID_NO_868 | ---MVSPVVI | A--SAGLGML | AGVALASRGT | GDG-----LP | ASS---RWDA | | | 37 |
| SEQ_ID_NO_886 | ---MVSPIVI | A--SAGLGML | AGVAMANRTM | GGGGDGRQLP | AAS---RWDA | | | 42 |
| SEQ_ID_NO_870 | ---MVAPVVI | A--SAGLGML | AGVAMANRSL | GNG-----LP | AAS---RWDA | | | 37 |
| SEQ_ID_NO_878 | ---MVAPVVI | T--SAGLGML | AGLAMANRSL | GDG-----LP | AAS---RWDA | | | 37 |

| | | | | | | | | |
|---|---|---|---|---|---|---|---|---|
| SEQ_ID_NO_876 | ----PRCSRC | NGTGRVSC-L | CNRWSD--GD | -RGCRTCAGS | GRMVCSSCGG | | | 81 |
| SEQ_ID_NO_855 | ----PRCPTC | NGTGRVTC-F | CSRWSD--GD | -VGCRRCSGS | GRAACSNCGG | | | 77 |
| SEQ_ID_NO_862 | ----PLCPSC | NGTGRVAC-L | CSRWSD--GD | -AGCRACSGS | GRMACSSCGG | | | 75 |
| SEQ_ID_NO_858 | ----QRCPTC | NGTGRVSC-L | CSRWSD--GD | -VGCRTCSGS | GRRACSSCGG | | | 77 |
| SEQ_ID_NO_856 | ----QRCPTC | NGTGRITC-L | CTRWSD--GD | -IGCRTCAGS | GRMACSSCGG | | | 77 |
| SEQ_ID_NO_885 | PEPAPRCAAC | GGTGREECRL | CARWSDARGD | CSGCRACAGT | RRAPCRSCGG | | | 98 |
| SEQ_ID_NO_868 | R---PRCSTC | SGTGREEC-L | CSRWSD--GD | -VGCGTCSGS | GRKRCRSCGG | | | 80 |
| SEQ_ID_NO_886 | R---PRCATC | GGSGRVDC-L | CNRWSD--GD | -SGCRTCAGS | GRMPCRSCGG | | | 85 |
| SEQ_ID_NO_870 | R---PRCATC | GGSGRVEC-L | CNRWSD--GD | -SGCRTCAGS | GRMPCRSCGG | | | 80 |
| SEQ_ID_NO_878 | R---PRCATC | GGSGRVEC-L | CNRWSD--GD | -SGCRTCAGS | GRMPCRSCGG | | | 80 |

| | | | | | | |
|---|---|---|---|---|---|---|
| SEQ_ID_NO_876 | TGTGRPLPVQ | SVR------ | ---PPNQS-- | ---Y- | | 101 |
| SEQ_ID_NO_855 | SGTGRPLPAQ | TVQ------ | ---PPNRP-- | ---Y- | | 97 |
| SEQ_ID_NO_862 | TGTGRPIPVQ | SMR------ | ---SPNRP-- | ---PS | | 96 |
| SEQ_ID_NO_858 | SGTGRPIPVQ | LIVR------ | ---QPTNR-- | ---SF | | 98 |
| SEQ_ID_NO_856 | SGTGRPIPVQ | SVR------ | ---QPTNR-- | ---NS | | 98 |
| SEQ_ID_NO_885 | SGTGRRAPVR | VSSS------ | ---APPSR-- | ----- | | 117 |
| SEQ_ID_NO_868 | SGTGRPLPAR | LIVQ------ | EQKLPTAPGR | RGDYN | | 109 |
| SEQ_ID_NO_886 | SGTGRPLPAR | LLARGHHHHH | NPPPSSAPGR | GGDYS | | 120 |
| SEQ_ID_NO_870 | SGTGRPLPAR | LTVQ---HQ | KPPPPPPG- | ---YN | | 107 |
| SEQ_ID_NO_878 | SGTGRPLPAR | LTVQ---HH | K--PPPPAG- | ---YN | | 105 |

Figure 29

| | | | | | | |
|---|---|---|---|---|---|---|
| SEQ_ID_NO_907 | -----MAV- | --------D | SMHVVMFPFL | AFGHISPFVQ | LARKLVAAG- | 33 |
| SEQ_ID_NO_912 | ---MAAAVVE | AD-----DE | AMHVALFPFL | AFGHISPFAQ | LARSLGAVG- | 40 |
| SEQ_ID_NO_911 | MGSAGAAPVA | TAAGGGGGDG | DLHVVMFPFL | AFGHISPFAQ | LARKMAGVGA | 50 |
| SEQ_ID_NO_898 | ----MPSELA | MN-----ND | ELHVVMFPFL | AFGHISPFVQ | LSNKLFSH-- | 38 |
| SEQ_ID_NO_913 | ------MSLK | GN-----DK | ELHLVMFPFF | AFGHITPFVQ | LSNKISSLYP | 38 |
| SEQ_ID_NO_901 | ----MENEMK | HS-----ND | ALHVVMFPFF | AFGHISPFVQ | LANKLSSY-- | 38 |
| SEQ_ID_NO_915 | ----MENE-- | --------K | VLHVVMFPFF | AFGHISPFAQ | LANKLSSH-- | 33 |
| SEQ_ID_NO_904 | ---MGSQA-- | --------T | THHMAMYPWF | GVGHLTAFFR | LANKLASK-- | 34 |
| SEQ_ID_NO_905 | ---MGSQA-- | --------T | TYHMAMYPWF | GVGHLTGFFR | LANKLAGK-- | 34 |
| SEQ_ID_NO_908 | ---MGSQA-- | --------T | TYHMAMYPWF | GVGHLTGFFR | LANKLAGK-- | 34 |
| SEQ_ID_NO_891 | ------ME-- | --------P | TFHAFMFPWF | AFGHMIPFLH | LANKLAEK-- | 31 |
| SEQ_ID_NO_893 | MSDLISKR-- | --------S | SFRILMFPWF | AVGHLTPFLH | LSNKLAEK-- | 37 |

| | | | | | | |
|---|---|---|---|---|---|---|
| SEQ_ID_NO_907 | GVRVTLLSAA | ANVPRVEAML | GPAAGAV--A | VAPLRLQRVP | GLPEGAESTA | 81 |
| SEQ_ID_NO_912 | GVRVTFLSAA | ANVARVEAML | PADGTAV--- | VAALHLPRVP | GLPVGAESTA | 87 |
| SEQ_ID_NO_911 | GVRVTFLSAA | ANVPRVEAML | GGTGGTS--T | VAALELPRVP | GLPEGAESTA | 98 |
| SEQ_ID_NO_898 | GVHVTFLSAA | SNIPRIRST | NLNPAIN--- | VISLKFPN-- | ----GITNTA | 79 |
| SEQ_ID_NO_913 | GVKITFLAAS | ASVSRIETML | NPSTNTK--- | VIPLTLPRVD | GLPEGVENTA | 85 |
| SEQ_ID_NO_901 | GVKVSFFTAS | GNASRVKSML | NSAPTTH--- | VPLTLPHVE | GLPPGAESTA | 85 |
| SEQ_ID_NO_915 | GVKVSFFTAS | GNASRLRSML | NSAPTTTHID | VPLTLPHVE | GLPPGSESTA | 83 |
| SEQ_ID_NO_904 | GHRISFLIPK | NTQSKLASIF | NLHPHLV--S | FVPITVPSIP | GLPPGAETTS | 81 |
| SEQ_ID_NO_905 | GHRISFLIPK | NTQSKLESIF | NLHPHLI--S | FVPIVVPSIP | GLPPGAETTS | 81 |
| SEQ_ID_NO_908 | GHRISFLIPK | NTQSKLESIF | NLHPHLI--S | FVPIVVPSIP | GLPPGAETTS | 81 |
| SEQ_ID_NO_891 | GHQITFLLPK | KAQKQLEH-H | NLFPDSI--V | FHPLTIPHVN | GLPAGAETTS | 78 |
| SEQ_ID_NO_893 | GCTISFLIPN | KAIKLLQH-F | NLYPDHI--T | FHPVKVPHVE | GLPLGTETAS | 84 |

| | | | | | | |
|---|---|---|---|---|---|---|
| SEQ_ID_NO_907 | EVSADGAELL | KVAVDGTRPQ | VAALLAELRP | DALLFDFATP | WTELAAPLR | 131 |
| SEQ_ID_NO_912 | EVDADGAELL | KLALDGTRPQ | VEALLARLRP | DVVLFDFATP | WADVARQLG | 137 |
| SEQ_ID_NO_911 | EVSADGAELL | KLAVDGTRPQ | VEALLARLRP | DVVLFDFATP | WVDVARPLG | 148 |
| SEQ_ID_NO_898 | ELPPHLAGNL | IHALDLTQDD | VKSLLLELKP | HYWFFDFAQH | MLPKLASEVG | 129 |
| SEQ_ID_NO_913 | DASPATIGLL | VVAIDLMQPQ | IKTLLANLKP | DFVIFDFVHW | MLPEIASELG | 135 |
| SEQ_ID_NO_901 | ELTPASAELL | KVALDLMQPQ | KTLLSHLKP | HFVLFDFAQE | MLPKMANGLG | 135 |
| SEQ_ID_NO_915 | ELTPVTAFLL | KVALDLMQPQ | KTLLSHLKP | HFVLFDFAQE | MLPKMADELG | 133 |
| SEQ_ID_NO_904 | DVPFSSTHLL | MEAMDKTQTD | EIILKNLEV | DVVFFDFTH- | MLPGLARKIG | 130 |
| SEQ_ID_NO_905 | DVPFPSTHLL | MEAMDKTQND | EIILKDLKV | DVVFYDFTH- | MLPSLARKIG | 130 |
| SEQ_ID_NO_908 | DVPFPSTHLL | MEAMDKTQND | EIILKDLKV | DVVFYDFTH- | MLPSLARKIG | 130 |
| SEQ_ID_NO_891 | DISISMDNLL | SEALDLTRDQ | VEAAVRALRP | DLIFFDFAH- | MPEIAKEHM | 127 |
| SEQ_ID_NO_893 | DIPIHLTHFL | CVAMDRTRDQ | VEKIIRDQKP | DFVMYDMAY- | MPEVARPLG | 133 |

Figure 29 (continued)

| | | | | | | | |
|---|---|---|---|---|---|---|---|
| SEQ_ID_NO_907 | I KAL QFSVFS | AVSGAYLMNP | ARRLGAGGQL | - - PTADDLTS | PPAGFPPSSS | | 179 |
| SEQ_ID_NO_912 | ARAAHFSVFT | AVTSAYLTVP | ARRRLHHGAA | SCPTVDDLAT | APVGFPPSSS | | 187 |
| SEQ_ID_NO_911 | VKAALFSVFA | AVSGAYVMAP | ARRRLPGPWR | - - PTVDDLAS | APEGFPPSSP | | 195 |
| SEQ_ID_NO_898 | I KSVHFSVYS | AI SDAYI TVP | SRFADVEGRN | - - I TFEDLKK | PPPGYPQNSN | | 177 |
| SEQ_ID_NO_913 | I KTI YFSVYM | - - - - ANI VMP | STSKLTGNKP | - - STVEDI K- | - - - - ALQQSDG | | 175 |
| SEQ_ID_NO_901 | I KTVYYSVVV | ALSTAFLTCP | ARVLE- PKKY | - - PSLEDMKK | PPLGFPQTSV | | 182 |
| SEQ_ID_NO_915 | I KTVFYSVFV | ALSTAFLTCP | ARVTE- PKKY | - - PTLEDMKK | PPLGFPHTSI | | 180 |
| SEQ_ID_NO_904 | I KSVFYSTI S | PLMHGFALSP | ERRVA- - GKQ | - - LTEADMMK | APASFPDPSI | | 176 |
| SEQ_ID_NO_905 | I KSVFYSTI S | PLMHGYALSP | ERRVV- GKQ | - - LTEADMMK | APASFPDPSI | | 176 |
| SEQ_ID_NO_908 | I KSVFYSTI S | PLMHGYALSP | ERRVV- GKQ | - - LTEADMMK | APASFPDPSI | | 176 |
| SEQ_ID_NO_891 | I KSVSYMVS | ATTI AYTFAP | G- - - - - - - - - | - - - - - GVLGV | PPPGYPSSKV | | 163 |
| SEQ_ID_NO_893 | I KTI KYSVVS | AAAI AI VLVP | ARNVV- EGKA | - - I TAAELSV | PPTGYPSTSV | | 180 |

| | | | | | | | |
|---|---|---|---|---|---|---|---|
| SEQ_ID_NO_907 | I TTVPAYQAA | DFSYVFTSFH | GEP- CVYDRV | LAGVQASDAL | VI KTCFEMEG | | 228 |
| SEQ_ID_NO_912 | LATVPTYQAA | DFTYVFTSFH | GMP- SAYDRV | AACDKASDVL | VFKTCAEMEG | | 236 |
| SEQ_ID_NO_911 | LATVPAYQAA | DFSYVFESFH | GMP- CVYDRV | AACHNACDAL | VI KTCAEMEG | | 245 |
| SEQ_ID_NO_898 | I - SLKAFEAM | DFMFLFTRFG | EKNLTGYERV | LQSLGECSFI | VFKTCKEI EG | | 226 |
| SEQ_ID_NO_913 | L- PVKTFEAI | SLMNVFKSFH | - - - - - - - DMM | DKCI NGCNLM | LI KSCREMEG | | 217 |
| SEQ_ID_NO_901 | T- SVRTFEAR | DFLYVFKSFH | NGP- TLYDRI | QSGLRGCSAI | LAKTCSQMEG | | 230 |
| SEQ_ID_NO_915 | T- SVKTFEAQ | DFLYI FKSFN | NRP- TVYDRV | LSGLKGCSAI | LAKTCSQMEG | | 228 |
| SEQ_ID_NO_904 | K- - LHAHEAR | GFTARTVMKF | GGDI TFFDRI | FTAVSESDGL | AYSTCREI EG | | 224 |
| SEQ_ID_NO_905 | K- - LHAHEAR | GFTARTVMKF | GGDI TFFDRI | FTAVSESDGL | AYSTCREI EG | | 224 |
| SEQ_ID_NO_908 | K- - LHAHEAR | GFTARTVMKF | GGDI TFFDRI | FTAVSESDGL | AYSTCREI EG | | 224 |
| SEQ_ID_NO_891 | L- YRENDAH | ALATLSI FYK | - - - - RLYHDI | TTGFKSCDI | ALRTCNEI EG | | 207 |
| SEQ_ID_NO_893 | V- - LRGHEVR | SLLFVSQPYG | EGT- TFYERA | CTGMKGCDAI | AI RSCYEMEE | | 227 |

| | | | | | | | |
|---|---|---|---|---|---|---|---|
| SEQ_ID_NO_907 | PYI NYLTAQH | GKPVLVTGPV | VPEPPQGE- L | EERWARMLSS | FPDNAVVFAS | | 277 |
| SEQ_ID_NO_912 | PYI EYVATQY | DKPI LVTGPL | VPEPPHGE- L | EERWETMLSS | FPDNAVVFAS | | 285 |
| SEQ_ID_NO_911 | PYI DYI AAEH | GKPVLVTGPI | VPEPPRGE- L | EERWATMLSS | FPDNSVVFAS | | 294 |
| SEQ_ID_NO_898 | PYLDYI ETQF | RKPVLLSGPL | VPEPSTDV- L | EEKWSKMLDG | FPAKSVI LCS | | 275 |
| SEQ_ID_NO_913 | SRI DDYTKQS | TRPVFLI GPV | VPEPHSGE- L | DETWANMLNR | FPAKSVI YCS | | 266 |
| SEQ_ID_NO_901 | PYI KYVEAQF | NKPVFLI GPV | VPDPPSGK- L | EEKWATMLNK | FEGGTVI YCS | | 279 |
| SEQ_ID_NO_915 | PYI EYVKSQF | KKPVLLVGPV | VPDPPSGK- L | EEKWDAMLNK | FEAGTVI YCS | | 277 |
| SEQ_ID_NO_904 | QFCDYI ETQF | KKPVLLAGPA | LPVPSKST- M | EQKWSDMLGK | FKEGSVI YCA | | 273 |
| SEQ_ID_NO_905 | QFCDYI ETQF | QKPVLLAGPA | LPVPSKST- M | EQKWSDMLGK | FKEGSVI YCA | | 273 |
| SEQ_ID_NO_908 | QFCDYI ETQF | QKPVLLAGPA | LPVPSKST- M | EQKWSDMLGK | FKEGSVI YCA | | 273 |
| SEQ_ID_NO_891 | KFCDYI SSQY | HKKVLLTGPM | LPEDDTSKPL | EEQLSHFLSR | FPPRSVVFCA | | 257 |
| SEQ_ID_NO_893 | KLCDYI GRQY | GKPVFLTGPV | LPESARTP- L | EDRWAQMLNR | FEAGSVVFCS | | 276 |

Figure 29 (continued)

| SEQ_ID_NO_907 | FGSETFLPAA AATELLLGLE STNRPFFVVL NFPKGTDTEA ELAKCTPPGF | 327 |
|---|---|---|
| SEQ_ID_NO_912 | FGSETFLPTA AATELLLGLE ATGQPFVAVL NFPRSVDAEA EVKKCMAPGF | 335 |
| SEQ_ID_NO_911 | FGSETFLLHA AATELLLGLE ATALPFLAVL NFPKGTDAEA ELRKLTPPGL | 344 |
| SEQ_ID_NO_898 | FGSETFLSDY QIKELASGLE LTGLPFILVL NFPSNLSAKA ELERALPKGY | 325 |
| SEQ_ID_NO_913 | FGSETFLTDD QIRELALGLE LTGLPFFLVL NFPANVDKSA ELKRTLPDGF | 316 |
| SEQ_ID_NO_901 | FGSETFLTDD QVKELALGLE QTGLPFFLVL NFPANVDVSA ELNRALPEGF | 329 |
| SEQ_ID_NO_915 | FGSETFLKDD QIKELALGLE QTGLPFFLVL NFPANVDASA ELNRGLPEGF | 327 |
| SEQ_ID_NO_904 | FGSECTLRKE QFQELLMGLE LTGMPFFAAL KAPFGTDS- - IEAAIPEEL | 320 |
| SEQ_ID_NO_905 | FGSECTLRKD KFQELLMGLE LTGMPFFAAL KPPFETES- - VEAAIPEEL | 320 |
| SEQ_ID_NO_908 | FGSECTLRKD KFQELLMGLE LTGMPFFAAL KPPFEAES- - IEAAIPEEL | 320 |
| SEQ_ID_NO_891 | LGSQIVLEKD QFQELCLGME LTGLPFLIAV KPPRGSST- - VEEGLPEGF | 304 |
| SEQ_ID_NO_893 | FGSQLILEKE QLQELVLGFE STGLPFLVVL KPPVGSST- - IEEALPEGF | 323 |

| SEQ_ID_NO_907 | AERTKGRGVV HTGWQQQHI LRHRGVGCFV NHAGLSSVVE GLVAGCRLVL | 377 |
|---|---|---|
| SEQ_ID_NO_912 | EERVKGRGVV HSGWQQQHI LRHRGYGCYV NHAGFSSVVE GLVAGCRLVL | 385 |
| SEQ_ID_NO_911 | EERVKGRGIL HTGWQQQHI LRHRBVGCFV NHSGLSSVVE GLIAGCRLVL | 394 |
| SEQ_ID_NO_898 | LERVKNRGVV HSGWFQQQLV LKHSGVGCYV CHGGFSSVIE AMVNECQLVL | 375 |
| SEQ_ID_NO_913 | LERVKDKGIV HSGWQQRHI LAHDGVGCYV FHAGYGSVIE GLVNDCQLVM | 366 |
| SEQ_ID_NO_901 | LERVKDKGII HSGWQQQNI LAHSGVGCYV CHAGFSSVIE ALVNDCQVVM | 379 |
| SEQ_ID_NO_915 | RERVKEKGVI HSGWQQQHI LAHTGVGCYV CHAGFSSVIE AFMNDCQVVM | 377 |
| SEQ_ID_NO_904 | REKIHGKGIV HGGWQQQLF LQHPGVGCFV SHCGWASLSE ALVNDCQIVL | 370 |
| SEQ_ID_NO_905 | KEKIQGRGIV HGEWQQQLF LQHPGVGCFV SHCGWASLSE ALVNDCQIVL | 370 |
| SEQ_ID_NO_908 | KEKIQGRGIV HGEWQQQLF LQHPGVGCFV SHCGWASLSE ALVNDCQIVL | 370 |
| SEQ_ID_NO_891 | QERVKGRGVV WGGWQQPLI LDHPSIGCFV NHCGPGTIWE CLMTDCQMVL | 354 |
| SEQ_ID_NO_893 | EERVKGRGVV WGGWQQLEI LDHPSIGCFV NTCGFGSMME SLMSDCQIVL | 373 |

| SEQ_ID_NO_907 | LPMKGDQYLN AALFARDLRV GAEVARRDGD GWFGRGDVSD AVDTAMAD- - | 425 |
|---|---|---|
| SEQ_ID_NO_912 | LPMKSDQFFN AALLARELRV GTEVARRDGD GWFGHDAVRD AVNAAVAD- - | 433 |
| SEQ_ID_NO_911 | LPMKGDQYLN AALFARELRV GTEVARRARD GWFGREDVRD ALAAAFAG- - | 442 |
| SEQ_ID_NO_898 | LPFKGDQFFN SKLIANDLKA GVEVNRSDED GFFHKEDILE ALKTVMLEDN | 425 |
| SEQ_ID_NO_913 | LPMKVDQFTN SKVIALELKA GVEVNRRDED GYFGKDDVFE AVESVMNDTE | 416 |
| SEQ_ID_NO_901 | LPQKGDQILN AKLVSGDMEA GVEINRRDED GYFSKEDIKE AVEKVMVDVE | 429 |
| SEQ_ID_NO_915 | LPQKGDQLLN AKLVSGDMKA GVEVNRRDED GYFSKDDIEE AVEKVMVEL- | 425 |
| SEQ_ID_NO_904 | LPQVGDQIIN ARIMSVSLKV GVEVEKGEED GVFSRESVCK AVKAVM-DEK | 419 |
| SEQ_ID_NO_905 | LPQVGDQIIN ARIMSVSLKV GVEVEKGEED GVFSRESVCK AVKAVM-DEK | 419 |
| SEQ_ID_NO_908 | LPQVGDQIIN ARIMSVSLKV GVEVEKGEED GVFSRESVCK AVKAVM-DEK | 419 |
| SEQ_ID_NO_891 | LPFLGDQVLF TRLMTEEFKV SVEVSR-EKT GWFSKEBLSD AIKSVM-DKD | 402 |
| SEQ_ID_NO_893 | VPHLGDQILN TRLMAEELKV AVEVER-DEK GWFTKENLSN AIKCVM-DKD | 421 |

Figure 29 (continued)

| | | | | | | |
|---|---|---|---|---|---|---|
| SEQ_ID_NO_907 | ...GMEGDG- | ·IKWRDFLMD | DAVQKRLADD | FVRDFKKFVR | A··· | 461 |
| SEQ_ID_NO_912 | ···AGGGDDD | ERKWREFLTD | DAVQRRFVEE | FVRELRKLVL | ···· | 470 |
| SEQ_ID_NO_911 | ···GEDGGGE | EKKWREFLMD | DAVQRRFVRE | FVAGLRRLKG | ···· | 479 |
| SEQ_ID_NO_898 | KEQGKQIREN | HMQWSKFLSN | KEIQNKFITD | LVAQLKSMA- | ···· | 464 |
| SEQ_ID_NO_913 | NEPAKSIREN | HRKLKEFLQN | DEIQKKYIAD | FVENLKAL | ···· | 454 |
| SEQ_ID_NO_901 | KDPGKLIREN | QKKWKEFLLN | KDIQSKYIGN | LVNEMTAMAK | VSTT | 473 |
| SEQ_ID_NO_915 | ····KVIREN | QKKWKEFLLN | KDTHSKFVED | LVHDMMAMAK | LSTT | 465 |
| SEQ_ID_NO_904 | SEIGREVRGN | HDKLRGFLLN | ADLDSKYMDS | FNQKLQDLLG | ···· | 459 |
| SEQ_ID_NO_905 | SEIGREVRGN | HDKLRGFLMN | ADLDSKYMDS | FNQKLQDLLG | ···· | 459 |
| SEQ_ID_NO_908 | SEIGREVRGN | HDKLRGFLLN | ADLDSKYMDS | FNQKLQDLLG | ···· | 459 |
| SEQ_ID_NO_891 | SDLGKLVRSN | HAKLKETLGS | HGLLTGYVDK | FVEELQEYI | ···· | 442 |
| SEQ_ID_NO_893 | SEVGSMKKN | HTEWRKLLRS | EGFMSSYFDK | FFQNMQELVD | HK·· | 463 |

Figure 30

```
SEQ_ID_NO_935    MAY--DRRRS -SLFDAFTLS PLPYPVLLIL LMVFLLLSLS WFFDHESFME  47
SEQ_ID_NO_917    MSYYGDRRAE SSIVEAFTLS PLPYPVILVL LMVTLLLGAS WFFTYDDFIE  50
SEQ_ID_NO_925    MSYY-DRRGE SSVLEAFTLS PLPYPVILIL MMVTLLLGAS WFFSYEDFME  49
SEQ_ID_NO_940    MAY--QRGET SSVVEAFTLS PLPYPVILIL LMVMLLGVS  WFFTYEDFME  48
SEQ_ID_NO_937    MAYYGDRRPE SSIVEAFTLS PLPYPVILIL LMVSLLLGVS WFFTYEDFIE  50
SEQ_ID_NO_921    MAY--EERRS -SILDSFSLS PLPYPVLLIL AVASVFLSS  WYFSLEEAAE  47
SEQ_ID_NO_919    MHY--YRRRS DSIFDAFTLN PLPYPVLLIL AVLSIFLGMS WFFSYEDMVE  48
SEQ_ID_NO_923    MGY--GRSRA SSVLDGFSLN PVPYPVLLIL SLIFLGIS   WYISYEEVVE  48

SEQ_ID_NO_935    ETEEQMSWVL LTLPVVLILV IRWLSSIERL DDTLMGLFRY DRRRPSYYGY  97
SEQ_ID_NO_917    EASQQLSWAL LGVPIALVLL IRWISSVDSF EGYLGFYPR  ESRWKGRVE-  98
SEQ_ID_NO_925    EASEQFSWFL LGVPIALVLL IRWISSVDTF EGYFGFYPT  ESRWRG-VP-  96
SEQ_ID_NO_940    EAAEQLSWAL LLVPVALVLL IRWISSVDTF DGYFSFYPT  ERRWNRVDP-  96
SEQ_ID_NO_937    EAAEQFSWAL LVVPIALVLL IRWISSVDSF DGYFEGFYPS ERRWRPGVG-  99
SEQ_ID_NO_921    SAEEQINFAL LLIPLFLIVL VRWLSSMENP DAL-LGMFSS SRRTTYVSPG  96
SEQ_ID_NO_919    TTEEQMGWL  LVVPLVLIVI VRWLSSMENP DMI-FVMSPW DKRRRTHHR-  96
SEQ_ID_NO_923    AAEEQLGWML LATPVVLILV VRWLSSVDTS EMFFNSSPW  ERRRRTHHF-  97

SEQ_ID_NO_935    SQPQEGSSPW GIAAVLVLLL VMVYF----- ---------- ----------  122
SEQ_ID_NO_917    RGPAEGSSPW GVALLVLLLL VLARAGCGKV VYGNPGRLGR KRRGGDKVKE  148
SEQ_ID_NO_925    AAPSEGSSPW GVAMVVLLLL LLASF----- ---------- ----------  121
SEQ_ID_NO_940    -GPAEGSSPW GVAMVVLLLL VLASF----- ---------- ----------  120
SEQ_ID_NO_937    SAPAEGSSPW GVAMLVLLLI VLASF----- ---------- ----------  124
SEQ_ID_NO_921    AGGDGGSSPW GVAALIVLLL VLLQY----- ---------- ----------  121
SEQ_ID_NO_919    --PSEGSSPW GVAAFIVLLL VLVKF----- ---------- ----------  119
SEQ_ID_NO_923    --PSEGSSPW GVAALILLVL VLLHY----- ---------- ----------  120

SEQ_ID_NO_935    ---HSSIQDM MGP------- ---------- ---------- ----------  132
SEQ_ID_NO_917    QAGDEAAKFP MSGMRLATEK RRRVRRSPSK KGIVLKQKSR KVSLQHRSKK  198
SEQ_ID_NO_925    ---HSTFQDM MKP------- ---------- ---------- ----------  131
SEQ_ID_NO_940    ---ISTFQDM MKP------- ---------- ---------- ----------  130
SEQ_ID_NO_937    ---HETIRDM MRP------- ---------- ---------- ----------  134
SEQ_ID_NO_921    ---QSSFLEM MSG------- ---------- ---------- ----------  131
SEQ_ID_NO_919    ---QSTFLDS MLV------- ---------- ---------- ----------  129
SEQ_ID_NO_923    ---HSTFLDA MFV------- ---------- ---------- ----------  130
```

Figure 30 (continued)

```
SEQ_ID_NO_935                    - - -      132
SEQ_ID_NO_917                    L K A      201
SEQ_ID_NO_925                    - - -      131
SEQ_ID_NO_940                    - - -      130
SEQ_ID_NO_937                    - - -      134
SEQ_ID_NO_921                    - - -      131
SEQ_ID_NO_919                    - - -      129
SEQ_ID_NO_923                    - - -      130
```

Figure 31

| | | | | | | | |
|---|---|---|---|---|---|---|---|
| SEQ_ID_NO_947 | MGI KFSQGPS | NTTI HNRS-- | -HQDGEDQRN | ETATKI NHDK | PQNQSS--SF | | 45 |
| SEQ_ID_NO_972 | MGSL- GPSTI | SSMNMAKAAS | VVGGKTGVVA | VADQQKEVPP | KTMNCSSYAF | | 49 |
| SEQ_ID_NO_967 | MGSL- GPAVV | VSASAAKM-- | ---AGGGQQP | STERKETSSA | FGGGCCGGGF | | 44 |
| SEQ_ID_NO_964 | MGSLL GPTVT | VNVSMTKPDA | AAAGGGQQPP | --ERKEGGGR | CGVLGC- GF | | 46 |
| SEQ_ID_NO_944 | MGSL- GPTVS | LSI -MARP-- | ----GGQQPA | EMERKKDSGV | FFGGC- GF | | 40 |
| SEQ_ID_NO_946 | ---MSGVSCP | SSVSSAMP-- | -----KDLRP | NGYNQHDASK | RGTCSC---F | | 37 |
| SEQ_ID_NO_962 | MGSI SQPVAN | LSLAASAQ- | ---------- | --AKQQQRDL | H----C---F | | 29 |
| SEQ_ID_NO_950 | MESVTTRPSP | NVVGVANS-- | ---------- | --------K | HGVEWCG-HF | | 28 |

| | | | | | | |
|---|---|---|---|---|---|---|
| SEQ_ID_NO_947 | QI PLHYPKYT | KSDYEKMPEW | QLDRLLREYG | LPVI GDSYEK | RKFAI GAFLW | 95 |
| SEQ_ID_NO_972 | QMPLHYPRYK | KADYESMPEW | RVDCLLREYG | LPADGDLDSK | RKFAMGAFLW | 99 |
| SEQ_ID_NO_967 | QMPLHYPRYK | KADYEAMPEW | RVDCLLREYG | LPVDGGVEEK | RRFAMGAFLW | 94 |
| SEQ_ID_NO_964 | RMPLHYPRYK | KEDYEGMPEW | RVDSLLREYG | LPADGDLDSK | RRFAMGAFLW | 95 |
| SEQ_ID_NO_944 | RMPLHYPRYK | KADYESMPEW | RVDCLLREYG | LPADGDVDSK | RRFAMGAFLW | 90 |
| SEQ_ID_NO_946 | QMPLHYPRYK | KSDYETMPEW | RLDCLLKEYG | LPAI GDANQK | RKFAMGAFLW | 87 |
| SEQ_ID_NO_962 | RMPLHYPRYT | RADYESMPEW | KLDCLLREYG | LPVTGDVDHK | RSFAMGAFLW | 79 |
| SEQ_ID_NO_950 | QMPLHYPRYT | QADYEAMPEW | RLDCLLKEYG | LPI FGDVESK | RKFAMGAFLW | 78 |

| | | |
|---|---|---|
| SEQ_ID_NO_947 | SSENEH | 101 |
| SEQ_ID_NO_972 | PDQY- - | 103 |
| SEQ_ID_NO_967 | PDQY- - | 98 |
| SEQ_ID_NO_964 | PDQY- - | 100 |
| SEQ_ID_NO_944 | PDQY- - | 94 |
| SEQ_ID_NO_946 | PSENE- | 92 |
| SEQ_ID_NO_962 | PAH- - - | 82 |
| SEQ_ID_NO_950 | I K- - - - | 80 |

Figure 32

```
SEQ_ID_NO_976    ------MALH LNTVIDLTVD NVVLFRIPPI TIDFLNKLPQ QSEAPTPASA    44
SEQ_ID_NO_980    MAPSTIYQYH MRQDFSTNVD SN---NSTAP TTDAIIHLQ  FSHVLELCYP    47
SEQ_ID_NO_978    ---------- ---------- ---------- MARLLFRLLQ ETNSPTPATP    20

SEQ_ID_NO_976    VTAQLTRRFT CSTGDFL-VL YRQPQRVEEM VTAAGLPLEC APSVAEFISL    92
SEQ_ID_NO_980    ETIQIPLNTT NESHLFPRQL FSSHVNRESI VKEILSSMGC SSDFIESAAP    97
SEQ_ID_NO_978    SP-------- -------AL YSDLVF--VM LAALLCALIC VLGLLAVSF-    49

SEQ_ID_NO_976    SVRSNSYRK- ---------- --PVVMTVEV GAPVDEDEDE DELL------  123
SEQ_ID_NO_980    DISSFALDMV TNPCNASSSE VLTMVLAIHV TTPYDEREEI DRALSESLMQ   147
SEQ_ID_NO_978    --RCVWLRRI ANR------- ---------- SATNSDQPPA NKGLKKKVLK    60

SEQ_ID_NO_976    ---------- ---------- -PPGAVFEEC AICYKEYLVG GATSVKLACS   152
SEQ_ID_NO_980    EASRFKPASK SCIDGLKRMS LEGSCSMKEC MVCLEEFLMG SEVLVCLPCG   196
SEQ_ID_NO_978    SLPKLTYSPD S--------- -PPAEKFAEC AICLMEFAAG DELRVLSQCG   120

SEQ_ID_NO_976    HTFHRKCLDR ATAVNRTCPY CRAPVPVEQD YWDDEDACDN SESESDDIPS   202
SEQ_ID_NO_980    HIFHGDCIVR MLETSHLCPL CRFAMP---- ---------- ---------   222
SEQ_ID_NO_978    HGFHVSCIDT MLGSHSSCPS CRDILV---- ---------- SIARCQKCGG   156

SEQ_ID_NO_976    EEGDDEESEY DDIPSEGGDD EETEHDDIPS EEGDDWESEY EDVPNEEDDG   252
SEQ_ID_NO_980    ---------- ---------- ---------- ---------- ---------   222
SEQ_ID_NO_978    LPGSSSSGPE PDTRIKQDDP NSNNNDNXSX LN-------- ---------   188

SEQ_ID_NO_976    SSPAPDGSSQ EITAASPEFV SSVRDLSLSC LRLD      286
SEQ_ID_NO_980    ---------- ---------- ---------- ----      222
SEQ_ID_NO_978    ---------- ---------- ---------- ----      188
```

Figure 33

| | | | | | | | |
|---|---|---|---|---|---|---|---|
| SEQ_ID_NO_991 | -MAMGMLEVH | LISGKGLRAH | DPLN----- | ------KPI D | PYVE NYKGD | 37 |
| SEQ_ID_NO_1032 | -MAMGMLEVH | LISGKGLQAH | DPLN----- | ------KPI D | PYVE NYKGD | 37 |
| SEQ_ID_NO_985 | -MGMGMLEVH | LISGKGLQAH | DPLN----- | ------KPI D | PYVD NYKGD | 37 |
| SEQ_ID_NO_992 | -MAMGMLEVH | LISGKGLQAH | DPLN----- | ------KPI D | PYVE NYKGD | 37 |
| SEQ_ID_NO_1008 | MAGSGVLEVH | LVDAKGLTGN | DFL------ | ------GKI D | PYVVVQYRSQ | 37 |
| SEQ_ID_NO_1001 | -MPRGTLEVV | LISAKGLEDN | DFL------ | ------SSI D | PYVILSYRAQ | 36 |
| SEQ_ID_NO_1003 | -MAQGTLEVL | LVGAKGLENT | DYL------ | ------CNMD | PYAVLKCTSQ | 36 |
| SEQ_ID_NO_1028 | -MVQGTLEVL | LVGAKGLENT | DYL------ | ------CNMD | PYAVLKCRSQ | 36 |
| SEQ_ID_NO_984 | -MPQGKLQVV | LVSAKGLENT | DFL------ | ------CNMD | PYVLLTCRTQ | 36 |
| SEQ_ID_NO_995 | -MPEGTIQVV | LVGAKGLENT | DFFNYRVPCN | DVKTYPSNI D | PYVLLTCRSQ | 49 |
| SEQ_ID_NO_982 | -MPHGTLEVV | LVSAKGLEDS | DFL------ | ------NSMD | PYVLLTCRTQ | 36 |
| SEQ_ID_NO_996 | -MPHGTLEVV | LVSAKGLEDA | DFL------ | ------NNMD | PYVQLTCRTQ | 36 |
| SEQ_ID_NO_1011 | -MVRGKLEVL | LVSAKGLDDS | DFF------ | ------NSMD | PYVILTCRSH | 36 |
| SEQ_ID_NO_1023 | -MVHGKLEVL | LVSAKGLEDT | DFL------ | ------NNMD | PYVILTCRTQ | 36 |
| SEQ_ID_NO_1026 | .......... | .......... | .......... | --------MD | PYVILTCRTQ | 12 |

| | | | | | | | |
|---|---|---|---|---|---|---|---|
| SEQ_ID_NO_991 | ERMSKVAKNA | GPDPVWNEKF | KFLAEYPGSG | GDFLILFKVM | DHDVIDGDDY | 87 |
| SEQ_ID_NO_1032 | ERMSKVAKNA | GPDPVWNEKF | KFLAEYPGSG | GDFLILFKVM | DHDVIDGDDY | 87 |
| SEQ_ID_NO_985 | ERMSGVAKNG | GPNPLWDEKF | KFLAEYPGSG | GDFHILFKVM | DHDAIDGDDY | 87 |
| SEQ_ID_NO_992 | ERMSKVAKNA | GPDPLWDEKF | KFLAEYPGSG | GDFHVLFKVM | DHDAIDGDDY | 87 |
| SEQ_ID_NO_1008 | ERKSSVARDQ | GKNPSWNEVF | KFDINSTAAT | GDHKLFLRLM | DHDTFSRDDF | 87 |
| SEQ_ID_NO_1001 | EHKSTVQEGA | GSNPQWNETF | LFTV---SD | SASELNLRIM | EKDNFNNDDN | 82 |
| SEQ_ID_NO_1003 | EQKSTVASGK | GSDPEWNETF | VFTV---SE | NATELVKLL | DSDGGTDDDS | 82 |
| SEQ_ID_NO_1028 | EQKSSVASGK | GSDPEWNETF | MFSV---TH | NATELIKLM | DSDSGTDDDF | 82 |
| SEQ_ID_NO_984 | EQKSSVASGK | GSEPEWNEDF | FNI---SE | GASELAKIM | DSDAGSQDDF | 82 |
| SEQ_ID_NO_995 | EQRSSVASGQ | GSEPEWNETF | VFTI---SE | GTSELVLKIV | DHDTITDDDY | 95 |
| SEQ_ID_NO_982 | DQKSNVASGQ | GTTPEWNETF | FNV---SE | GTTELKAKIF | DTDVGIEDDP | 82 |
| SEQ_ID_NO_996 | DQKSNVAEGM | GTTPEWNETF | FTV---SE | GTTELKAKIF | DKDVGTEDDA | 82 |
| SEQ_ID_NO_1011 | EQKSTVASGA | GSEPEWNETF | FFAV---SS | DSPELRVKIM | DSDALSADDL | 82 |
| SEQ_ID_NO_1023 | EQKSSVANGE | GSEPEWNETF | FTV---SD | DTPQLNLKIM | DSDFVTNDDF | 81 |
| SEQ_ID_NO_1026 | EQKSSVAKGA | GSEPEWNETF | VFTV---SD | DVPQLNVKIM | DSDAFSADDF | 58 |

Figure 33 (continued)

| | | | | | | | |
|---|---|---|---|---|---|---|---|
| SEQ_ID_NO_991 | GDVSIDVKD | LLVEGVRKGW | SELPPRMYQV | AHKLYFKGE | EVGVSFKRQ | 137 |
| SEQ_ID_NO_1032 | GDVSIDVKD | LLVEGVRKGW | SELPPRMYQV | AHKLYFKGE | EVGVSFKRQ | 137 |
| SEQ_ID_NO_985 | GDVKIDVKD | LLAEGVRKGW | SEPPRMYHV | AHKIHFKGE | EVGVSFKLQ | 137 |
| SEQ_ID_NO_992 | GDVKIDVKD | LLAEGVRKGW | SERPRMYHV | AHKIHFKGE | EVGVSFKLQ | 137 |
| SEQ_ID_NO_1008 | LGEATINNTD | LLSLGMEHGT | WEMSESKHRV | VLADKIYHGE | RVSLTFTAS | 137 |
| SEQ_ID_NO_1001 | LGEAIPLEA | VFEEG----- | SLAENAYKL | VLKEQEYCGE | KVALTFTPE | 125 |
| SEQ_ID_NO_1003 | VGEATIPLDG | VYTEG----- | SIPPTVYNV | VLKDEEYRGE | KIGLTFTPE | 125 |
| SEQ_ID_NO_1028 | VGEATISLEA | VYTEG----- | SIPPTVYNV | VLKEEEYRGE | KVGLTFTPE | 125 |
| SEQ_ID_NO_984 | VEEVAIPLEP | VFIER----- | NIPLTPYTV | VLKDGEYRGE | KFGLTFTPE | 125 |
| SEQ_ID_NO_995 | LGKASIPLEP | LFIEG----- | NLPITAYNV | VLKDEEYRGE | RVGLSFTPE | 138 |
| SEQ_ID_NO_982 | LGEATIPLEA | VFLEG----- | DPPAAYNV | VLKDEEFKGE | IMALSFKPS | 125 |
| SEQ_ID_NO_996 | VGEATIPLEP | VFNEG----- | SIPPTAYNV | VLKDEEYKGE | MVALSFKPS | 125 |
| SEQ_ID_NO_1011 | VGEACIPLEA | VLQEG----- | SLPPAVHRV | VLKDEEYRGE | KIALTFTPA | 125 |
| SEQ_ID_NO_1023 | VGEASIPLEA | VFQEG----- | SLPPTVHPV | VLKEEKYCGE | KLALTFTPA | 124 |
| SEQ_ID_NO_1026 | VGEANIPLEP | VFLEG----- | SLPPAVHRV | VLKEEKYCGE | KVALTFTPA | 101 |

| | | | | | | | |
|---|---|---|---|---|---|---|---|
| SEQ_ID_NO_991 | ---------- | ---------- | ---------- | ---------- | ---------- | 137 |
| SEQ_ID_NO_1032 | ---------- | ---------- | ---------- | ---------- | ---------- | 137 |
| SEQ_ID_NO_985 | ---------- | ---------- | ---------- | ---------- | --GGGGCGGC | 145 |
| SEQ_ID_NO_992 | ---------- | ---------- | ---------- | ---------- | --GGGGCAGC | 145 |
| SEQ_ID_NO_1008 | ---------- | ---------- | ---------- | ---------- | AKAQDHAFQV | 147 |
| SEQ_ID_NO_1001 | ---------- | ---------- | ---------- | ---------- | --RNDEFETC | 133 |
| SEQ_ID_NO_1003 | --E------- | ---------- | ---------- | ---------- | ARDEDQPEENY | 137 |
| SEQ_ID_NO_1028 | --D------- | ---------- | ---------- | ---------- | DRDRGLSEEDI | 137 |
| SEQ_ID_NO_984 | ERE------- | ---------- | ---------- | ---------- | SRDFEV-EESF | 138 |
| SEQ_ID_NO_995 | RRT------- | ---------- | ---------- | ---------- | SRTFDAGEESY | 152 |
| SEQ_ID_NO_982 | --E------- | ---------- | ---------- | ---------- | NRSRGFEEESY | 137 |
| SEQ_ID_NO_996 | --E------- | ---------- | ---------- | ---------- | NRSRGMDEESY | 137 |
| SEQ_ID_NO_1011 | ---------- | ---------- | ---------- | ---------- | -EENEEEESY | 134 |
| SEQ_ID_NO_1023 | -VE------- | ---------- | ---------- | ---------- | TRRPDNEEGTY | 137 |
| SEQ_ID_NO_1026 | AVKTLTSVSC | NIDGVVAIVS | EHLVGVCDAN | VLDTRISSGN | SPSSQPRERG | 151 |

Figure 33 (continued)

| | | |
|---|---|---|
| SEQ_ID_NO_991 | .G.......... | 138 |
| SEQ_ID_NO_1032 | .G.......... | 138 |
| SEQ_ID_NO_985 | NPWEN....... | 150 |
| SEQ_ID_NO_992 | YPWEN....... | 150 |
| SEQ_ID_NO_1008 | GGWAHSFRQ-.. | 156 |
| SEQ_ID_NO_1001 | GGWKESTRDF.. | 143 |
| SEQ_ID_NO_1003 | GGWNQSS-.... | 144 |
| SEQ_ID_NO_1028 | GGWKQSS-.... | 144 |
| SEQ_ID_NO_984 | GGWKQSYTD .. | 148 |
| SEQ_ID_NO_995 | GGWKESAYTD.. | 162 |
| SEQ_ID_NO_982 | GGWKNSEASY.. | 147 |
| SEQ_ID_NO_996 | GGWKNSEASY.. | 147 |
| SEQ_ID_NO_1011 | GGWNQST-.... | 141 |
| SEQ_ID_NO_1023 | SSWN-....... | 141 |
| SEQ_ID_NO_1026 | GGLQQLELIACY | 163 |

Figure 34

```
SEQ_ID_NO_1058    MHRFASGLAS ---------- ------KARL ARKGANQIAS RSSMSRN---      31
SEQ_ID_NO_1077    ---MASTFAG MSSAGPLAAP STSSNKLSSM ANISSTSFGS KRNVALRKSR      47
SEQ_ID_NO_1078    ---MASTFAG MSSAGPLAAP STGSNKLSSM ANISSTSFGS KRNVALRKSR      47
SEQ_ID_NO_1075    ---MNTQIHP --HTSLLFFP PN---RFNF ISSFSSF--- -----RRRNP      33
SEQ_ID_NO_1095    ---MTTARGL ---------- ------SART TRGA------ -----SNRRV      20
SEQ_ID_NO_1055    ---MAQSQLA ---------- ------KGSR QTTGRPFQNK P----ARAAR      27
SEQ_ID_NO_1080    ---MATIPTT --GSASLLRG SA---ALQRD GRSTRPSSAA RPLPGRRARS      42
SEQ_ID_NO_1086    ---MATMPST CASSSSLFLL LR----KDRR SSRSASL--- -----PGPAR      35
SEQ_ID_NO_1085    ---MATIPTT --DSALLLGS SA---LHRA RRASAARLPG A----NRRRP      37
SEQ_ID_NO_1097    ---MATIPTT --DSGLLLGS ------SALL RRTRRAASSA RLPAAARRRP      39
SEQ_ID_NO_1054    ---MASANAI --STASPFRP LS---QGRL ---------- -----ATRSD      25
SEQ_ID_NO_1088    ---MASANAI --STASLLRS FS---SQGRV RRAK------ -----NGRAQ      31
SEQ_ID_NO_1068    ---MASANAL --SSASVLCS SR----QSKL G-GGNQQQGQ RVSYNKRTIR      40
SEQ_ID_NO_1072    ---MATANAL --SSPSVLCS SR----QCKL S-GGSQQKGQ RVSY-RKANR      39
SEQ_ID_NO_1057    ---MASANAL --SSASILCS PN----KGSL RRKGNQRQNQ RVNY-RQGNN      40
SEQ_ID_NO_1061    ---MATSNAL --STASILCS PK----QGGL RRRGNQQNNS RLNY-GLSSR      40
SEQ_ID_NO_1076    ---MASTNAL --SSTSILRS PTN---QADT SLSKKVKQHG RVNF-RQKPN      41
SEQ_ID_NO_1092    ---MASTNAL --SSTSILRS PTNN--QADT SLSKKAKQHG RVNY-RQNPN      42
SEQ_ID_NO_1074    ---MASTNAL --SSASILRS PN----RQSL TRRANH--NG RVNY-RKPNN      38
SEQ_ID_NO_1083    ---MASTNAL --SSASILRS PN----HQSL SRRANQ--NG RVNY-RQPNH      38

SEQ_ID_NO_1058    ------YAAK DVKFGVEARG --LMLKGVED LADAVKVTMG PKGRNVVIEQ      73
SEQ_ID_NO_1077    RLTL-AAAK ELFNKDGSA IKKLQNGVNK LADLVGYTLG PKGRNVVLES      96
SEQ_ID_NO_1078    RPTL-AAAK ELFNKDGSA IKKLQNGVNK LADLVGVTLG PKGRNVVLES      96
SEQ_ID_NO_1075    QFAVR-ASPK KISFGKECRE --NLQVGIDK LADAVSLTVG PKGRNVILSE      80
SEQ_ID_NO_1095    QVQVR-AEAK KLTFDMASRR --KIQAGIDK LADAVGVTLG PRGRNVVLEE      67
SEQ_ID_NO_1055    RLVIRAADAK EIVFDQESRR --RLQAGINK VADAVGVTLG PRGRNVVLEQ      75
SEQ_ID_NO_1080    LSVVR-ASAK DIAFDQASRS --ALQAGVEK LAAAVGVTLG PRGRNVVLDE      89
SEQ_ID_NO_1086    RLGVVRASAK EIAFDQGSRS --SLQAGVEK LAAVAVTLG PRGRNVVLDE      83
SEQ_ID_NO_1085    QALVR-ASAK EIAFDQGARA --SLQAGVEK LAAAVGVTLG PRGRNVVLDE      84
SEQ_ID_NO_1097    QLLVR-ASAK EIAFDQGSRA --SLQAGVEK LAAAVGVTLG PRGRNVVLDE      86
SEQ_ID_NO_1054    RFVVR-ANAK DIAFDQKSRA --ALQAGVEK LANAVGVTLG PRGRNVVLDE      72
SEQ_ID_NO_1088    RLVVR-ADAK DIAFDQKSRA --ALQAGVEK LANAVGVTLG PRGRNVVLDE      78
SEQ_ID_NO_1068    RFSVR-ANVK EIAFDQHSRA --ALQAGIDK LADCVGLTLG PRGNVVLDE      87
SEQ_ID_NO_1072    RFSLR-ANVK EIAFDQSSRA --ALQAGIDK LADAVGLTLG PRGNVVLDE      86
SEQ_ID_NO_1057    RFGVK-ACAK EIAFDQSSRA --AMQAGIDK LADAVGLTLG PRGNVVLDE      87
SEQ_ID_NO_1061    RFSVR-ANAK DIAFDQKSRA --ALQSGIDK LADAVGLTLG PRGNVVLDE      87
SEQ_ID_NO_1076    RFVVK-AAAK DIAFDQHSRS --AMQAGIDK LADAVGLTLG PRGNVVLDE      88
SEQ_ID_NO_1092    RFMVK-AAAK DIAFDQHSRR --AMQAGIDK LADAVGLTLG PRGNVVLDE      89
SEQ_ID_NO_1074    RFSVK-ASAK EIAFDQHSRS --AMQAGIDK LADAVGLTLG PRGNVVLDE      85
SEQ_ID_NO_1083    RFAVK-ASAK EIAFDQSSRA --AIQAGIDK LADAVGLTLG PRGNVVLDE      85
```

Figure 34 (continued)

| SEQ_ID | Col1 | Col2 | Col3 | Col4 | Col5 | Col6 | Pos |
|---|---|---|---|---|---|---|---|
| SEQ_ID_NO_1058 | SYGAPKVTKD | GVTVAKSIEF | KDKVKNVGAS | LVKQVANATN | DVAGDGTTCA | | 123 |
| SEQ_ID_NO_1077 | KYGAPKIVND | GVTVAREVEL | EDPVKNIGAK | LVRQAAAKTN | DLAGDGTTTS | | 146 |
| SEQ_ID_NO_1078 | KYGAPKIVND | GVTVAREVEL | EDPVENIGAK | LVRQAAAKTN | DLAGDGTTTS | | 146 |
| SEQ_ID_NO_1075 | -SGKLKVIND | GVTIARSIEL | SDAIENAGAM | LIQEVASKMN | DLAGDGTSTA | | 129 |
| SEQ_ID_NO_1095 | KFGMPQVIND | GVTIARAIEL | PDPVENAGAQ | LIKEVAGRTN | DSAGDGTTTA | | 117 |
| SEQ_ID_NO_1055 | KFGVPQVIND | GVSIRRAIEL | KDPVENAGAQ | LIKEVAGRTN | DAAGDGTTTA | | 125 |
| SEQ_ID_NO_1080 | -FGSPKVVND | GVTIARAIEL | ADPMENAGAA | LIREVASKTN | DSAGDGTTTA | | 138 |
| SEQ_ID_NO_1086 | -FGSPKVVND | GVTIARAIEL | ADPMENAGAA | LIREVASKTN | DSAGDGTTTA | | 132 |
| SEQ_ID_NO_1085 | -FGTPKVVND | GVTIARAIEL | ADPMENAGAS | LIREVASKTN | DSAGDGTTTA | | 133 |
| SEQ_ID_NO_1097 | -FGTPKVVND | GVTIARAIEL | ADPMENAGAA | LIREVASKTN | DSAGDGTTTA | | 135 |
| SEQ_ID_NO_1054 | -YGNPKVVND | GVTIARAIEL | YDPMENAGAA | LIREVASKTN | DSAGDGTTTA | | 121 |
| SEQ_ID_NO_1088 | -YGSPKVVND | GVTIARAIEL | YDPMENAGAA | LIREVASKTN | DSAGDGTTTA | | 127 |
| SEQ_ID_NO_1068 | -FGSPKVVND | GVTIARAIEL | PNAMENAGAA | LIREVASKTN | DSAGDGTTTA | | 136 |
| SEQ_ID_NO_1072 | -FGSPKVVND | GVTIARAIEL | PDAMENAGAA | LIREVASKTN | DSAGDGTTTA | | 135 |
| SEQ_ID_NO_1057 | -FGSPKVVND | GVTIARAIEL | PNAMENAGAA | LIREVASKTN | DSAGDGTTTA | | 136 |
| SEQ_ID_NO_1061 | -FGSPKVVND | GVTIARAIEL | PDPMENAGAA | LIREVASKTN | DSAGDGTTTA | | 136 |
| SEQ_ID_NO_1076 | -FGSPKVVND | GVTIARAIEL | PDPMENAGAA | LIREVASKTN | DSAGDGTTTA | | 137 |
| SEQ_ID_NO_1092 | -FGSPKVVND | GVTIARAIEL | PDPMENAGAA | LIREVASKTN | DSAGDGTTTA | | 138 |
| SEQ_ID_NO_1074 | -FGSPKVVND | GVTIARAIEL | PDPMENAGAA | LIREVASKTN | DSAGDGTTTA | | 134 |
| SEQ_ID_NO_1083 | -FGSPKVVND | GVTIARAIEL | PDAMENAGAA | LIREVASKTN | DSAGDGTTTA | | 134 |

| SEQ_ID | Col1 | Col2 | Col3 | Col4 | Col5 | Pos |
|---|---|---|---|---|---|---|
| SEQ_ID_NO_1058 | TILTRAFTE | GCKSVAAGMN | AMDLRRGISM | AVDSVVTNLK | SRARMSTSE | 173 |
| SEQ_ID_NO_1077 | VVLAQGLIAE | GVKVVAAGAN | PVLITRGIEK | TAKALVAELK | NMSKEVEDS- | 195 |
| SEQ_ID_NO_1078 | VVLAQGLIAE | GVKVVAAGAN | PVLITRGIEK | TAKALVAELK | NMSKEVEDS- | 195 |
| SEQ_ID_NO_1075 | IILARAMIKG | GLSAVAFGAN | PISLKKGMEK | TVKDLVKFLK | KRSIPVEGRD | 179 |
| SEQ_ID_NO_1095 | SVLAREMIKY | GLQSVAAGAN | PVTVKRGMDK | TSEFCRKKLD | ELTIPVRNAA | 167 |
| SEQ_ID_NO_1055 | SVLAREMIHY | GLQSVTAGAN | PIAVKRGLDK | TAEYLVAKLK | EHAKPVKGRD | 175 |
| SEQ_ID_NO_1080 | SVLAREIIKL | GLLSVTSGAN | PVSIKKGIDK | TVQSLVEELE | KKSRPVKGSG | 188 |
| SEQ_ID_NO_1086 | SVLAREIIKL | GLLSVTSGAN | PVSIKKGIDK | TVHSLVEELE | KKSRPVKGSG | 182 |
| SEQ_ID_NO_1085 | SVLAREIIKL | GMLSVTSGAN | PVSIKKGIDK | TVQKLVEELE | KKSRPVKGGG | 183 |
| SEQ_ID_NO_1097 | SVLAREIIKL | GMLSITSGAN | PVSVKKGIDK | TVQKLVEELE | KKSRPVKGSG | 185 |
| SEQ_ID_NO_1054 | CVLAREIIKL | GLLSVTSGAN | PVSLKKGIDK | TVQGLIQELE | NKSRPIKGGG | 171 |
| SEQ_ID_NO_1088 | SVLAREIIKL | GLLSVTSGAN | PVSLKKGIDK | TVHGLIEELE | KKARPVKGSG | 177 |
| SEQ_ID_NO_1068 | SILAREIIKH | GLLSVTSGAN | PVSLKRGIDK | TVQGLIEELQ | KKARPVKGRD | 186 |
| SEQ_ID_NO_1072 | SVLAREIIKH | GLLSVTSGAN | PVSLKRGIDK | TVQALIEELE | KRSRPVKGGR | 185 |
| SEQ_ID_NO_1057 | SVLAREIIKL | GLLTVTSGAN | PVSVKRGIDK | TVQSLIEELE | KKARPVKGRD | 186 |
| SEQ_ID_NO_1061 | SVLAREIIKL | GLLSVTSGAN | PVSIKRGIDK | TVQGLVEELE | KKARPVKGRD | 186 |
| SEQ_ID_NO_1076 | SILAREIIKL | GLLNVTSGAN | PVSIKKGIDK | TVAALVEELE | KLARPVKGGD | 187 |
| SEQ_ID_NO_1092 | SILAREIIKL | GLLSVTSGAN | PVSIKKGIDK | TVAGLIEELE | KLARPVKGGD | 188 |
| SEQ_ID_NO_1074 | SVLAREIIKL | GLLSVTSGAN | PVSLKRGIDK | TVQGLVEELE | KKARPVKGGD | 184 |
| SEQ_ID_NO_1083 | SVLAREIIKL | GLLSVTSGAN | PVSLKRGIDK | TVQGLVEELE | KRARPVKGGD | 184 |

Figure 34 (continued)

| | | | | | | | |
|---|---|---|---|---|---|---|---|
| SEQ_ID_NO_1058 | EIAQVGTISA | NGEREGELI | AKAMEKVGKE | GVITISDGKT | LFNELEVVEG | 223 |
| SEQ_ID_NO_1077 | ELPDVAAVSA | GNNLEVGSMI | AEPMSTVGRK | GVVTLEEGKS | AENSLRVVEG | 245 |
| SEQ_ID_NO_1078 | ELADVAAVSA | GNNLEVGSMI | AEAMSKVGRK | GVVTLEEGKS | AENSLRVVEG | 245 |
| SEQ_ID_NO_1075 | HIKAVASISA | GNDEYVGNLI | AEAIEKIGFD | GVITIESSRS | SETSVVIEEG | 229 |
| SEQ_ID_NO_1095 | DIRAVASISA | GNNEEIGNMI | AEAIEKVGPD | GVLSIETGSG | LETVVEVEEG | 217 |
| SEQ_ID_NO_1055 | DIKNVASISA | GNDNAIGEMI | ADALDKVGSN | GVLSIETSNS | TETVVEVQEG | 225 |
| SEQ_ID_NO_1080 | DIKAIAAISA | GNDDFIGTMI | AEAINKVGPD | GVLSIESSSS | FETTVEVEEG | 238 |
| SEQ_ID_NO_1086 | DIKAVAAISA | GNDDFVGTMI | AEAIDKVGPD | GVLSIESSSS | FETTVEVEEG | 232 |
| SEQ_ID_NO_1085 | DIKAVAAISA | GNDEFVGTMI | AEAIDKVGPD | GVLSIESSSS | FETTVEVEEG | 233 |
| SEQ_ID_NO_1097 | DIKAVAAISA | GNDEFVGTMI | AEAIDKVGPD | GVLSIESSSS | FETTVEVEEG | 235 |
| SEQ_ID_NO_1054 | DIKAVASISA | GNDEFIGSMI | AEAIDKVGPD | GVLSIESSSS | FETTVEVEEG | 221 |
| SEQ_ID_NO_1088 | DIKAVASISA | GNDELIGSMI | ADAIDKVGPD | GVLSIESSSS | FETTVDVEEG | 227 |
| SEQ_ID_NO_1068 | DIRAVASISA | GNDDLIGSMI | ADAIDKVGPD | GVLSIESSSS | FETTVEVEEG | 236 |
| SEQ_ID_NO_1072 | DIKAVATISA | GNDELIGAMI | ADAIDKVGPD | GVSPIESSSS | FETTVEVEEG | 235 |
| SEQ_ID_NO_1057 | DIKAVASISA | GNDDLIGTMV | ADAIDKVGPD | GVLSIESSSS | FETTVDVEEG | 236 |
| SEQ_ID_NO_1061 | DIKAVASISA | GNDELIGTMI | ADAIDKVGPD | GVLSIESSSS | FETVVEVEEG | 236 |
| SEQ_ID_NO_1076 | DIKAVATISA | GNDELIGKMI | AEAIDKVGPD | GVLSIESSNS | FETTVEVEEG | 237 |
| SEQ_ID_NO_1092 | DIKAVASISA | GNDELIGKMI | AEAIDKVGPD | GVLSIESSSS | FETTVEVEEG | 238 |
| SEQ_ID_NO_1074 | DIKAVASISA | GNDELIGQMI | AEAIDKVGPD | GVLSIESSSS | FETTVEVEEG | 234 |
| SEQ_ID_NO_1083 | DIKAVASISA | GNDELIGKMI | AEAIDKVGPD | GVLSIESSSS | FETTVEVEEG | 234 |

| | | | | | | | |
|---|---|---|---|---|---|---|---|
| SEQ_ID_NO_1058 | MKLDRGYISP | YFITNQKNQK | CELDDPLILI | HEKKISSINS | VVKVLELALK | 273 |
| SEQ_ID_NO_1077 | MQFDRGYFAP | YFVTDSEKMS | VEYDNCKLLL | VDKKITNAKD | LVNVLKDAIR | 295 |
| SEQ_ID_NO_1078 | MQFDRGYVSP | YFVTDSEKMS | VEYENCKLLL | VDKKITNARD | LVNVLEDAIR | 295 |
| SEQ_ID_NO_1075 | MKIDRGYMSP | HFITNQEKSI | VEFDNAKVLV | TDQKISSVRE | IVPLLEKAMQ | 279 |
| SEQ_ID_NO_1095 | MEIDRGYISP | QFVNDNERLM | VEYEGCRILI | TDEKIEQVQM | LVPLLEEVSQ | 267 |
| SEQ_ID_NO_1055 | MEIDRGYISP | QFVTNQERLL | VEYDNCRVLV | TDQKIDAIRD | IIPILEQVTR | 275 |
| SEQ_ID_NO_1080 | MEIDRGYISP | QFVTNSEKSV | VEFENARVLV | TDQKISSIKE | ILPLLEQTTQ | 288 |
| SEQ_ID_NO_1086 | MEIDRGYISP | QFVTNPEKSL | VEFENARILV | TDQKISSIKE | IIPLLEQTTQ | 282 |
| SEQ_ID_NO_1085 | MELDRGYISP | QFVTNPEKST | VEFENARILV | TDQKISSIKE | ILPLLEQTTQ | 283 |
| SEQ_ID_NO_1097 | MELDRGYISP | QFVTNPEKST | VEFENARILV | TDQKISSIKE | IPLLEQTTQ | 285 |
| SEQ_ID_NO_1054 | MEIDRGYISP | QFVTNLEKSI | VEFENCKYLI | TDQKITSIKE | ILPILEKTTQ | 271 |
| SEQ_ID_NO_1088 | MEIDRGYISP | QFVTNLEKSI | VEFENAKVLI | TDQKITSIKE | ILPILEKTTQ | 277 |
| SEQ_ID_NO_1068 | MEIDRGYISP | QFVTNPEKLL | AEFENARVLI | TDQKITAIKD | IIPILEKTTQ | 286 |
| SEQ_ID_NO_1072 | MEIDRGYISP | QFVTNPEKLL | VEFENARVLI | TDQKITAIKD | IPILEKTTQ | 285 |
| SEQ_ID_NO_1057 | MEIDRGYISP | QFVTNPEKLI | CEFENARVLV | TDQKITAIKD | IPLLEKTTQ | 286 |
| SEQ_ID_NO_1061 | MEIDRGYISP | QFVTNPEKLI | CEFENARVLI | TDQKITAIKD | IPLLEKTTQ | 286 |
| SEQ_ID_NO_1076 | MEIDRGYISP | QFVTNPEKSI | VEFENARVLI | TDQKISAIKD | IPLLEKTTQ | 287 |
| SEQ_ID_NO_1092 | MEIDRGYISP | QFVTNLEKSI | VEFENARVLI | TDQKISAIKD | IPLLEKTTQ | 288 |
| SEQ_ID_NO_1074 | MEIDRGYISP | QFVTNPEKLI | VEFENARVLI | TDQKISAIKD | IPLLEKTTQ | 284 |
| SEQ_ID_NO_1083 | IEIDRGYISG | -FVTNLEKSI | VEFENARVLV | TDQKISAIKD | IPLLEKTTQ | 283 |

Figure 34 (continued)

| | | | | | | | |
|---|---|---|---|---|---|---|---|
| SEQ_ID_NO_1058 | RQ-RPLLIVS | EDVESDALAT | LILNKLRAG | KVCAIKAPGF | GENRKAGLHD | 322 |
| SEQ_ID_NO_1077 | NG-SPTLIIA | ENIDQEALAT | LVVNKLRGAL | KVAALKAPGF | GERKSQYLDD | 344 |
| SEQ_ID_NO_1078 | NG-YPILIIA | EDIEQEALAT | LVVNKLRGAL | KVAALKAPGF | GERKSQYLDD | 344 |
| SEQ_ID_NO_1075 | LS-APLLIIA | EDVTAQVLET | LIVNKMQGLL | RVAAVKCPGL | GDGKKALLQD | 328 |
| SEQ_ID_NO_1095 | AGSPPLLIIA | EDITGEALAT | LVVNKMRGVL | KVAAIKAPGF | GERRKALLQD | 317 |
| SEQ_ID_NO_1055 | LN-APLLIIA | EDVSGEALAT | LVVNKLRGVL | NVCAIKAPGF | GERRKSLLQD | 324 |
| SEQ_ID_NO_1080 | LR-APLLIIA | EDVSGEALAT | LVVNKLRGIL | NVAAIKAPGF | GERRKALLQD | 337 |
| SEQ_ID_NO_1086 | LR-APLLIIA | EDVAGEALAT | LVVNKLRGIL | NVAAIKAPGF | GERRKALLQD | 331 |
| SEQ_ID_NO_1085 | LR-APLLIIA | EDVSGEALAT | LVVNKLRGIL | NVAAIKAPGF | GERRKALLQD | 332 |
| SEQ_ID_NO_1097 | LR-APLLIIA | EDVSGEALAT | LVVNKLRGIL | NVAAIKAPGF | GERRKALLQD | 334 |
| SEQ_ID_NO_1054 | LR-APLFIA | EDITGEALAT | LVVNKLRGIL | NVAAIKAPSF | GERRKAVLQD | 320 |
| SEQ_ID_NO_1088 | LR-APLFIA | EDITGEALAT | LVVNKLRGIL | NVAAIKAPSF | GERRKAVLQD | 326 |
| SEQ_ID_NO_1068 | LR-APLLIIA | EDVTGEALAT | LVVNKLRGVL | NVVAVKAPGF | GERRKAMLQD | 335 |
| SEQ_ID_NO_1072 | LR-APLLIIA | EDVTGEALAT | LVVNKLRGVL | NVVAVKAPGF | GERRKAMLQD | 334 |
| SEQ_ID_NO_1057 | LR-APLLIIA | EDVTGEALAT | LVVNKLRGIL | NVAAIKAPSF | GERRKAVLQD | 335 |
| SEQ_ID_NO_1061 | LR-APLLIIA | EDVTGEALAT | LVVNKLRGVL | NVAAIKAPGF | GERRKAMLQD | 335 |
| SEQ_ID_NO_1076 | LR-APLLIIS | EDITGEALAT | LVVNKLRGIL | NVAAIKAPGF | GERRKALLQD | 336 |
| SEQ_ID_NO_1092 | LR-APLFIA | EDITGEALAT | LVVNKLRGIL | NVAAIKAPGF | GERRKALLQD | 337 |
| SEQ_ID_NO_1074 | LR-APLLIIA | EDVTGEALAT | LVVNKLRGIL | NVAAIKAPGF | GERRKALLQD | 333 |
| SEQ_ID_NO_1083 | LR-APLIIIA | EDVTGEALAT | LVVNKLRGIL | NVAAIKAPSF | GERRKAVLQD | 332 |

| | | | | | | | |
|---|---|---|---|---|---|---|---|
| SEQ_ID_NO_1058 | LAVLTGGQLI | TEELGMNLEK | VDLDMLGSCK | KITISKDDTV | ILDGAGDKKS | 372 |
| SEQ_ID_NO_1077 | IATLTGGTVI | REELGLTLDK | ADKEVLGHAA | KVMLTKDATT | VGDGSTQEA | 394 |
| SEQ_ID_NO_1078 | IATLTGGTVI | REELGLTLDK | ADKEVLGHAA | KVMLTKDATT | VGDGSTQEA | 394 |
| SEQ_ID_NO_1075 | IALMTGADFL | CGDLGLTLEG | TTSDQLGSAL | KVKITSNATT | FADPNTKAE | 378 |
| SEQ_ID_NO_1095 | IAIVTGAQYI | AKDLGLSVQR | ATMDSLGYAR | KVSIAQTTTT | LIADGASKED | 367 |
| SEQ_ID_NO_1055 | IAIVTGAEFL | AKDLGMKVEQ | AVVEQLGVAR | KVTVANNTTT | LIADAASKDE | 374 |
| SEQ_ID_NO_1080 | IAIVTGAEFQ | AKDLGQLIEQ | TTVEQLGIAR | KVTISGSSTT | IIADVATKDE | 387 |
| SEQ_ID_NO_1086 | IAIVTGAEFQ | AKDLGLLVES | TTVEQLGIAR | KVTISQSSTT | IIADVATKDE | 381 |
| SEQ_ID_NO_1085 | IAIVTGAEYQ | SKDLGLLVEK | TTVEQLGIAR | KVTISSSSTT | IIADAASKDD | 392 |
| SEQ_ID_NO_1097 | IAIVTGAEYQ | SKDLGLLVEN | TTVEQLGIAR | KVTISSSSTT | IIADAASKDD | 394 |
| SEQ_ID_NO_1054 | IAIVTGAEFL | AKDLGLLVEN | ATEEQLGTAR | KVTIHQTTTT | LIADAASKDE | 370 |
| SEQ_ID_NO_1088 | IAIVTGAEFL | AKDLGLLVEN | ATEEQLGTAR | KVTIHQTTTT | LIADAASKDE | 376 |
| SEQ_ID_NO_1068 | IAILTGAEYL | AMDMSLLVEN | ATIDQLGIAR | KVTISKDSTT | LIADAASKDE | 385 |
| SEQ_ID_NO_1072 | IAILTEPS-T | ALDMGLLVEN | TTIDQLGIAR | KVTISKDSTT | LIADAASKAE | 383 |
| SEQ_ID_NO_1057 | IAILTGAEFQ | ANDLGLLIEN | TSVEQLGIAR | KVITKDSTD | IIADAASKDE | 385 |
| SEQ_ID_NO_1061 | IAILTGAEFQ | ASDLGLSIEN | TSIEQLGLAR | KVTISKDSTT | IIADAASKDE | 385 |
| SEQ_ID_NO_1076 | IAILTGAEFQ | ASDLGLLVEN | TTIEQLGLAR | KVTISKDSTT | IIADAASKDE | 386 |
| SEQ_ID_NO_1092 | IAILTGAEYQ | ASDLGLLVEN | TSIEQLGLAR | KVTISKDSTT | IIADAASKDE | 387 |
| SEQ_ID_NO_1074 | IAILTGAEFQ | ASDLGLLVEN | TSVEQLGLAR | KITISKDSTT | VIADAATKDE | 383 |
| SEQ_ID_NO_1083 | IAILTGAEFQ | ASDLGLLVEN | TSIEQLGLAR | KVTISKDSTT | IIADAASKDE | 382 |

Figure 34 (continued)

| SEQ_ID_NO_1058 | EERCEQIRS | AIELSTSDYD | KEKLQERLAK | LSGGVAVLKI | GGASEAEVGE | 422 |
|---|---|---|---|---|---|---|
| SEQ_ID_NO_1077 | VNKRVAQIKN | LIEAADQDYE | KEKLNERIAK | LSGGVAVIQV | GAQTETELKE | 444 |
| SEQ_ID_NO_1078 | VNKRVAQIKN | LIEAADQDYE | KEKLNERIAK | LSGGVAVIQV | GAQTETELKE | 444 |
| SEQ_ID_NO_1075 | IQARILQIKK | DLIETDNANH | SRKLSERIAK | LTGGIAVIKV | GAHITELELED | 428 |
| SEQ_ID_NO_1095 | DMRVAQLKQ | ELAETDSVYD | TEKLSERIAK | LAGGVAVIKV | GAATETEMEE | 417 |
| SEQ_ID_NO_1055 | EMRIAQLKK | ELAETDSVYD | TEKLSERIAK | LSGGVAVIKV | GAATEAELED | 424 |
| SEQ_ID_NO_1080 | IQARIAQLKR | ELSQTDSTYD | SEKLAERIAK | LSGGVAVIKV | GAATETELED | 437 |
| SEQ_ID_NO_1086 | IQARIAQLKR | ELSQTDSAYD | SEKLAERIAK | LSGGVAVIKV | GAATETELED | 431 |
| SEQ_ID_NO_1085 | IQARIAQLKR | ELSQTDSTYD | SEKLAERIAK | LSGGVAVIKV | GASTEAELED | 432 |
| SEQ_ID_NO_1097 | IQARIAQLKR | ELSQTDSAYD | SEKLAERIAK | LSGGVAVIKV | GASTEAELED | 434 |
| SEQ_ID_NO_1054 | IQARIAQLKK | ELAETDSVYD | TEKLAERIAK | LAGGVAVIKV | GAATETELED | 420 |
| SEQ_ID_NO_1088 | IQARVAQLKK | ELSETDSIYD | TEKLAERIAK | LSGGVAVIKV | GAATETELED | 426 |
| SEQ_ID_NO_1068 | LQARIAQLKK | ELFETDSVYD | SEKLAERIAK | LSGGVAVIKV | GAATETELED | 435 |
| SEQ_ID_NO_1072 | LQARISQLKK | ESFETDSVYD | SEKLAERIAK | LSGGVAVIKV | GAATETELED | 433 |
| SEQ_ID_NO_1057 | LQARVQLKK | ELAETDSVYD | TEKLAERIAK | LSGGVAVIKV | GAATETELED | 435 |
| SEQ_ID_NO_1061 | LQARIAQLKK | ELSETDSVYD | SEKLAERIAK | LSGGVAVIKV | GAATETELED | 435 |
| SEQ_ID_NO_1076 | LQSRVAQLKK | ELSETDSIYD | SEKLAERIAK | LSGGVAVIKV | GAATETELED | 436 |
| SEQ_ID_NO_1092 | LQSRVAQLKK | ELSETDSVYD | SEKLAERIAK | LSGGVAVIKV | GAATETELED | 437 |
| SEQ_ID_NO_1074 | LQARVAQLKK | ELSQTDSVYD | TEKLAERIAK | LSGGVAVIKV | GAATETELED | 433 |
| SEQ_ID_NO_1083 | LQARVAQLKK | ELAETDAVYD | SMKLAERITK | LSGGVAVIKV | GAATETELED | 432 |

| SEQ_ID_NO_1058 | KKDRVTDALN | ATKAAVEEGI | VPGGGVALLY | ASKELDKLL- | STANFDQKIG | 470 |
|---|---|---|---|---|---|---|
| SEQ_ID_NO_1077 | KKLRVEDALN | ATKAAVERGI | VVGGGCTLLR | LAAKVDAIKG | TLANDEEKVG | 494 |
| SEQ_ID_NO_1078 | KKLRVEDALN | ATKAAVEEGI | VVGGGCTLLR | LAAKVDAIKG | TLANDEEKVG | 494 |
| SEQ_ID_NO_1075 | RKLRIEDAKN | ATFAAINEGL | VPGGGATYVH | LDLIPAIKN | SMEDLDEQIG | 478 |
| SEQ_ID_NO_1095 | RKLRIEDAKN | ATFAAVEEGI | VPGGGAALVH | LSKMDEFIP | TLTSAEERLG | 467 |
| SEQ_ID_NO_1055 | RKLRIEDAKN | ATFAAVEEGI | VPGGGAALLH | LSELVPAFKE | TLTDAEEKLG | 474 |
| SEQ_ID_NO_1080 | RKLRIEDAKN | ATFAAIEEGI | VPGGGAAYVH | LSTFVPAIKE | KLDDPEERLG | 487 |
| SEQ_ID_NO_1086 | RKLRIEDAKN | ATFAAIEEGI | VPGGGAAYVH | LSKFVPAIKE | KLDDPEERLG | 481 |
| SEQ_ID_NO_1085 | RKLRIENAKN | ATFAAIEEGI | VPGGGAAYVH | LSTFVPAIKE | KLDDPEERLG | 482 |
| SEQ_ID_NO_1097 | RKLRIEDAKN | ATFAAIEEGI | VPGGGAAYVH | LSTFVPAIKE | TLDDPEERLG | 484 |
| SEQ_ID_NO_1054 | RQLRIEDAKN | ATFAAIEEGI | VPGGGAAYVH | LSTVVPKIKE | AIEDPDERLG | 470 |
| SEQ_ID_NO_1088 | RQLRIEDAKN | ATFAAIEEGI | VPGGGTAYVH | LSTTVPAIKE | TIEDHDERLG | 476 |
| SEQ_ID_NO_1068 | RKLRIEDAKN | ATFAAIEEGI | VPGGGAALVH | LSTVIPAIKE | TFEDADERLG | 485 |
| SEQ_ID_NO_1072 | RKLRIEDAKN | ATFAAIEEGI | VPGGGATLVH | LSTVIPAIKE | TFEDADVRLG | 483 |
| SEQ_ID_NO_1057 | RKLRIEDAKN | ATFAAIEEGI | VPGGGAALVH | LSTCVPAIKD | KLEDPEERIG | 485 |
| SEQ_ID_NO_1061 | RKLRIEDAKN | ATFAAIEEGI | VPGGGAALVH | LSTCVPAIKD | KIEDADERLG | 485 |
| SEQ_ID_NO_1076 | RKLRIEDAKN | ATFAAIEEGI | VPGGGTALVH | LSGYVPAIKE | KLEDADERLG | 486 |
| SEQ_ID_NO_1092 | RKLRIEDAKN | ATFAAIEEGI | VPGGGTALVH | LSAYVPAIKE | KLEDADERLG | 487 |
| SEQ_ID_NO_1074 | RKLRIEDAKN | ATFAAIEEGI | VPGGGTALVH | LSTHVPAIKD | KLEDADERLG | 483 |
| SEQ_ID_NO_1083 | RKLRIEDAKN | ATFIAIEVGI | VL-VDTALLH | LSTHVPAIKD | KLEDADERLG | 480 |

Figure 34 (continued)

| | | | | | | | |
|---|---|---|---|---|---|---|---|
| SEQ_ID_NO_1058 | VQIQNALKT | PVHTIASNAG | VEGAVVVGKL | LEDDNPDLGY | DAAKGEYVDM | | 520 |
| SEQ_ID_NO_1077 | ADIVQRALSY | PLKLIAKNAG | VNGSVVSEKV | LSSDDPKFGY | NAATGNYEDL | | 544 |
| SEQ_ID_NO_1078 | ADIVKRALSY | PLKLIAKNAG | VNGSVVSEKV | LSSDDPKFGY | NAATGNYEDL | | 544 |
| SEQ_ID_NO_1075 | ADIVAKALVE | PAKSIAANAG | VDGDVVVEKT | RTFID-VRIGY | NAMTGTYEDL | | 527 |
| SEQ_ID_NO_1095 | AEIVQKALLA | PCRLIGNNAG | VEGDVIVQHV | MEGD-FNYGY | DAMVGEYGDL | | 516 |
| SEQ_ID_NO_1055 | ADIVMKSLRA | PCRLIADNAG | VEGEVIVQRL | LGKP-FEVGY | NAMIDKVENL | | 523 |
| SEQ_ID_NO_1080 | ADIIQKALVA | PASLIAHNAG | VEGEVIVEKI | KDSE-MEFGY | NAMTDKHENL | | 536 |
| SEQ_ID_NO_1086 | ADIIQKALVA | PAALIAHNAG | VEGEVIVEKI | KESE-MEVGY | NAMADRHENL | | 530 |
| SEQ_ID_NO_1085 | ADIIQKALVA | PAALIAHNAG | VEGEVIVDKI | KESE-MEYGY | NAMADKHENL | | 531 |
| SEQ_ID_NO_1097 | ADIIQKALVA | PAALIAHNAG | VEGEVIVDKI | RESE-MEFGY | NAMADKHENL | | 533 |
| SEQ_ID_NO_1054 | ADIIQKALVA | PASLIAHNAG | VEGEVVVEKI | KOSD-MEVGY | NAMTDKYENL | | 519 |
| SEQ_ID_NO_1088 | ADIIQKALVA | PASLIAHNAG | VEGEVVVEKI | KDGE-MEVGY | NAMNDKYENL | | 525 |
| SEQ_ID_NO_1069 | ADIVQKALLS | PAALIAQNAG | VEGEVVVEKI | MFSD-MENGY | NAMTDTYENL | | 534 |
| SEQ_ID_NO_1072 | ADIVQKALVA | Q-SLIAQNAG | IEGEVVVEKI | MFSE-MELGY | NAMTDTYENL | | 531 |
| SEQ_ID_NO_1057 | ADIVQKALVA | PASLIAQNAG | MEGEVVVEKV | KNSE-MEIGY | NAMTDTYENL | | 534 |
| SEQ_ID_NO_1061 | ADIVQKALYS | PASLIAQNAG | IEGEVVVEKL | KASE-MEIGY | NAMTDKYENL | | 534 |
| SEQ_ID_NO_1076 | ADIVQKALVA | PAALIAQNAG | IEGEVVVEKI | KNGE-MEVGY | NAMTDTYENL | | 535 |
| SEQ_ID_NO_1092 | ADIVQKALVA | PASLIAQNAG | IEGEVVVEKI | RNGE-MEVGY | NAMTDTYENL | | 536 |
| SEQ_ID_NO_1074 | ADIVQKALIA | PAALIAQNAG | IEGEVVVEKI | KSGE-MEVGY | NAMADRYENL | | 532 |
| SEQ_ID_NO_1083 | ADIVQKALIA | PASLIAQNAG | IEGEVVVEKV | KNGE-MEVGY | NAMTDRYENL | | 529 |
| | | | | | | | |
| SEQ_ID_NO_1058 | -IKAGIIDPL | KVIRTALVDA | ASVSSLMITT | EAIVVELPKD | E---KEVPA | | 565 |
| SEQ_ID_NO_1077 | IMAAGIIDPT | KVWRCCLEHA | ASVAKTFLMS | DCVVVEIKEP | E---AAVAG | | 590 |
| SEQ_ID_NO_1078 | -MAAGIIDPT | KVWRCCLEHA | ASVAKTFLMS | DCVVVEIKEP | E---AAVAG | | 589 |
| SEQ_ID_NO_1075 | -LNAGVADPS | RVARCALQSA | VSIAGVVLTT | QAILVDKYL- | -----GSN-K | | 569 |
| SEQ_ID_NO_1095 | -IEKGVIDPK | KVTRSGVQNS | CSIAGMVLTT | QAVITEIPKK | KRAIGANAGP | | 565 |
| SEQ_ID_NO_1055 | -LDAGVIDPA | KVTRNGLLNS | VSIAGIMLTT | QAVMVEKHKP | SEIPGGMT-A | | 571 |
| SEQ_ID_NO_1080 | -VEAGVIDPA | KVTRCALQNA | ASVAGMVLTT | QAIVVEKPSK | K---APA-P | | 580 |
| SEQ_ID_NO_1086 | -VQAGVIDPA | KVTRCALQNA | ASVAGMVLTT | QAIVVEKPKK | K---ASA-A | | 574 |
| SEQ_ID_NO_1085 | -VEAGVIDPA | KVTRCALQNA | ASVAGMVLTT | QAIVVEKPKK | K---APA-A | | 575 |
| SEQ_ID_NO_1097 | -VEAGVIDPA | KVTRCALQNA | ASVAGMVLTT | QAIVVEKPQK | -----APA-A | | 576 |
| SEQ_ID_NO_1054 | -MEAGVIDPA | KVTRCALQNA | ASVAGMVLTT | QAIVVEKPKP | K---PQV-A | | 563 |
| SEQ_ID_NO_1088 | -IEAGVIDPA | KVTRCALQNA | ASVAGMVLTT | QAIVVEKPKP | K---APV-A | | 569 |
| SEQ_ID_NO_1069 | -FEAGVIDPA | KVTRCALQNA | ASVAGMVLTT | QAIVVDKPKP | K---APA-A | | 578 |
| SEQ_ID_NO_1072 | -LEAGVIDPA | KVTRCALQNA | ASVAGMVLTT | QAIVVDKPKP | K---APA-A | | 575 |
| SEQ_ID_NO_1057 | -LAAGVIDPA | KVTRCALQNA | ASVAGMVLTT | QAIVVEKAKP | K---APA-A | | 578 |
| SEQ_ID_NO_1061 | -MEAGVIDPA | KVTRCALQNS | ASVAGMVLTT | QAIVVEKPKP | K---TPA-A | | 578 |
| SEQ_ID_NO_1076 | -VESGVIDPA | KVTRCALQNA | ASVAGMVLTT | QAIVVEKPKP | K---AAV-A | | 579 |
| SEQ_ID_NO_1092 | -IESGVIDPA | KVTRCALQNA | ASVAGMVLTT | QAIVVEKPKP | R---APV-P | | 580 |
| SEQ_ID_NO_1074 | -VEAGVIDPA | KVTRCALQNA | ASVAGMVLTT | QAIVVEKPKP | K---APV-A | | 576 |
| SEQ_ID_NO_1083 | -VEAGVIDPA | KVTRCALQNA | ASVAGMVLTT | QAIVVEKPKP | K---APT-A | | 573 |

Figure 34 (continued)

| SEQ_ID_NO_1058 | MGGGMGGMDY | | 575 |
|---|---|---|---|
| SEQ_ID_NO_1077 | NPMDNSGYGY | | 600 |
| SEQ_ID_NO_1078 | NPMDNSGYGY | | 599 |
| SEQ_ID_NO_1075 | NALTNGKVTV | AVSYSWGMMK PMYYKA | 595 |
| SEQ_ID_NO_1095 | MADEEGNFSL | | 575 |
| SEQ_ID_NO_1055 | SGMPSG-MTI | | 580 |
| SEQ_ID_NO_1080 | AGMPQGMM- | | 588 |
| SEQ_ID_NO_1086 | SGAPEGSLAM | | 584 |
| SEQ_ID_NO_1085 | AGAPEGSFAM | | 585 |
| SEQ_ID_NO_1097 | AAAP- | | 580 |
| SEQ_ID_NO_1054 | -EPPEGALTV | | 572 |
| SEQ_ID_NO_1088 | -EPAEGTLTV | | 578 |
| SEQ_ID_NO_1068 | -AAPEG-LMV | | 586 |
| SEQ_ID_NO_1072 | -AAPEG-LMV | | 583 |
| SEQ_ID_NO_1057 | -AAPEG-LTI | | 586 |
| SEQ_ID_NO_1061 | -AATQGQYAV | | 587 |
| SEQ_ID_NO_1076 | -AAPQG-LTI | | 587 |
| SEQ_ID_NO_1092 | -GAPQG-LTV | | 588 |
| SEQ_ID_NO_1074 | -GAPQG-LTV | | 584 |
| SEQ_ID_NO_1083 | -AAPQG-LTI | | 581 |

Figure 35

| | | | | | | |
|---|---|---|---|---|---|---|
| SEQ_ID_NO_1106 | MAELNVAPSP | PPSTILTLED | MLRKLPLPSD | ETIRSPATTK | MCKIVSHRSS | 50 |
| SEQ_ID_NO_1105 | ---------- | ---------- | ---------- | ---------- | ---------M | 1 |
| SEQ_ID_NO_1108 | ---------- | ---------- | ---------- | ---------- | ------MREY | 4 |
| SEQ_ID_NO_1109 | --MAAVAPIA | MPARVHHHHH | HHRRALAASP | AALAAAGNGL | SATRRVRRSP | 48 |
| SEQ_ID_NO_1101 | ---------- | ------MPFA | SSSSLIKRRP | LL-------- | ------RHAN | 20 |
| SEQ_ID_NO_1099 | ---------- | ---------- | MTRHVILTSE | E--------- | ------RNSP | 15 |
| SEQ_ID_NO_1103 | ---------- | ---------- | MTRHVILKSP | LLVSSEESTM | ------RNSP | 24 |

| | | | | | | |
|---|---|---|---|---|---|---|
| SEQ_ID_NO_1106 | PRHPTTKANK | G------FQC | AEVAGGTTAG | CAALVCC-PC | GIVGLLVLAT | 93 |
| SEQ_ID_NO_1105 | TRQNQLQNRR | R------SV | GEVAGNAIAE | CAAICCCVPC | AVVDMVALAT | 44 |
| SEQ_ID_NO_1108 | GRGHEEEEGE | E--HEPQPGC | GEGACDAAAN | CAAVCCCCPL | ALLDVLLLVT | 52 |
| SEQ_ID_NO_1109 | AVEMRRERER | RRAREQQPRC | GEVAGGTAAE | CAAVFCCFPE | AVVELVVLAA | 98 |
| SEQ_ID_NO_1101 | SSGSSCCSGR | F--------- | GEIAGGTTAE | CAAICCCCPC | GLVNLLVLTI | 61 |
| SEQ_ID_NO_1099 | PTTMIKHAER | R------KV | GEVAGGAAAE | CAAVMCCGPC | AVVNLVVLAV | 58 |
| SEQ_ID_NO_1103 | PSTTSLSKER | R------KV | GEVAGGAAAE | CAAVMCCCPC | AVVNLMVLAV | 67 |

| | | | | | | |
|---|---|---|---|---|---|---|
| SEQ_ID_NO_1106 | VKLPAGLCRR | ALSQKRRKRV | KKR------- | ------STTL | RSRAMSFVSD | 130 |
| SEQ_ID_NO_1105 | YKVPASLKKK | AAINNRKKRL | LKQ------- | ---------- | MKKDMKNFLE | 77 |
| SEQ_ID_NO_1108 | VKLPAGVMRR | VRRRRRHRD | RVS----RK | KRSAAAAVE | PADPSGSSGK | 97 |
| SEQ_ID_NO_1109 | VRAPAALCRR | AVRGGRRRRV | RST----KP | KETGAMDIAS | PRSLAAAAAK | 143 |
| SEQ_ID_NO_1101 | YKIPAGICRR | ALKRKQRKKL | IKKGLFPPRG | RGYGCGSCDD | PELHIHPMAR | 111 |
| SEQ_ID_NO_1099 | YRVPAAVCKK | AMRQTKRQRF | MRR----RH | GLLASAAA-- | -ESTVHARLK | 100 |
| SEQ_ID_NO_1103 | YKVPAAVCKK | AVRRSKRRRF | TRK----RH | GLLASATAEG | SESTVHARLN | 112 |

| | | | | | | |
|---|---|---|---|---|---|---|
| SEQ_ID_NO_1106 | DEDFGVPSFV | PRTPETWPSK | SPSVEVAEK- | EEEMW-AEFY | SAGFWRSPSQ | 178 |
| SEQ_ID_NO_1105 | HEKPGGP--G | PETVVVGPTM | EELLAQEELP | EEDLW-ARFS | VNGFWRSSSS | 124 |
| SEQ_ID_NO_1108 | AMIGAAP--S | PLEAEEEEAR | GEAAAAAEL- | EREIMSSRFY | GAGFWRSVSS | 144 |
| SEQ_ID_NO_1109 | ARKVDAD--F | PAT---PKA | EHLVDM-- | EKEVW-ASFY | GGGFWRSPSQ | 182 |
| SEQ_ID_NO_1101 | VEDSLRE--F | DGE-E-AVKK | EEL-AMLRL- | EKEMW-ETFY | GTGFWRSPSQ | 153 |
| SEQ_ID_NO_1099 | EEDPTAE--I | VFE-E-NVVN | VELNDVVVL- | EDEMF-ERFY | GAGFWRSPSQ | 144 |
| SEQ_ID_NO_1103 | EEDLTAE--I | VFE-ECHVSG | GELNDVVRL- | ENEML-DRFY | GAGFWRSPSQ | 157 |

Figure 35 (continued)

```
SEQ_ID_NO_1106   ---------- KESN- -----  ----------  ----------  ---   182
SEQ_ID_NO_1105   -----QKHEP DELQTGEN--  ----------  ----------  -NR   139
SEQ_ID_NO_1108   ---------- GCSSSASMRY  Q---------  ----------  ---   155
SEQ_ID_NO_1109   REDRRCIAAG DGAAAAALFF  FSFTTVVGFL  AFLLPFLGKR  EDR   225
SEQ_ID_NO_1101   RELPAKRSSP RETPNARL--  ----------  ----------  ---   171
SEQ_ID_NO_1099   ---------- RDTSSGSI--  ----------  ----------  ---   152
SEQ_ID_NO_1103   ---------- KDTSSGSL--  ----------  ----------  ---   165
```

Figure 36

| | | |
|---|---|---|
| SEQ_ID_NO_1112 | MAQNKMVMV LLSTFLVMA RSLWPEEPS NADD-FRGAC IEECTKEFNK | 48 |
| SEQ_ID_NO_1113 | MAQNKTIAVA LLLATLVAV- ----MGKEPE TLEETLRAGC KEECSEQKKK | 45 |
| SEQ_ID_NO_1114 | MAQNKTIAVA LLLATLVAV- ----MGKEPE TLEEAVRAGC KEECSEQKKK | 45 |

| | | |
|---|---|---|
| SEQ_ID_NO_1112 | APGDKKTCEV LC--------  ---------- ---------- ---------T | 61 |
| SEQ_ID_NO_1113 | APIDEKQCED FCFIKTKSIF EAHKGVKDLK ADRFIDFCNN ECNAVYKEDP | 95 |
| SEQ_ID_NO_1114 | APIDEKQCED FCFIKTKSIF EAHKGVKDLK ADRFIDFCNN ECNAVYKEDP | 95 |

| | | |
|---|---|---|
| SEQ_ID_NO_1112 | KLTKKPSEEG KHD------- ---------- ---- | 74 |
| SEQ_ID_NO_1113 | ATSKKCAESC EADAKEAEVF LDKVVAYMQT MKQA | 129 |
| SEQ_ID_NO_1114 | ATSKKCAESC EADAKEAEVF LDKVVAYIQT TKQA | 129 |

Figure 37

```
SEQ_ID_NO_1138   M--KRSREA EEEEEQAA-- --GAELLLLL SL-SRGDKPA- ----------  32
SEQ_ID_NO_1141   M-----TKH PRDGEVIS-- --LSLSLTLG AAADSGERK-  ----------  29
SEQ_ID_NO_1143   -MAMKR-MRS EDIVGDKDSL DDMAKCLMLL S--HGGGLT-  ----------  35
SEQ_ID_NO_1120   MLLSKVGQAD HEILTNYR-- --SAAAAAAA A--TAGA---  ----------  31
SEQ_ID_NO_1147   MAKRERAAWE VEAGAAAD-- --TARLLMLL A--QAQQHL   LQQHAHHHHH  44
SEQ_ID_NO_1132   -----MAMKR QRSNEGID-- --YANCLMLL S--CPQQ---  ----------  26
SEQ_ID_NO_1134   MSAMKR-SRE DRQVEAAA-- --MANCLMLL S--KLNDKS-  ----------  32
SEQ_ID_NO_1136   ---------- ---------- --MARILLLF SGHHQHHAH-  ----------  17
SEQ_ID_NO_1145   ---------- ---------- --MPMPMPVA A--RGHR---  ----------  13
SEQ_ID_NO_1144   MVAI---SE  KSTVETTA-- --AANCLMLL S--RVGQEN-  ----------  30
SEQ_ID_NO_1116   MVAI---SE  NPTVEAT--- --AANCLMLL S--RVGQK--  ----------  28
SEQ_ID_NO_1123   MVAI---SE  KSTVDVT--- --AANCLMLL S--RVGQEN-  ----------  29
SEQ_ID_NO_1140   -MTIKRSWED DREVENLA-- --MANCLMLL S--RVGQS--  ----------  31
SEQ_ID_NO_1133   MWMININPMKR TREANDFDSI TTMANCLMLL SQNRSGEFI-  ----------  39
SEQ_ID_NO_1118   -------MKR GRDIDAMD-- --MADCLMLL S--RVGET--  ----------  25
SEQ_ID_NO_1129   -------MKR GREESKLD-- --MANCLMLL T--KVGES--  ----------  25

SEQ_ID_NO_1138   ------TVRK K---VRAAEG ---VFECKIC SRQFPTFQAL GGHRISHNRP  70
SEQ_ID_NO_1141   ------KPRR GSSPAASGSG ---DFVCKTC SRAFPSFQAL GGHRTSHLRG  70
SEQ_ID_NO_1143   ------TDTK ----PKTCPH PVDVFECKTC NRQFSSFQAL GGHRASHKRP  75
SEQ_ID_NO_1120   ---------- ----GAGAGR ---SFSCKTC NKNFPSFQAL GGHRASHKKP  64
SEQ_ID_NO_1147   HHHGVGVPPF PAGRAAVHGR ---VFECKTC SRQFPTFQAL GGHRASHKRP  91
SEQ_ID_NO_1132   ---------- ----KSYENG ---EVECKTC NKKFSSFQAL GGHRASHKRM  59
SEQ_ID_NO_1134   ------TSTT TT--NQDHHN ---DFECKTC NKRFSSFQAL GGHRASHKRP  71
SEQ_ID_NO_1136   ------YG-- ----PSSPER ---VFECKTC NRRFPSFQAL GGHRASHKKP  52
SEQ_ID_NO_1145   ---------- -------APER ---VFVCKTC DRVFPSFQAL GGHRASHKKP  44
SEQ_ID_NO_1144   ------VD-- ----GGSAKR ---VFTCKTC LKEFHSFQAL GGHRASHKKP  65
SEQ_ID_NO_1116   ---------- ----GGDQKR ---VFTCKTC LKEFHSFQAL GGHRASHKKP  61
SEQ_ID_NO_1123   ------VD-- ----GGDQKR ---VFTCKTC LKQFHSFQAL GGHRASHKKP  64
SEQ_ID_NO_1140   ---------- ----GSTPDR ---VFHCKTC DKEFKSFQAL GGHRASHKRP  64
SEQ_ID_NO_1133   ------DSTT SNSSNLNSNR ---VFECKTC NRQFPSFQAL GGHRASHKRP  80
SEQ_ID_NO_1118   ---------- ----DRVAGR ---VFACKTC NKKFSSFQAL GGHRASHKKP  58
SEQ_ID_NO_1129   ------ETNY PISKGSDIG- ---DFKCKTC NRRFSSFQAL GGHRASHKKP  65
```

Figure 37 (continued)

| | | | | | | |
|---|---|---|---|---|---|---|
| SEQ_ID_NO_1138 | RVDRS----- | -----TS--- | ---------- | ---------- | --RRSVHQCS | 85 |
| SEQ_ID_NO_1141 | RHGLA----L | GLAAATAKET | TKKVQEKPA- | ---------- | --AAATHECH | 103 |
| SEQ_ID_NO_1143 | RLMGE----- | -----EHKVD | RTKLCSSGN- | ---------- | --KPKMHECS | 102 |
| SEQ_ID_NO_1120 | KLKES----- | -----T---- | -GNLKLPNS  | PS-------- | --KPKTHQCS | 89 |
| SEQ_ID_NO_1147 | RVLQQQQLQQ | QQTVVADHAG | QLCLGRQPLQ | LPLPTTTTPQ | QAKPRVHECP | 141 |
| SEQ_ID_NO_1132 | KLAEG----- | ---------- | -EELKEQAKS | LSLWN----- | --KPKMHECS | 86 |
| SEQ_ID_NO_1134 | KLLIG----- | -----A---- | -GEFLVQPS- | ---------- | --SKKMHECS | 93 |
| SEQ_ID_NO_1136 | RLADG----- | ---------- | --AGAEPP-- | ---------- | --KPKVHGCS | 71 |
| SEQ_ID_NO_1145 | RLDDG----- | ---------- | -GDL------ | ---------- | --KPKLHGCS | 60 |
| SEQ_ID_NO_1144 | NNENL----- | -----S---- | -GLMKKTK-- | ---------- | --ASSSHPCP | 88 |
| SEQ_ID_NO_1116 | NNNES----- | ---------L | SGLVKKAK-- | ---------- | --APSSHPCP | 93 |
| SEQ_ID_NO_1123 | NNDAL----- | -----SS--- | -GLMKKV--- | ---------- | --KTSSHPCP | 85 |
| SEQ_ID_NO_1140 | KTSDG----- | ---------- | -SEARTPP-- | ---------- | --KPKTHECP | 84 |
| SEQ_ID_NO_1133 | RLGGD----- | ---------- | -LTLSQIPVA | AA-------- | --KPKTHECS | 104 |
| SEQ_ID_NO_1118 | KLTVG----- | -----DN--- | -EGLAVSP-- | ----K----- | --KPKTHECS | 61 |
| SEQ_ID_NO_1129 | KLMVT----- | -----DL--- | -SCHQELPNP | TMKQ------ | --QPRMHPCP | 93 |

| | | | | | | |
|---|---|---|---|---|---|---|
| SEQ_ID_NO_1138 | ICGVEFAMGQ | ALGGHMRRHK | PMAEDSKRSD | PKK------- | ---------- | 118 |
| SEQ_ID_NO_1141 | CGQGFEMGQ | ALGGHMRRHR | EEAAAAAAV | H--------- | ---------- | 134 |
| SEQ_ID_NO_1143 | LCGQKFSMGQ | ALGGHMRRHR | A--NEGLSSI | MNPLDHA--- | -------KVPM | 141 |
| SEQ_ID_NO_1120 | CGLEFPLGQ | ALGGHMRRHR | APNNVDTTST | SSKDHELAVT | QPPFLPAVPV | 139 |
| SEQ_ID_NO_1147 | VCGLEFAVGQ | ALGGHMRRHR | AEAEAEATEA | PSKVMMR--- | --------PA | 180 |
| SEQ_ID_NO_1132 | CGMGFSLGQ | ALGGHMRKHR | AVINEGVSSI | NQIIEKF--- | --------PV | 125 |
| SEQ_ID_NO_1134 | CGMEFSLGQ | ALGGHMRRHR | AAIDEKSKAA | TKAMMIP--- | ----------V | 131 |
| SEQ_ID_NO_1136 | CGLEFAVGQ | ALGGHMRRHR | AVAAAGPGVG | LGLSLGL--- | --GLGPNEDG | 116 |
| SEQ_ID_NO_1145 | VCGLEFAIGQ | ALGGHMRRHR | AMAAGGGGGV | MPMTPPT--- | -----AAAIKE | 103 |
| SEQ_ID_NO_1144 | CGVEFPMGQ | ALGGHMRRHR | NEGG-GAGAL | VTRELLP--- | -----EAALMT | 128 |
| SEQ_ID_NO_1116 | CGVEFPMGQ | ALGGHMRRHR | NEIG-GGAAL | VTRALLP--- | -----EPTMTT | 125 |
| SEQ_ID_NO_1123 | CGVEFPMGQ | ALGGHMRRHR | NESGAAGGAL | VTRALLP--- | -----EPTVTT | 128 |
| SEQ_ID_NO_1140 | VCGLEFAIGQ | ALGGHMRRHR | DVGNEK--GG | RPVAARP--- | ---------- | 119 |
| SEQ_ID_NO_1133 | ICGLEFAIGQ | ALGGHMRRHR | AAMSDSASGN | SASPPRDDRT | VVVKKSNIV- | 153 |
| SEQ_ID_NO_1118 | ICGLEFAIGQ | ALGGHMRRHR | AALNDG---L | VTRDLLP--- | ---------E | 116 |
| SEQ_ID_NO_1129 | ICGLEFAIGQ | ALGGHMRKHR | TAINDGLLCG | KPSSSLS--- | ------ILKE | 134 |

Figure 37 (continued)

| | | | | | | | |
|---|---|---|---|---|---|---|---|
| SEQ_ID_NO_1138 | ·········· | ········ | M DLT MADPEF | ········ | G DL HR VR | ··· | 135 |
| SEQ_ID_NO_1141 | ·········· | ········ | ········ APPV | ········ | ········ | ··· | 138 |
| SEQ_ID_NO_1143 | LMKRSNS··· | ···TRVVCSL | DLN ·LTPL | ········ | E N ·DLK LF | | 170 |
| SEQ_ID_NO_1120 | LKRSNSS··· | ···KRVLC·L | DLS ALPMY· | ········ | Q NDSELQ LEK | | 171 |
| SEQ_ID_NO_1147 | HDKTCDV··· | ···AGGI C·L | DLN ·LTPS· | ········ | E NCAKCRSWV | | 211 |
| SEQ_ID_NO_1132 | LKRLNS··· | ···KRI MG·L | DLN ·LTPL | ········ | E ND·DLM·FG | | 153 |
| SEQ_ID_NO_1134 | LKKSNSS··· | ···KRI FC·L | DLN ·LTPR· | ········ | N EDVDLK LWP | | 161 |
| SEQ_ID_NO_1136 | NKKAAA··· | ···AAEL A·L | DLN ·EPAL | ········ | E EEPADR AML | | 145 |
| SEQ_ID_NO_1145 | HGESGDDDAV | VGMKRGL W·L | DLN ·HPPCD | EYGAGSESDD | ECGHVD· AAA | | 149 |
| SEQ_ID_NO_1144 | LKKSSS··· | ···GRLAC·L | DLS ·LGMV | ········ | E NL·NLK LEL | | 156 |
| SEQ_ID_NO_1116 | LKKSSSG··· | ···KRVAC·L | DLS ·LGMV | ········ | E NL·NLK LEL | | 154 |
| SEQ_ID_NO_1123 | LKKSSSG··· | ···KRVAC·L | DLS ·LGMV | ········ | D NL·NLK LEL | | 157 |
| SEQ_ID_NO_1140 | ···ESVT··· | ···KRGLF·M | DLN ·LTPL | ········ | E N ·DLK LWS | | 144 |
| SEQ_ID_NO_1133 | ··DDDND··· | ···RRVAG·L | DLN ·LTPF· | ········ | E N ·HLE FGL | | 179 |
| SEQ_ID_NO_1118 | MNKSTGD··· | ···GRDPS· | DLG ·LTSW· | ········ | G VDLELK L · | | 144 |
| SEQ_ID_NO_1129 | SSKDGDQ··· | ···KLNLR·L | DLN ·LTPL | ········ | E ED·DLK LNL | | 163 |

| | | | |
|---|---|---|---|
| SEQ_ID_NO_1138 | ·······RTG | SHCQL QL FV | 148 |
| SEQ_ID_NO_1141 | ·········· | ····LL EL FV | 144 |
| SEQ_ID_NO_1143 | ·······GKM | APKVDL RL M | 183 |
| SEQ_ID_NO_1120 | ·········· | VARPML RCFI | 181 |
| SEQ_ID_NO_1147 | LGAAAGQGVH | KTLAML DCSL | 231 |
| SEQ_ID_NO_1132 | ·······KSP | PTPI PL SL F | 165 |
| SEQ_ID_NO_1134 | ·······TAP | I SSPVL RI FI | 174 |
| SEQ_ID_NO_1136 | ·······GL A | VGFRPRGG·· | 156 |
| SEQ_ID_NO_1145 | AGYTFHQFMD | TGTMAV DCV· | 168 |
| SEQ_ID_NO_1144 | ·······GRP | VC········ | 161 |
| SEQ_ID_NO_1116 | ·······GRT | VC········ | 159 |
| SEQ_ID_NO_1123 | ·······GRT | VY········ | 162 |
| SEQ_ID_NO_1140 | ·······NTV | NTALAM ··· | 153 |
| SEQ_ID_NO_1133 | ·······GKI | APT··VDCFL | 190 |
| SEQ_ID_NO_1118 | ·······GKV | TPTPVHCFI | 157 |
| SEQ_ID_NO_1129 | ·········· | ·RTPVL NCFI | 172 |

Figure 38

| | | | | | | | |
|---|---|---|---|---|---|---|---|
| SEQ_ID_NO_1162 | MATKIFALLV | LLALSASATT | AVIIPQCSLA | PTAAIIPRFL | PPVSAIGFEH | | 50 |
| SEQ_ID_NO_1163 | MATKIFVLLA | LLALSVSTTT | AVIIPQCSLA | PNAFLISQFL | PPLTLVGFEH | | 49 |
| SEQ_ID_NO_1161 | MAAKIFAILA | LLALSASVAT | ATIIPQCSQF | ------QYL | SPVTAARFEY | | 42 |
| SEQ_ID_NO_1159 | MATKIFSLLM | LLALSACVAN | ATIFPQCSQA | PIASLLPPYL | PSMIASVCEN | | 50 |
| SEQ_ID_NO_1164 | MAAKIFCFLM | LLGLSASVAT | ATIFPQCSQA | PIASLLPPYL | SPAVSSMCEN | | 50 |

| | | | | | | | |
|---|---|---|---|---|---|---|---|
| SEQ_ID_NO_1162 | PAVQAYRLQQ | ALAASIL-- | ----QQPLAQ | LQQQSSAHLT | IQTIAAQQIQ | | 92 |
| SEQ_ID_NO_1163 | PALQAYRLQQ | ALANSIL-- | ----QQPFPQ | LQQQSSAHLT | VQTIAAQQQQ | | 92 |
| SEQ_ID_NO_1161 | PTIQSYRLQE | AIAASILRSL | ALTVQQPYAL | LQQPSLMNLY | LQRIAAQQLQ | | 92 |
| SEQ_ID_NO_1159 | PALQPYRLQQ | AIAASNIPLS | PLLFQQSPAL | ----SLVQSL | VQTIRAQQLQ | | 96 |
| SEQ_ID_NO_1164 | PIVQPYRIQQ | AIATGLPLS | PLFLQQPSAL | LQQLPLVHLV | AQNIRAQQLQ | | 100 |

| | | | | | | | |
|---|---|---|---|---|---|---|---|
| SEQ_ID_NO_1162 | QQFLPSLSQL | AAANPTAYLQ | QQLLASNPLA | VANAIAYHQ | QQLQQLLPAL | | 142 |
| SEQ_ID_NO_1163 | QQFLPALSQL | ALANPVAYLQ | QQLLASNPLA | LVNNAAYQ-Q | QQLQQVLPVI | | 141 |
| SEQ_ID_NO_1161 | QQLLPTINQV | VAANLAAYLQ | Q--------- | ---------- | ---QQFLP-F | | 119 |
| SEQ_ID_NO_1159 | QLVLPVINQV | ALANLSPYSQ | Q--------- | ---------- | ---QQFLP-F | | 123 |
| SEQ_ID_NO_1164 | -------QL | VLANLAAYSQ | Q--------- | ---------- | ---HQFLP-F | | 119 |

| | | | | | | | |
|---|---|---|---|---|---|---|---|
| SEQ_ID_NO_1162 | SQLAVANPAA | YLQ-SQLFPS | NPLV-ANAAA | YLQQQQLQQI | LPVLSQLAVA | | 190 |
| SEQ_ID_NO_1163 | SQVAMANPAA | YLQ-QQQLAY | NPLVAANAAA | YLQQQQLQQI | LPALSQLALV | | 190 |
| SEQ_ID_NO_1161 | NQLAGVNPAA | YLQAQQLLPF | NQLV-RSPAA | FLLQQQL--- | LP-FHLQVVA | | 164 |
| SEQ_ID_NO_1159 | NQLSTLNPAA | YLQ-QQLLPF | SQLA----TA | YSQQQQL--- | LP-FNQLAAL | | 164 |
| SEQ_ID_NO_1164 | NQLAALNSAA | YLQ-QQ-LPF | SQLV---AA | YP--RQF--- | LP-FNQLAAL | | 157 |

| | | | | | | | |
|---|---|---|---|---|---|---|---|
| SEQ_ID_NO_1162 | DPNSYL-QQQ | QLLPFNQVAV | ANNAVYEQQH | QLLQVNPLA- | -----AAFLQ | | 233 |
| SEQ_ID_NO_1163 | NPAAYL-QQQ | QLLPFNQLAV | TNTAAYLQQQ | QLLRVNPVVA | ANPLAAAFLQ | | 239 |
| SEQ_ID_NO_1161 | NIAAFLQQQQ | QLLPFYPQVV | GNINAFLQQQ | QLLPFYPQDV | ANN--VAFLQ | | 212 |
| SEQ_ID_NO_1159 | NPAAYL-QQQ | ILLPFSQLAA | ANRASFLTQQ | QLLPFYQQFA | ANP--ATLLQ | | 211 |
| SEQ_ID_NO_1164 | NSAAYL-QQQ | QLLPFSQLAD | VSPAAFLTQQ | QLLPFYLHAM | PNA--GTLLQ | | 204 |

| | | | | | |
|---|---|---|---|---|---|
| SEQ_ID_NO_1162 | QQQRQLLPFN | QMSLMNPALS | WQQPIVGGVG | F- | 264 |
| SEQ_ID_NO_1163 | QQ--QLLPFN | DISLMNPAFS | WQQPIVGSAI | F- | 268 |
| SEQ_ID_NO_1161 | QQ--QLLPFN | QLALTNPTTL | LQQPTIGGAI | F- | 241 |
| SEQ_ID_NO_1159 | LQ--QLLPFV | QLALTDRAAS | YQQHIIGGAL | F- | 240 |
| SEQ_ID_NO_1164 | LQ--QLLPFN | QLALTNSTVF | YQQPIIGGAL | FD | 234 |

Figure 39

| | | | | | | |
|---|---|---|---|---|---|---|
| SEQ_ID_NO_1167 | MAK------ | -NGINNSVAV | GIAVQSDWDN | RHFGSSLSLN | VRRLFEFLLQ | 42 |
| SEQ_ID_NO_1182 | MGR----GG | --GMGNPVNV | GIAVQADWGN | REFISNISLN | VRRLFDFLLR | 43 |
| SEQ_ID_NO_1166 | MGR----GG | --GMGNPVNV | GIAVQADWEN | REFISNISLN | VRRLFDFLLR | 43 |
| SEQ_ID_NO_1183 | MAR----AG | GHGMGNPVNV | GIAVQADWEN | REFISNISLN | VRRLFDFLLR | 45 |
| SEQ_ID_NO_1173 | MARAGGGGGG | GGGITNAVNV | GIAVQADWEN | REFISHISLN | IRRLFDFLIQ | 50 |
| SEQ_ID_NO_1169 | MSR----GG | GVGITNAVNV | GIAVQADWEN | REFISNISIN | VRRLFDFLIN | 45 |
| SEQ_ID_NO_1177 | MAR----AG | --GITNAVNV | GIAVQADWEN | REFISHISLN | VRRLFDFLVQ | 43 |
| SEQ_ID_NO_1180 | MAR----AG | --GITNAVNV | GIAVQADWEN | REFISHISLN | VRRLFDFLVQ | 43 |
| SEQ_ID_NO_1171 | MAR----AG | --GITNAVNV | GIAVQADWEN | REFISHISLN | VRRLFEFLLQ | 43 |
| SEQ_ID_NO_1175 | MAK----AG | --GITNAVNV | GIAVQADWEN | REFISHISLN | VRRLFEFLVQ | 43 |

| | | | | | | |
|---|---|---|---|---|---|---|
| SEQ_ID_NO_1167 | FESSTRSKLA | TLNEKLTVLE | RQLEFLEADF | STALINPV-- | -------- | 79 |
| SEQ_ID_NO_1182 | FEATTKSKLA | SLNEKLDILE | RKLEVLEVQV | SSATTNPSVF | N------- | 84 |
| SEQ_ID_NO_1166 | FEATTKSKLA | SLNEKLDILE | RKLEVLEVQV | GSATTNPSVF | N------- | 84 |
| SEQ_ID_NO_1183 | FEATTKSKLA | SLNEKLDILE | RKLEVLEVQV | SSATTNPSVF | N------- | 86 |
| SEQ_ID_NO_1173 | FESTTKSKLS | SLNLKLDTLE | RRLQLLELQV | STATSNPSLF | TSTTTTTA | 98 |
| SEQ_ID_NO_1169 | FEATTKSKLA | SLNEKLDTLE | RRLELLEVQV | GTASANPSLF | T------- | 86 |
| SEQ_ID_NO_1177 | FEATTKSKLA | SLNEKLDVLE | RRLELLEVQV | GNASANPSLF | AT------ | 85 |
| SEQ_ID_NO_1180 | FEATTKSKLA | SLNEKLDVLE | RRLELLEVQV | GNASANPSLF | AT------ | 85 |
| SEQ_ID_NO_1171 | FEATTKSKLA | SLNEKLDTLE | RRLELLEVQV | GTASANPSLF | ST------ | 85 |
| SEQ_ID_NO_1175 | FESTTKSKLA | SLNEKLDLLE | RRLEMLEVQV | STATANPSLF | AT------ | 85 |

Figure 40

```
SEQ_ID_NO_1187    MFSWLRGCR  DECSATDQLK  Q---------  ----------  A  RDVFVAKEAV   32
SEQ_ID_NO_1185    MFAWLRGCR  DECSASDQLK  Q---------  ----------  A  HDVFKAKEVV   32
SEQ_ID_NO_1189    MFSWLRGCR  DECSASDQLK  Q---------  ----------  A  RDVFMAKEAV   32
SEQ_ID_NO_1190    MFAWLRGCR  DECSASDQLK  QGVVKEKNRC  WFWGAFSVNA  A  RDVFVAKEAV   50
SEQ_ID_NO_1191    MFAWLRGCR  DECSASDQLK  Q---------  ----------  A  RDVFVAKEAV   32

SEQ_ID_NO_1187    LQKKISQEME  RAKEFKKSGN  KQAAMQCLKR  KRYYESQMNQ  VGSVRLRIDT   82
SEQ_ID_NO_1185    LQKKISQEVE  RAKEFTKSGN  KQAAMQCLKR  KRYYESQMNQ  VGSVQLRINT   82
SEQ_ID_NO_1189    LQKKISQEME  RAKEFTKSGN  KQAAMQCLKR  KKYYESQMSQ  VGSVQLRINT   82
SEQ_ID_NO_1190    LQKKISQEME  RAKEFTKSGN  KQAAMQCLKR  KKYYESQMNQ  VGSVQLRINT   100
SEQ_ID_NO_1191    LQKKISQEME  RAKEFTKSGN  KQAAMQCLKR  KKYYESQMNQ  VGSVQLRINT   82

SEQ_ID_NO_1187    KEKMIADNMV  N---K       94
SEQ_ID_NO_1185    KERMIADHTG  N---K       94
SEQ_ID_NO_1189    KEKMIADHMG  N---K       94
SEQ_ID_NO_1190    KEKMIADHSG  NKEDK       115
SEQ_ID_NO_1191    KEKMIADHSG  NKEDK       97
```

Figure 41

| | | | | | | | |
|---|---|---|---|---|---|---|---|
| SEQ_ID_NO_1204 | ········ MVK | TRAAATPR·· | ············ | ····· | PSGGG | GAGAADI TAG | 26 |
| SEQ_ID_NO_1203 | MGEQSLSDPK | PQPLSPFPSP | PASAAL···· | ····· | PPPAS | ASASASASAA | 41 |
| SEQ_ID_NO_1205 | MESPNPQQVN | SMGDQSPLSP | NLHPLS···· | ····· | PSPSA | AAAAAA···· | 37 |
| SEQ_ID_NO_1196 | MGEDTPSQPQ | PQVQSQPPND | SSTTTQAQVQ | NQSGDPSNTS | TAAVSTVTTA | 50 |
| SEQ_ID_NO_1202 | MGEQTLGQAQ | SLIEPQPL·· | ············ | ····· | PAPSS | TAVPDGATVD | 33 |
| SEQ_ID_NO_1194 | ···MSLRKTL | TAVNQSSL·· | ············ | ····· | PPDSL | ISAGNLTVSE | 30 |
| SEQ_ID_NO_1200 | MGKPVTRSHS | LLLHEPSS·· | ············ | ····· | PPLS· | ·········· | 22 |

| | | | | | | | |
|---|---|---|---|---|---|---|---|
| SEQ_ID_NO_1204 | ·········· | ·········· | ···· | KISFRS | RKIVKSTPAK | GKSVATTTTA | 52 |
| SEQ_ID_NO_1203 | ·········· | ·········· | ···S | TSRTTSAAAS | RPKKKVTN-P | SPDRNPAKKP | 71 |
| SEQ_ID_NO_1205 | ·········· | ·········· | ···T | PTPAAAASS | RSSRSKKPPH | SSDPNQSKKP | 68 |
| SEQ_ID_NO_1196 | CTAIVACGPT | ELVNVPLPTS | SPPSKIPSRP | RKIRKLSPDL | SFDPNASQQA | 100 |
| SEQ_ID_NO_1202 | ········S | ELNNVPRPTT | SPATKIPLRP | RKIRKVSPDP | STSESQTETP | 74 |
| SEQ_ID_NO_1194 | ·········· | ·······VS | GSSSRIRFRP | RKIRKVSSDP | SPRIIIASP | 62 |
| SEQ_ID_NO_1200 | ·········· | ·········· | ···T | TTSSKISFDS | RKIRKLSTNK | TTTTTAITS | 53 |

| | | | | | | | |
|---|---|---|---|---|---|---|---|
| SEQ_ID_NO_1204 | ·········· | ·VLS· | ····· | ·········· | ···PP····P | LSSPGELAAA | 68 |
| SEQ_ID_NO_1203 | ·········· | ·RLT· | ····· | ·········· | ···FSIPGRP | LSAVGEVGVA | 91 |
| SEQ_ID_NO_1205 | ·········· | ·RLT· | ····· | ·········· | ···LTVPGRP | LSADGEVAAA | 88 |
| SEQ_ID_NO_1196 | TTSSSTSLTE | QRKTVGRTSK | TKLSQHRALA | VVAPRIIARS | LSDEGEVETA | 150 |
| SEQ_ID_NO_1202 | ·········· | ·KPAKTGGRN | TTKAAPPRAL | TVVPRIVARS | LSQDGEVEIA | 113 |
| SEQ_ID_NO_1194 | ·········· | ·········· | ·········· | ·········· | ·······P | LSTKSTVDIA | 73 |
| SEQ_ID_NO_1200 | ·········· | ·TSI· | ····· | ·········· | ···PPL·-KP | LSHKGEIELA | 71 |

| | | | | | | | |
|---|---|---|---|---|---|---|---|
| SEQ_ID_NO_1204 | LSHLRTADPL | LSEVIASTGA | PAFISSPSRP | AFHSLAHSIL | HQQLAPSAAA | 118 |
| SEQ_ID_NO_1203 | IRYLRAADPA | LAAVIDAH-E | PPVFQCPHRP | -FHSLVRSIL | YQQLAFKAAA | 139 |
| SEQ_ID_NO_1205 | IQHLRAADPA | LATVIDAH-D | PPAFQCPHRP | -FHSLVRSIL | YQQLAFKAAA | 136 |
| SEQ_ID_NO_1196 | RHLRDADPL | LASLIDLH-P | PPTFDTFHAP | -FLALTRSIL | YQQLAFKAGT | 198 |
| SEQ_ID_NO_1202 | LRYLRNADPV | LSPLIDIH-Q | PPTFDNFHTP | -FLALTRSIL | YQQLAYKAGT | 161 |
| SEQ_ID_NO_1194 | LRHLQSSDE | LGALITTHND | PPVFDSSNTP | -FLSLARSIL | YQQLATKAAK | 122 |
| SEQ_ID_NO_1200 | LDHLSKSDPL | LAPLLNSH-E | PPALNPCTSP | -FLSLTKSIL | FQQLATNAAK | 119 |

Figure 41 (continued)

| | | | | | | | |
|---|---|---|---|---|---|---|---|
| SEQ_ID_NO_1204 | AIYARFLAL | PAAADPDAAV | VNPAAVLALS | AADLRAI GVS | ARKAAYLHDL | | 168 |
| SEQ_ID_NO_1203 | SVYSRFLALL | ----G-GESC | VAPDAVLALT | PHQLRQI GVS | PRKASYLHDL | | 184 |
| SEQ_ID_NO_1205 | SVYSRFLSLL | ----G-GEHN | VLPEAVLALT | TQDLRQI GVS | PRKASYLHDL | | 181 |
| SEQ_ID_NO_1196 | SIYTRFISLC | ----G-GENG | VVPETVLSLT | SQQLRQI GVS | GRKASYLHDL | | 243 |
| SEQ_ID_NO_1202 | SIYTRFIALC | ----G-GENG | VVPETVLALT | PQQLRQI GVS | GRKASYLHDL | | 206 |
| SEQ_ID_NO_1194 | CYDRFISLF | ----NGGEAG | VFPESVISLS | AVDLRKI GVS | GRKASYLHDL | | 168 |
| SEQ_ID_NO_1200 | SIYTRFLTLC | ----D-GESQ | VNPDTVLSLS | APKLREI GVS | GRKASYLHDL | | 164 |

| | | | | | | | |
|---|---|---|---|---|---|---|---|
| SEQ_ID_NO_1204 | AGRFAAGELS | ESAVAAMDEA | ALLAELTKVK | GVGEWTVHMF | MIFSLHRPDV | | 218 |
| SEQ_ID_NO_1203 | ARKYASGILS | DAAIVNMDDR | SLAAMLTMVK | GIGSWSVHMF | MIFSLARPDV | | 234 |
| SEQ_ID_NO_1205 | ARKYASGILS | DAAVVNMDDR | SLAAMLTMVK | GIGAWSVHMF | MIFSLNRPDV | | 231 |
| SEQ_ID_NO_1196 | ARKYQTGILS | DSAIVNMDDK | SLFTMLTMVN | GIGSWSVHMF | MIFSLHRPDV | | 293 |
| SEQ_ID_NO_1202 | ARKYQNGILS | DSAIVNMDDK | SLLTMLTMVN | GIGSWSVHMF | MIFSLHRPDV | | 256 |
| SEQ_ID_NO_1194 | ADKYNNGVLS | DELLKMSDE | ELIDRLTLVK | GIGVMTVHMF | MIFSLHRPDV | | 218 |
| SEQ_ID_NO_1200 | AEKYRNGSLS | DSSILEMNDD | MLLNRLTEVK | GIGVWSVHMF | MLFSLHRPDV | | 214 |

| | | | | | | | |
|---|---|---|---|---|---|---|---|
| SEQ_ID_NO_1204 | LPSGDLGVRK | GVQELYGLPA | LPKPEEMAAL | CERWRPYRSV | GAWYMWRLME | | 268 |
| SEQ_ID_NO_1203 | LPSADLGVRK | GVQMLYALED | VPRPSQMDKL | CERWRPYRSV | GAWYMWRLIE | | 284 |
| SEQ_ID_NO_1205 | LPAADLGVRK | GVQHLYGLDA | VPRPSQMEKL | CEQWRPYRSV | GAWYMWRLIE | | 281 |
| SEQ_ID_NO_1196 | LPINDLGVRK | GVQLLYNLEE | LPRPSQMDQL | CEKWRPYRSV | ASWYLWRYVE | | 343 |
| SEQ_ID_NO_1202 | LPINDLGVRK | GVQLLYNLED | LPRPSQMDQL | CDKWRPYRSV | ASWYMWREVE | | 306 |
| SEQ_ID_NO_1194 | LPVGDLGVRK | GVKDLYGLKN | LPGPLQMEQL | CEKWRPYRSV | GSWYMWRLIE | | 268 |
| SEQ_ID_NO_1200 | LPVGDLGVRK | GVQSLYGLKD | LPQALEMEQI | CEKWKPYRSV | GSWYMWRLME | | 264 |

| | | | | | | | |
|---|---|---|---|---|---|---|---|
| SEQ_ID_NO_1204 | SKGAAAKKAK | SNAIAFLPS- | --------SC- | ---------- | ---------- | | 289 |
| SEQ_ID_NO_1203 | SKVPQPAPAI | PVGSLAFPS- | ---------P | DGQSMLQQDE | QQQQQTVIQM | | 324 |
| SEQ_ID_NO_1205 | SKAPPPPPAI | PVGPPALTE- | -------HGD | ELMLQQQQHQ | QQQQQSVIQM | | 323 |
| SEQ_ID_NO_1196 | AKGAPSSAAA | VAAGASLPP- | ---------- | ----LQQQEE | PQQHQQQPPL | | 378 |
| SEQ_ID_NO_1202 | AKGTPSSAVA | VATGAGLQQQ | QHHQHHHQHQ | QQEQQQQQQQ | QQQHPPQPQL | | 356 |
| SEQ_ID_NO_1194 | SRKTK----- | ---------- | ---------- | ---------- | ---------- | | 273 |
| SEQ_ID_NO_1200 | AKALANKAAK | KA-------- | ---------- | ---------- | ---------- | | 276 |

Figure 41 (continued)

| | | | |
|---|---|---|---|
| SEQ_ID_NO_1204 | ---------- | -------- | 289 |
| SEQ_ID_NO_1203 | I DPL QML PGM G | ------ | 335 |
| SEQ_ID_NO_1205 | I DPL QML PGM G | ------ | 334 |
| SEQ_ID_NO_1196 | MDPI NSI LNL G | ACAWGQ | 395 |
| SEQ_ID_NO_1202 | LDPI NSMFNL G | AACAWGQ | 374 |
| SEQ_ID_NO_1194 | ---------- | -------- | 273 |
| SEQ_ID_NO_1200 | ---------- | -------- | 276 |

Figure 42

| | | | | | | | |
|---|---|---|---|---|---|---|---|
| SEQ_ID_NO_1241 | MFLVDWFYGV | LASLGLWQKD | AKILFLGLDN | AGKTTLLHML | KDERLVQHQP | 50 |
| SEQ_ID_NO_1229 | MFVDWFYGV | LASLGLWQKE | AKILFLGLDN | AGKTTLLHML | KDERLVQHQP | 50 |
| SEQ_ID_NO_1249 | MFLWDWFYGV | LASLGLWQKE | AKILFLGLDN | AGKTTLLHM | KDERLVQHQP | 50 |
| SEQ_ID_NO_1264 | ---MGIVFTR | LFSSVFGNRE | ARILVLGLDN | AGKTTILYRL | QMGEVVSTIP | 47 |
| SEQ_ID_NO_1251 | ---MGIVFTR | LFSSVFGNRE | ARILVLGLDN | AGKTTILYRL | QMGEVVSTIP | 47 |
| SEQ_ID_NO_1265 | ---MGIVFTR | LFSSVFGNRE | ARILVLGLDN | AGKTTILYRL | QMGEVVSTIP | 47 |
| SEQ_ID_NO_1253 | ---MGIVFTK | LFSSVFGNKE | ARILVLGLDN | AGKTTILYRL | QMGEVVSTIP | 47 |
| SEQ_ID_NO_1210 | ---MGILFTR | MFSSVFGNKE | ARILVLGLDN | AGKTTILYRL | QMGEVVSTIP | 47 |
| SEQ_ID_NO_1267 | ---MGILFTR | MFSSVFGNKE | ARILVLGLDN | AGKTTILYRL | QMGEVVSTIP | 47 |
| SEQ_ID_NO_1213 | ---MGILFTK | MFSNLFGNRE | ARILVLGLDN | AGKTTILYRL | QMGEVVSTIP | 47 |
| SEQ_ID_NO_1218 | ---MGILFSK | MFSSVFGNKE | ARILVLGLDN | AGKTTILYRL | QMGEVVSTIP | 47 |
| SEQ_ID_NO_1232 | ---MGLVFTK | LFSSLFGNKE | ARILVLGLDN | AGKTTILYRL | QMGEVVSTIP | 47 |
| SEQ_ID_NO_1234 | ---MGLVFTR | LFSSVFGNKE | ARILVLGLDN | AGKTTILYRL | QMGEVVSTIP | 47 |
| SEQ_ID_NO_1272 | ---MGLSFTK | LFSRLFAKKE | MRILMVGLDA | AGKTTILYKL | KLGEIVTTIP | 47 |
| SEQ_ID_NO_1268 | ---MGITFAK | LFQRLFSKKE | MRILMVGLDA | AGKTTILYKL | KLGEIVTTIP | 47 |
| SEQ_ID_NO_1211 | ---MGLRFTK | ALSRLFSKKE | MRILMVGLDA | AGKTTILYKL | KLGEIVTTIP | 47 |
| SEQ_ID_NO_1216 | ---MGLSFTK | LLGRLFSEKE | MRILMVGLDA | AGKTTILYKL | KLGEIVTTIP | 47 |
| SEQ_ID_NO_1269 | ---MGLSFTK | LLGRLFSKKE | MRILMVGLDA | AGKTTILYKL | KLGEIVTTIP | 47 |
| SEQ_ID_NO_1239 | ---MGLSFTK | LFSRLFAKKE | MRILMVGLDA | AGKTTILYQL | KLGEIVTTIP | 47 |
| SEQ_ID_NO_1259 | ---MGLTFTK | LFSRLFAKKE | MRILMVGLDA | AGKTTILYKL | KLGEIVTTIP | 47 |
| SEQ_ID_NO_1233 | ---MGLTFTK | LFSRLFAKKE | MRILMVGLDA | AGKTTILYKL | KLGEIVTTIP | 47 |
| SEQ_ID_NO_1235 | ---MGLSFTK | LFSRLFAKKE | MRILMVGLDA | AGKTTILYKL | KLGEIVTTIP | 47 |
| SEQ_ID_NO_1243 | ---MGLSFTK | LFSRLFAKKE | MRILMVGLDA | AGKTTILYKL | KLGEIVTTIP | 47 |
| SEQ_ID_NO_1270 | ---MGLSFTK | LFSRLFAKKE | MRILMVGLDA | AGKTTILYKL | KLGEIVTTIP | 47 |
| SEQ_ID_NO_1242 | ---MGLSFGK | LFSRLFAKKE | MRILMVGLDA | AGKTTILYKL | KLGEIVTTIP | 47 |
| SEQ_ID_NO_1238 | ---MGLSFTK | LFSRLFAKKE | MRILMVGLDA | AGKTTILYKL | KLGEIVTTIP | 47 |
| SEQ_ID_NO_1236 | ---MGLSFTK | LFSRLFAKKE | MRILMVGLDA | AGKTTILYKL | KLGEIVTTIP | 47 |
| SEQ_ID_NO_1240 | ---MGLSFGK | LFSRLFAKKE | MRILMVGLDA | AGKTTILYKL | KLGEIVTTIP | 47 |

Figure 42 (continued)

| SEQ ID | Sequence | Len |
|---|---|---|
| SEQ_ID_NO_1241 | T---------- -----QYPT SEEL SI GNI K FKAFDL GGHQ I ARRVWRDYY | 85 |
| SEQ_ID_NO_1229 | T---------- -----QHPT SEEL SI GK K FKAFDL GGHQ I ARRVWKDYY | 85 |
| SEQ_ID_NO_1249 | T---------- -----QHPT SEEL SI GK K FKAFDL GGHQ I ARRVWKDYY | 85 |
| SEQ_ID_NO_1264 | SGFPAPDSLI FFLPFA GFN VETVQYNNI K FQVWDL GGQT SI RPYWRCYF | 97 |
| SEQ_ID_NO_1251 | T---------- ------ GFN VETVQYNNI K FQVWDL GGQT SI RPYWRCYF | 82 |
| SEQ_ID_NO_1265 | T---------- ------ GFN VETVQYNNI K FQVWDL GGQT SI RPYWRCYF | 82 |
| SEQ_ID_NO_1253 | T---------- ------ GFN VETVQYNNI K FQVWDL GGQT SI RPYWRCYF | 82 |
| SEQ_ID_NO_1210 | T---------- ------ GFN VETVQYNNI K FQVWDL GGQT SI RPYWRCYF | 82 |
| SEQ_ID_NO_1267 | T---------- ------ GFN VETVQYNNI K FQVWDL GGQT SI RPYWRCYF | 82 |
| SEQ_ID_NO_1213 | T---------- ------ GFN VETVQYNNI K FQVWDL GGQT SI RPYWRCYF | 82 |
| SEQ_ID_NO_1218 | T---------- ------ GFN VETVQYNNI K FQVWDL GGQT SI RPYWRCYF | 82 |
| SEQ_ID_NO_1232 | T---------- ------ GFN VETVQYNNI K FQVWDL GGQT SI RPYWRCYF | 82 |
| SEQ_ID_NO_1234 | T---------- ------ GFN VETVQYNNI K FQVWDL GGQT SI RPYWRCYF | 82 |
| SEQ_ID_NO_1272 | T---------- ------ GFN VETVEYKNI S FTVWDVGGQD KI RPLWRHYF | 82 |
| SEQ_ID_NO_1268 | T---------- ------ GFN VETVEYKNI S FTVWDVGGQD KI RPLWRHYF | 82 |
| SEQ_ID_NO_1211 | T---------- ------ GFN VETVEYKNI S FTVWDVGGQD KI RPLWRHYF | 82 |
| SEQ_ID_NO_1216 | T---------- ------ GFN VETVEYKNI S FTVWDVGGQD KI RPLWRHYF | 82 |
| SEQ_ID_NO_1269 | T---------- ------ GFN VETVEYKNI S FTVWDVGGQD KI RPLWRHYF | 82 |
| SEQ_ID_NO_1239 | T---------- ------ GFN VETVEYQY S FTVWDVGGQD KI RPLWRHYF | 82 |
| SEQ_ID_NO_1259 | T---------- ------ GFN VETVEYKNI S FTVWDVGGQD KI RPLWRHYF | 82 |
| SEQ_ID_NO_1233 | T---------- ------ GFN VETVEYKNI S FTVWDVGGQD KI RPLWRHYF | 82 |
| SEQ_ID_NO_1235 | T---------- ------ GFN VETVEYKNI S FTVWDVGGQD KI RPLWRHYF | 82 |
| SEQ_ID_NO_1243 | T---------- ------ GFN VETVEYKNI S FTVWDVGGQD KI RPLWRHYF | 82 |
| SEQ_ID_NO_1270 | T---------- ------ GFN VETVEYKNI S FTVWDVGGQD KI RPLWRHYF | 82 |
| SEQ_ID_NO_1242 | T---------- ------ GFN VETVEYKNI S FTVWDVGGQD KI RPLWRHYF | 82 |
| SEQ_ID_NO_1238 | T---------- ------ GFN VETVEYKNI S FTVWDVGGQD KI RPLWRHYF | 82 |
| SEQ_ID_NO_1236 | T---------- ------ GFN VETVEYKNI S FTVWDVGGQD KI RPLWRHYF | 82 |
| SEQ_ID_NO_1240 | T---------- ------ GFN VETVEYKNI S FTVWDVGGQD KI RPLWRHYF | 82 |

Figure 42 (continued)

| | | | | | | | |
|---|---|---|---|---|---|---|---|
| SEQ_ID_NO_1241 | AKVDAVVYLV | DANDRERFPE | AKKELDGLLS | DESLTNVPFL | LGNKIDIPY | 135 |
| SEQ_ID_NO_1229 | AKVDAVVYLV | DAYDKERFAE | SKKELDALLS | DESLATVPFL | LGNKIDIPY | 135 |
| SEQ_ID_NO_1249 | AKVDAVVYLV | DAYDKERFAE | SKKELDALLS | DDSLANVPFL | LGNKIDIPY | 135 |
| SEQ_ID_NO_1264 | PNTQAIIYVV | DSSDTDRLVT | AKEEFHAILE | EDELKGAVVL | VYANKQDLPG | 147 |
| SEQ_ID_NO_1251 | PNTQAIIYVV | DSSDTDRLVT | AKEEFHSILE | EDELKGAVVL | VYANKQDLPG | 132 |
| SEQ_ID_NO_1265 | PNTQAIIYVV | DSSDTDRLVT | AKEEFHAILE | EDELKGAVVL | VYANKQDLPG | 132 |
| SEQ_ID_NO_1253 | PNTQAVIYVV | DSSDTDRIGV | AKEEFHAILE | EEELKGAMVL | IFANKQDLPG | 132 |
| SEQ_ID_NO_1210 | PNTQAVIYVV | DSSDTDRIGV | AKEEFHAILE | EDELKGAVVL | FANKQDLPG | 132 |
| SEQ_ID_NO_1267 | PNTQAVIYVV | DSSDTDRIGV | AKEEFHAILE | EEELKGAVVL | FANKQDLPG | 132 |
| SEQ_ID_NO_1213 | PNTQAIIYVV | DSSDTDRLV | AKEEFHAILE | EEELRGAAVL | FANKQDLPG | 132 |
| SEQ_ID_NO_1218 | PNTQAIIYVV | DSSDVDRLV | AKDEFHAILE | EEELRGAIVL | FANKQDLPG | 132 |
| SEQ_ID_NO_1232 | PNTQAIIYVV | DSSDVDRLV | AKEEFHAILE | EEELKGAVVL | FANKQDLPG | 132 |
| SEQ_ID_NO_1234 | PNTQAIIYVV | DSSDTDRLV | AREEFHAILE | EEELKGAVVL | FANKQDLPG | 132 |
| SEQ_ID_NO_1272 | QNTQGLIFVV | DSNDRDRVVE | ARDELHRMLN | EDELRDAVLL | VFANKQDLPN | 132 |
| SEQ_ID_NO_1268 | QNTQGLIFVV | DSNDRDRVSE | ARDELHRMLN | EDELRDAVLL | VFANKQDLPN | 132 |
| SEQ_ID_NO_1211 | QNTQGLIFVV | DSNDRERVVE | ARDELHRMLN | EDELRDAVLL | VFANKQDLPN | 132 |
| SEQ_ID_NO_1216 | QNTQGLIFVV | DSNDRDRVGE | AREELHRMLN | EDELRDAVLL | VFANKQDLPN | 132 |
| SEQ_ID_NO_1269 | QNTQGLIFVV | DSNDRDRVGE | ARDELHRMLN | EDELRDAVLL | VFANKQDLPN | 132 |
| SEQ_ID_NO_1239 | QNTQGLIFVV | DSNDRDRVVE | ARDELHRMLN | EDELRDAVLL | VFANKQDLPN | 132 |
| SEQ_ID_NO_1259 | QNTQGLIFVV | DSNDRDRIVE | AKDELHRMLN | EDELRDAVLL | VFANKQDLPN | 132 |
| SEQ_ID_NO_1233 | QNTQGLIFVV | DSNDRDRVVE | ARDELHRMLN | EDELRDAVLL | VFANKQDLPN | 132 |
| SEQ_ID_NO_1235 | QNTQGLIFVV | DSNDRDRVVE | ARDELHRMLN | EDELRDAVLL | VFANKQDLPN | 132 |
| SEQ_ID_NO_1243 | QNTQGLIFVV | DSNDRDRVVE | ARDELHRMLN | EDELREAVLL | VFANKQDLPN | 132 |
| SEQ_ID_NO_1270 | QNTQGLIFVV | DSNDRDRVVE | ARDELHRMLN | EDELRDAVLL | VFANKQDLPN | 132 |
| SEQ_ID_NO_1242 | QNTQGLIFVV | DSNDRDRVVE | ARDELHRMLN | EDELREAVLL | VFANKQDLPN | 132 |
| SEQ_ID_NO_1238 | QNTQGLIFVV | DSNDRDRVVE | AKDELHRMLN | GDELRDAVLL | VFANKQDLPN | 132 |
| SEQ_ID_NO_1236 | QNTQGLIFVV | DSNDRDRVVE | ARDELHRMLN | EDELRDAVLL | VFANKQDLPN | 132 |
| SEQ_ID_NO_1240 | QNTQGLIFVV | DSNDRDRVVE | ARDELHRMLN | EDELRDAVLL | VFANKQDLPN | 132 |

Figure 42 (continued)

| | | | | | | | |
|---|---|---|---|---|---|---|---|
| SEQ_ID_NO_1241 | AASEDELRYH | LGLTGVTTGK | GNINLAGTNV | RP--IEVFMC | SIVRK--MGY | | 181 |
| SEQ_ID_NO_1229 | AASEDELRYH | LGLSNFTTGK | GKVDLVGSNV | RP--LEVFMC | SIVRK--MGY | | 181 |
| SEQ_ID_NO_1249 | AASEEELRYH | LGLSSFTTGK | GKVSLCDSNV | RP--LEVFMC | SVVRK--MGY | | 181 |
| SEQ_ID_NO_1264 | ALDDAAITES | LELHKIKS-- | ---------- | RQ--WAIFKT | SAIKG--EGL | | 181 |
| SEQ_ID_NO_1251 | ALDDAAITES | LELHKIKS-- | ---------- | RQ--WAIFKT | SAIKG--EGL | | 166 |
| SEQ_ID_NO_1265 | ALDDAAITES | LELHKIKS-- | ---------- | RQ--WAIFKT | SAIKG--EGL | | 166 |
| SEQ_ID_NO_1253 | ALDDAAVTEA | LELHKIKS-- | ---------- | RQ--WAIFKT | CAVKG--EGL | | 166 |
| SEQ_ID_NO_1210 | ALDDAAVTEA | LELHKIKS-- | ---------- | RQ--WAIFKT | CAVKG--EGL | | 166 |
| SEQ_ID_NO_1267 | ALDDAAVTEA | LELHKIKS-- | ---------- | RQ--WAIFKT | CAVKG--EGL | | 166 |
| SEQ_ID_NO_1213 | ALDDAAVTES | LELHKIKN-- | ---------- | RQ--WAIFKT | SAIKG--EGL | | 166 |
| SEQ_ID_NO_1218 | ALDDAAVTEA | LELHKIKN-- | ---------- | RQ--WAIFKT | SAIKG--EGL | | 166 |
| SEQ_ID_NO_1232 | ALDDAAVTEA | LELHKIKN-- | ---------- | RQ--WAIFKT | SAIKG--EGL | | 166 |
| SEQ_ID_NO_1234 | ALDDAAVTES | LELHKIKN-- | ---------- | RQ--WAIFKT | SAIKG--EGL | | 166 |
| SEQ_ID_NO_1272 | AMNAAEITDK | LGLHSLRQ-- | ---------- | RPNLWGLINS | PKEVPLVANL | | 170 |
| SEQ_ID_NO_1268 | AMSAAEITDK | LGLHSLRQ-- | ---------- | RH--WFIQST | CATSG--EGL | | 166 |
| SEQ_ID_NO_1211 | AMNAAEITDK | LGLHSLRQ-- | ---------- | RH--WYIQST | CATSG--EGL | | 166 |
| SEQ_ID_NO_1216 | AMNAAEITDK | LGLHSLRQ-- | ---------- | RH--WYIQST | CATSG--EGL | | 166 |
| SEQ_ID_NO_1269 | AMNAAEITDK | LGLHSLRQ-- | ---------- | RH--WYIQST | CATSG--EGL | | 166 |
| SEQ_ID_NO_1239 | AMNAAEITDK | HGLHSLRQ-- | ---------- | RH--WYIQST | CATSG--EGL | | 166 |
| SEQ_ID_NO_1259 | AMNAAEITDK | LGLHSLRQ-- | ---------- | RH--WYIQST | CATSG--EGL | | 166 |
| SEQ_ID_NO_1233 | AMNAAEITDK | LGLHSLRQ-- | ---------- | RH--WYIQST | CATSG--EGL | | 166 |
| SEQ_ID_NO_1235 | AMNAAEITDK | LGLHSLRQ-- | ---------- | RH--WYIQST | CATSG--EGL | | 166 |
| SEQ_ID_NO_1243 | AMNAAEITDK | LGLHSLRQ-- | ---------- | RH--WYIQST | CATSG--EGL | | 166 |
| SEQ_ID_NO_1270 | AMNAAEITDK | LGLHSLRQ-- | ---------- | RH--WYIQST | CATSG--EGL | | 166 |
| SEQ_ID_NO_1242 | AMNAAEITDK | LGLHSLRQ-- | ---------- | RH--WYIQST | CATSG--EGL | | 166 |
| SEQ_ID_NO_1238 | AMNAAEITDK | LGLHSLRQ-- | ---------- | RH--WYIQST | CATSG--EGL | | 166 |
| SEQ_ID_NO_1236 | AMNAAEITDK | LGLHSLRQ-- | ---------- | RH--WYIQST | CATSG--EGL | | 166 |
| SEQ_ID_NO_1240 | AMNAAEITDK | LGLHSLRQ-- | ---------- | RH--WYIQST | CATSG--EGL | | 166 |

Figure 42 (continued)

| | | | | | | | |
|---|---|---|---|---|---|---|---|
| SEQ_ID_NO_1241 | GEGFK | | | | WMSQY | K | 193 |
| SEQ_ID_NO_1229 | GEGFK | | | | MLSQY | K | 193 |
| SEQ_ID_NO_1249 | GDGFK | | | | WVSQY | N | 193 |
| SEQ_ID_NO_1264 | FEGLD | CSVLQ HIILQFLPDE | CIWEYLMELT | YKSLMYLHIE | KNRF | VENDE | 231 |
| SEQ_ID_NO_1251 | FEGLN | | | | MLSNA | KSGGS | 182 |
| SEQ_ID_NO_1265 | FEGLD | | | | MLSNA | KSKSS | 182 |
| SEQ_ID_NO_1253 | FEGLD | | | | MLSNT | KSGTG | 182 |
| SEQ_ID_NO_1210 | FEGLD | | | | MLSNT | KSGSG | 182 |
| SEQ_ID_NO_1267 | FEGLD | | | | MLSNT | KSGSG | 182 |
| SEQ_ID_NO_1213 | FEGLD | | | | MLSNT | KSGSG | 182 |
| SEQ_ID_NO_1218 | FEGLD | | | | MLSNT | KSGGG | 182 |
| SEQ_ID_NO_1232 | FEGLD | | | | MLSNT | KSGGG | 182 |
| SEQ_ID_NO_1234 | FEGLD | | | | MLSNT | KSGGG | 182 |
| SEQ_ID_NO_1272 | FLG | | | | AKGVL | LGGGPKNLG | 188 |
| SEQ_ID_NO_1268 | YEGLD | | | | MLSSN | SQRA | 181 |
| SEQ_ID_NO_1211 | YEGLD | | | | MLSNN | ANKT | 181 |
| SEQ_ID_NO_1216 | YEGLD | | | | MLSNN | ASKA | 181 |
| SEQ_ID_NO_1269 | YEGLD | | | | MLSNN | SSKA | 181 |
| SEQ_ID_NO_1239 | YEGLD | | | | MLSNN | ANKA | 181 |
| SEQ_ID_NO_1259 | YEGLD | | | | MLSNN | ASKA | 181 |
| SEQ_ID_NO_1233 | YEGLD | | | | MLSNN | ASKA | 181 |
| SEQ_ID_NO_1235 | YEGLE | | | | MLSNN | ASKA | 181 |
| SEQ_ID_NO_1243 | YEGLD | | | | MLSNN | ASKA | 181 |
| SEQ_ID_NO_1270 | YEGLD | | | | MLSNN | ASKG | 181 |
| SEQ_ID_NO_1242 | YEGLD | | | | MLSNN | SNKA | 181 |
| SEQ_ID_NO_1238 | YEGLD | | | | MLSNN | ANKA | 181 |
| SEQ_ID_NO_1236 | YEGLD | | | | MLSNN | ANKA | 181 |
| SEQ_ID_NO_1240 | YEGLD | | | | MLSNN | ANKA | 181 |

Figure 42 (continued)

| | | |
|---|---|---|
| SEQ_ID_NO_1241 | ---------- --- | 193 |
| SEQ_ID_NO_1229 | ---------- --- | 193 |
| SEQ_ID_NO_1249 | ---------- --- | 193 |
| SEQ_ID_NO_1264 | QTVRTLGHWW LYP | 244 |
| SEQ_ID_NO_1251 | ---------- --- | 182 |
| SEQ_ID_NO_1265 | ---------- --- | 182 |
| SEQ_ID_NO_1253 | ---------- --- | 182 |
| SEQ_ID_NO_1210 | ---------- --- | 182 |
| SEQ_ID_NO_1267 | ---------- --- | 182 |
| SEQ_ID_NO_1213 | ---------- --- | 182 |
| SEQ_ID_NO_1218 | ---------- --- | 182 |
| SEQ_ID_NO_1232 | ---------- --- | 182 |
| SEQ_ID_NO_1234 | ---------- --- | 182 |
| SEQ_ID_NO_1272 | LLSPKPK--- --- | 195 |
| SEQ_ID_NO_1268 | ---------- --- | 181 |
| SEQ_ID_NO_1211 | ---------- --- | 181 |
| SEQ_ID_NO_1216 | ---------- --- | 181 |
| SEQ_ID_NO_1269 | ---------- --- | 181 |
| SEQ_ID_NO_1239 | ---------- --- | 181 |
| SEQ_ID_NO_1259 | ---------- --- | 181 |
| SEQ_ID_NO_1233 | ---------- --- | 181 |
| SEQ_ID_NO_1235 | ---------- --- | 181 |
| SEQ_ID_NO_1243 | ---------- --- | 181 |
| SEQ_ID_NO_1270 | ---------- --- | 181 |
| SEQ_ID_NO_1242 | ---------- --- | 181 |
| SEQ_ID_NO_1238 | ---------- --- | 181 |
| SEQ_ID_NO_1236 | ---------- --- | 181 |
| SEQ_ID_NO_1240 | ---------- --- | 181 |

Figure 43

```
SEQ_ID_NO_1285  ..........  ..........  ----MVGNAF  VEQYYS LHR  DPDQVHRFYH  26
SEQ_ID_NO_1297  MAVSDGVQTP  TP--------  ---DVVGNAF  VEQYYS LHQ  DPDQVHKFYH  39
SEQ_ID_NO_1284  MALQ-TATPP  TT--------  PSAQVVGNAF  VEQYYHI LHH  SPGSVYRFYQ  41
SEQ_ID_NO_1300  MAAP-QPAAP  AP-----EAP  PSAQVVGNAF  VQQYYLVLHQ  SPDLVYRFYQ  44
SEQ_ID_NO_1294  MAAP-Q-ASP  S---------  PSAQVVGNAF  VQQYYQI LHQ  SPDLVYRFYQ  39
SEQ_ID_NO_1295  MAAP-Q-ASP  S---------  PSAQVVGNAF  VQQYYQI LHQ  SPDLVYRFYQ  39
SEQ_ID_NO_1287  MAAP-TPPPA  AAPAAAPGPT  PPAQVVGNAF  VQQYYNI LHQ  SPELVFRFYQ  49
SEQ_ID_NO_1289  -MAS-QPPPP  AA-AAASGAP  PPAQVVGNAF  VHQYYNI LHQ  SPELVYRFYQ  47
SEQ_ID_NO_1291  MASP-PPPPP  AG-AAAPGSP  PPAQVVGNAF  VNQYYNI LHQ  SPELVHRFYQ  48
SEQ_ID_NO_1274  MAML GAQQVP  AA-----ACT  PL-DMVGNAF  VPQYYHI LHQ  SPEHVHRFYQ  43
SEQ_ID_NO_1276  MASV-EQQVP  AG-----IAT  PTSDVVGNAF  VHQYYL LHQ  SPELVHRFYH  44
SEQ_ID_NO_1280  MAAP-VTQLP  V---------  PTADVVGNAF  AHQYYHI LQQ  SPDLVHRFYQ  40

SEQ_ID_NO_1285  DSSVMSRP--  -EEDGTMTTV  TTTAEI DKKI  QSLEYTSFRV  EVLSADAQPS  73
SEQ_ID_NO_1297  ESSVLSRP--  -EEDGTMTTV  TTTAEI DKKI  QSFDYTSYRV  EVLSADAQPS  86
SEQ_ID_NO_1284  DSSVI SRP--  -DSSGVMTSV  TTMKGI NEKI  LSLNFKEFKA  EI KTADAQKS  88
SEQ_ID_NO_1300  DASRLARPAS  AAGAAGMDSV  TTMEAI SEKI  MEMDVS--KA  EI RTVDSQES  92
SEQ_ID_NO_1294  DASRLGRP-P  ADRYGDMVSV  TTMEAI NEKI  MAMDMS--RA  EI KTVDSQES  86
SEQ_ID_NO_1295  DASRLGRP-P  ADRYGDMVSV  TTMEAI NEKI  MAMDMS--RA  EI KTVDSQES  86
SEQ_ID_NO_1287  EASRI GRPAT  TGAD--MDTV  TTMEAI NEKI  MSMDI A--RA  EI RGVDAQES  95
SEQ_ID_NO_1289  EASQLGRPAG  TGADG-MDTV  TTMDAI NDKI  VSMGI D--RA  KI KAVDAQES  94
SEQ_ID_NO_1291  DASRLGRPAG  AGADG-MDTV  TTMDAI SDKI  VSMGI T--RA  EI KAVDAQES  95
SEQ_ID_NO_1274  EI SKLGRP--  -EENGLMSI T  STLQAI DKKI  MALGYGVI SA  EI RTVDTQES  90
SEQ_ID_NO_1276  DSSKLGRP--  -EENGGMSI T  TTMQAI NEKI  LSLGYGEFTA  EI TTVDAQDS  91
SEQ_ID_NO_1280  DGSKFGRP--  -GEDGVMSTT  TTMNAI NEKI  LSLGYGQVRA  EI VTVDSQES  87

SEQ_ID_NO_1285  YNNGVMVVVT  GQLTGTDNI K  RKFAQSFFLA  PQDKGFYVLN  DVFRYVDAY-  122
SEQ_ID_NO_1297  YNSGVVVVVT  GQLTGTDNVK  RKFAQSFFLA  PQDKGFYVLN  DVFRYVDAY-  135
SEQ_ID_NO_1284  YKEGVTVLVT  GQLTGKDNLR  RKFAQSFFLA  PQDNGYFVLN  DVFRYYEDH-  137
SEQ_ID_NO_1300  LGGGVTVLVT  GHLTGRDGVR  REFSQSFFLA  PQEKGYFVLN  DI FRFYGDL-  141
SEQ_ID_NO_1294  LGGGVTVLVT  GHLTVRDGVC  REFSQSFFLA  PQEKGYFVLN  DMFRYVGDG-  135
SEQ_ID_NO_1295  LGGGVTVLVT  GHLTVRDGVC  REFSQSFFLA  PQEKGYFVLN  DMFRYVGDG-  135
SEQ_ID_NO_1287  LCGGVTVLVT  GHLTGKDDVC  REFAQSFFLA  PQEKGYFVLN  DI LRYVGQG-  144
SEQ_ID_NO_1289  LCGGVSVLVM  GHLTGRNSVS  RQFVQSFFLA  PQEKGYFVLN  DI LRYVGEG-  143
SEQ_ID_NO_1291  LGGGVTVLVM  GHLTGRTSVG  REFVQSFFLA  PQEKGYFVLN  DI LRYVGDGX  145
SEQ_ID_NO_1274  HGGGYI VLVT  GYLTGKDSVR  RTFSQTFFLA  PQETGYFVLN  DMFRFI DEG-  139
SEQ_ID_NO_1276  HNGGVLVLVT  GYLTGKDKVK  RKFTQSFFLA  PQDKGYFVLN  DVFRFVDDT-  140
SEQ_ID_NO_1280  YKGGVLVLVT  GYLNGNDNLR  QKFTQSFFLA  PQDKGYFVLN  DVFRYYDDS-  136
```

Figure 43 (continued)

| | | |
|---|---|---|
| SEQ_ID_NO_1285 | --------KS IDIESVPAND ADESAPSEA TPEPEPVHV PEVI PPTQTV | 164 |
| SEQ_ID_NO_1297 | ---------K SVDIETVPAN DADESAPSEA FTPDPEPIHV A-------ED | 169 |
| SEQ_ID_NO_1284 | --------EP SELPPVTGDG DSAAVTVTPE LEPSHVAD-- --------SC | 169 |
| SEQ_ID_NO_1300 | --------PA PTAVEAQPEA DAVVPPVAAP LANGTATPAV EPAIPDDHDA | 183 |
| SEQ_ID_NO_1294 | -------PTP AAAAAAAVEV QPEADAVAPP LANGTATAPL QPAAPDY-DG | 177 |
| SEQ_ID_NO_1295 | ---------P TPAAAAAAEV QPEADAVAPP LANGTATAPL QPAAPDY-DA | 175 |
| SEQ_ID_NO_1287 | --EADPSLPP PQQQPPAPEL DAVVAP-AAA LANGTVAP-- VETVPREQEA | 189 |
| SEQ_ID_NO_1289 | ----GGDEGA EKQPAPEVAA DAEKTTSAPI LANGTVGGDA TTVPQ---DA | 186 |
| SEQ_ID_NO_1291 | GEEGAGHPPP PPQQPVQETV TGAEAVPAPI LANGTVGG-D NETLPCEQDA | 194 |
| SEQ_ID_NO_1274 | ---------- ----TVVHGN QIPVNNVQAP VNTYQDTAAA KEIPDDFVQE | 175 |
| SEQ_ID_NO_1276 | ---------- ----KHQPGG QDPVNGFEAS LTHEQGHS-- ---------- | 164 |
| SEQ_ID_NO_1280 | ---------- ----THQNGN QEPASNFEAP VAPDQDTP-- ---------- | 160 |

| | | |
|---|---|---|
| SEQ_ID_NO_1285 | IPTAQTVPP TQTVIADTET IISKEVSLPL ENGKLSVT-- ---------- | 202 |
| SEQ_ID_NO_1297 | IPTIQPVAD TDTNISK-- ----EVSLPL ENGKLSVT-- ---------- | 200 |
| SEQ_ID_NO_1284 | APEPTNSHVN KGQTVAEL-- ----NAVELS NNHERQIPV- ---------- | 201 |
| SEQ_ID_NO_1300 | VPQQENHVVD RSPPQPEEED EA--EVYNPP PEEVV---- ---------- | 216 |
| SEQ_ID_NO_1294 | MPQEEPDVVE HAAVPPEEEE ----EVYNPP LEEVEGGAV- ---------- | 212 |
| SEQ_ID_NO_1295 | MPHEEPDVVE NVAVPPEEEE ----EVYNPP LEEVEGGAV- ---------- | 210 |
| SEQ_ID_NO_1287 | SPQPELDLSE SVPHTNEEED PKE-EVYNPP NDVEVPV-- ---------- | 225 |
| SEQ_ID_NO_1289 | SPQPECQVAE PALNPKEEVL NG--EVCNBL SDVEKPV-- ---------- | 221 |
| SEQ_ID_NO_1291 | SPQPEQPAAE SAPPTPEEED LYGEEVYNPP NDMEKPV-- ---------- | 231 |
| SEQ_ID_NO_1274 | KYVQENHAVK QTEVLSKSTN EPE-KVFTPS EDEQVSA-- ---------- | 211 |
| SEQ_ID_NO_1276 | -PVPENHIEQ PAA-LPEECN GP--EVYNSS ENGDSSE- ---------- | 198 |
| SEQ_ID_NO_1280 | -HTQETHISE PTAALSEEVI GG--EVYNPS ESGDVSVEVE EEESGDVSFE | 207 |

| | | |
|---|---|---|
| SEQ_ID_NO_1285 | ENVIPVNHVK ESSHHVKEPE QPTS EKVAS NTQEDTPKKS FASIVNALKD | 252 |
| SEQ_ID_NO_1297 | ENVIPVNHVK ESSHQEQMAS IEKV----PS NTQEDTPKKS FASIVSAYKD | 246 |
| SEQ_ID_NO_1284 | ENEGNVESHF QSNGNDDSQA TELA----S SAQDDAPKKS YASIVKVQKG | 246 |
| SEQ_ID_NO_1300 | DEEQPVPEVI NEVPNNVAPV AATT--VAP VLQEEAPKKS YASIVKVMKE | 263 |
| SEQ_ID_NO_1294 | EEEQSVPEVI NEVPNNVVPV VAPA--AAP VSHEEAPKKS YASIVKVMKE | 259 |
| SEQ_ID_NO_1295 | EEEQSVPEVI NEVPNNVVPV VAPA--DAP VSHEEAPKKS YASIVKVMKE | 257 |
| SEQ_ID_NO_1287 | VEETLVPEVI DEVPNNVAAS IPVS--APP VPHEEAPKKS YASIVKVMKA | 272 |
| SEQ_ID_NO_1289 | AEETPVPDVI NEVPNNVAVA PPIS--SPP VPLKEAPKKS YASIVKVMKE | 268 |
| SEQ_ID_NO_1291 | VDETPVAEVI NEVPNNVAVA APSS--SPS LPIEEAPKKS YASIVKVMKE | 278 |
| SEQ_ID_NO_1274 | AEEVLVTETV NEAPIEVQKV GESD------ SRTGEIPKRS YASIVKVMKE | 255 |
| SEQ_ID_NO_1276 | EEESPVAEVV DEIPDDSKMV SDSK------ PEMEELPKKS YASILKVLKE | 242 |
| SEQ_ID_NO_1280 | EEEEPMPEVV DEIPPDSQLV ADSDVVVESS AKIEDTPKKS YASVVKVQKE | 257 |

Figure 43 (continued)

| | | | | | | | | |
|---|---|---|---|---|---|---|---|---|
| SEQ_ID_NO_1285 | NSAPFHL--- | -RASPAKPAV | HPP- | -RVHSV | PAPEAPTPNM | D-PLEKNN- | - | 294 |
| SEQ_ID_NO_1297 | NSAPFLS--- | -RTSPAKPAV | QPP- | -RVHSV | PAPEAPAPNM | D-PSEKNN- | - | 288 |
| SEQ_ID_NO_1284 | SSVPTKVYV- | -PTNTLKSGP | NKT- | -ESKVV | ES-VESTEVP | EAALESVSNP | | 291 |
| SEQ_ID_NO_1300 | VPLPA----- | -PAPPTRPAP | PKP- | -EKQS- | -P-PAPTPVT | DVPPFSSN-P | | 301 |
| SEQ_ID_NO_1294 | APVPAPIPAT | RPAPAARPAP | PKP- | -EKQSP | AP-PAPAPVA | DATPFSSN-A | | 305 |
| SEQ_ID_NO_1295 | APVPAPIPAT | RPAPAARPAP | PKP- | -EKQSP | AP-PAPAPVA | DATPFSSN-A | | 303 |
| SEQ_ID_NO_1287 | VLPPN----- | -STVPYRPAP | PKP- | -EKQA- | -PAPAQSVAV | DAPTFSPN-P | | 311 |
| SEQ_ID_NO_1289 | HRPLA----- | -PAVPSRPAP | P-T- | -EKQA- | -S-PAPTPVT | EAPAFSPN-P | | 306 |
| SEQ_ID_NO_1291 | YPPPA----- | -PAVPSRPAP | PKP- | -EKQA- | -P-PAPSLVA | DAPAFSPN-T | | 316 |
| SEQ_ID_NO_1274 | NAAPMSA--- | -SRTPTKVEP | KKD- | -EDDAI | HI-PLPTPLS | EKSDSGANVA | | 296 |
| SEQ_ID_NO_1276 | NAVPVSAP-- | -TQSPVKSAV | KSQGHPRI | AA | PP-SAPMPAS | DAQVSSNNVT | | 288 |
| SEQ_ID_NO_1280 | YTAPFSSP-- | -TPSPLRSAP | KIQ- | -EQVTA | AV-SQP-PAA | ESHVSSSNTF | | 300 |

| | | | | | | | |
|---|---|---|---|---|---|---|---|
| SEQ_ID_NO_1285 | ENAGR----- | --AHAIFVAN | LPMSATVEQL | DRAFKKFGP- | KRDGIQVRSN | | 337 |
| SEQ_ID_NO_1297 | ENGGR----- | --AHAIFVAN | LPMTATVEQL | DRVFKKFGTI | KRDGIQVRSN | | 331 |
| SEQ_ID_NO_1284 | ESSDAHE-EV | E-GHSIYIRN | LPLNVTVADL | ELFFKKFGP- | KPGGIQVRNN | | 339 |
| SEQ_ID_NO_1300 | DNSN-QEPEV | D-AHAIYVRN | LPLNATETQL | EDEFKKFGTI | KQNGIQVRSN | | 350 |
| SEQ_ID_NO_1294 | ESSNTHEPEV | D-AHAIYVRS | LPLNATTTQL | EDEFKKFGTI | KPDGIQVRSH | | 354 |
| SEQ_ID_NO_1295 | ESSNTHEPEV | D-AHAIYVRS | LPLNATTTQL | EDEFKKFGTI | KPDGIQVRSH | | 352 |
| SEQ_ID_NO_1287 | ESSN-QDQEV | D-ALAVYVKN | LPLHATPSQL | EEEFKRFGTI | KHDGIQVRSH | | 360 |
| SEQ_ID_NO_1289 | QSGGFQDPEV | D-AHAIYVRS | LPLNATPQDL | EEEFKRFGTI | KHEGIQVRSN | | 355 |
| SEQ_ID_NO_1291 | QGGSFQDPEV | D-AHAIYVRN | LPLNATPQDL | EEEFKRFGTI | KHEGIQVRSN | | 365 |
| SEQ_ID_NO_1274 | VNENNQENER | ALGPSIYLKG | LPLDATPAL- | ENEFQKFGL- | RTNGIQVRSQ | | 348 |
| SEQ_ID_NO_1276 | ENGNNQDAEA | E-GPSIYVKG | LPLNATPSML | EVEFKKFGP- | KSGGIQVRSQ | | 337 |
| SEQ_ID_NO_1280 | ENGNAQESE- | E-GPSIYVKG | LPLDATTTLL | ENEFKKFGP- | RNGGVQVRFQ | | 348 |

| | | | | | | | |
|---|---|---|---|---|---|---|---|
| SEQ_ID_NO_1285 | K--GSCFGFV | EFESAASMQS | ALEASPPVML | DNRRLS-EER | RGR------ | | 378 |
| SEQ_ID_NO_1297 | K--GSCFGFV | EFESAASLQS | ALEASPPVML | DNRRLS-EER | RGR------ | | 372 |
| SEQ_ID_NO_1284 | KQQGYCFGFV | EFLSLNSMNS | AIQAS-PVP- | GGRQAVVE-K | RTTTRVGSGI | | 388 |
| SEQ_ID_NO_1300 | KIQGFCYGFV | EFEDSTSVQS | AIEAS-PVT- | GGRQCYVEEK | RTP---GSR- | | 395 |
| SEQ_ID_NO_1294 | KIQGFCYGFV | EFEEATAVQS | AIEAS-PVMI | GGRQCFVEEK | RTP---GSR- | | 399 |
| SEQ_ID_NO_1295 | KIQGFCYGFV | EFEEATAVQS | AIEAS-PVMI | GGRQCFVEEK | RTP---GSR- | | 397 |
| SEQ_ID_NO_1287 | KIQGFCYGFI | EFEDASSVQS | ALAAS-PVT- | DDRPCHVEEK | RTP---GS-- | | 404 |
| SEQ_ID_NO_1289 | KIQGFCYGFV | EFEDASAVQA | AIEAS-PVT- | GERQCFVEEK | RTT---GSRG | | 401 |
| SEQ_ID_NO_1291 | KIQGFCYGFV | EFEDANAVQT | AIEAS-PVMI | SERQCYVEEK | RTT---GSR- | | 410 |
| SEQ_ID_NO_1274 | K--GFCFGFV | EFESASSMQS | AIEAS-PVML | NGHKVVEEK | RST---A--- | | 389 |
| SEQ_ID_NO_1276 | K--GFCFGFV | EFEMASSVQS | AIEAS-PIN- | GGRKAVVEEK | RST---S--- | | 378 |
| SEQ_ID_NO_1280 | K--GFCFGFV | EFEMASAVQS | ALELIYLFLF | T--------- | ---------- | | 377 |

Figure 43 (continued)

| | | | | | | | | |
|---|---|---|---|---|---|---|---|---|
| SEQ_ID_NO_1285 | SGYR----- | ----NDRND | NFRGRGNFGG | GRGGGFNGRN | DF-ERRGGEF | | | 416 |
| SEQ_ID_NO_1297 | GGYR----- | ----NDRND | NFRGRGNFGG | GRGGGFNGRN | DF-DRRG-EF | | | 409 |
| SEQ_ID_NO_1284 | NGTGRPR-PS | GRG-GLRND | SFRGRGNYVG | GR-G--YGRN | DY-VSRG-GF | | | 431 |
| SEQ_ID_NO_1300 | GSSRGGRFAP | GRGN-NFRSE | GTRGRGNYGG | GR-G--YGRG | EF-SYRS-DY | | | 439 |
| SEQ_ID_NO_1294 | GSSRGGRFAP | GRGNNNFRAD | GMRGRGNYSG | GR-S--YGRG | DF-SYRS-DY | | | 444 |
| SEQ_ID_NO_1295 | GSSRGGRFAP | GRGNNNFRAD | GMRGRGNYSG | GR-S--YGRG | DF-SYRS-DY | | | 442 |
| SEQ_ID_NO_1287 | RGSSRGRFPP | GRGG-NFRGE | GMRGRGSYTS | GR-G--YGRG | EYNNYRS-DF | | | 449 |
| SEQ_ID_NO_1289 | GGSRGGRFPP | GRGG-NFRGE | GIRGRGTYNG | GR-G--YGRG | EF-SYRS-DY | | | 445 |
| SEQ_ID_NO_1291 | GSNRGGRFAP | GRGG-NFRGE | GLRGRGTYNG | GR-G--YGRG | EF-SYRS-DY | | | 454 |
| SEQ_ID_NO_1274 | RGNYRGRSTF | GVNT-GYRNE | GGRGRGSFGG | GRGG--YGRT | DFNGYGN-- | | | 433 |
| SEQ_ID_NO_1276 | RGN-KGKSSS | VSGA-GYRNE | GARGRGNYGG | GR-G--YSRG | EF------- | | | 415 |
| SEQ_ID_NO_1280 | TGNNRGRFPS | GSGA-GYKSE | GMRGRGNL-G | GK-V--YGR- | EF-GIRT-EF | | | 420 |

| | | | | | | | | |
|---|---|---|---|---|---|---|---|---|
| SEQ_ID_NO_1285 | SGRSRGG-QN | AGR- | ----- | ----- | ----- | -----S | | 429 |
| SEQ_ID_NO_1297 | SGRPRGG-NN | TGR- | ----- | ----- | ----- | -----S | | 422 |
| SEQ_ID_NO_1284 | SGRGRGH--- | ---- | ----- | ----- | ----- | ------ | | 438 |
| SEQ_ID_NO_1300 | GGRSGGR-GG | PAR- | ----- | ----- | ----- | -----G | | 452 |
| SEQ_ID_NO_1294 | GGRGGGR-GG | SAR- | ----- | ----- | ----- | -----G | | 457 |
| SEQ_ID_NO_1295 | GGRGGGR-GG | SAR- | ----- | ----- | ----- | -----G | | 455 |
| SEQ_ID_NO_1287 | GGRGGGR-GG | SGR- | ----- | ----- | ----- | -----G | | 462 |
| SEQ_ID_NO_1289 | GGRGGGR-GG | SLH- | ----- | ----- | ----- | -----G | | 458 |
| SEQ_ID_NO_1291 | GGRGGGR-GG | SSR- | ----- | ----- | ----- | -----G | | 467 |
| SEQ_ID_NO_1274 | -NRGNNR-GG | YANRAN--- | ----- | ----- | ----- | -----G | | 448 |
| SEQ_ID_NO_1276 | GNRSSNR-GG | YSS- | ----- | ----- | ----- | -----R | | 428 |
| SEQ_ID_NO_1280 | GNRGGSRGGG | YSNRGGDGYS | NRGGGGGGGG | DGYSNRGGGG | GGDGYSNRGG | | | 470 |

| | | | | | | |
|---|---|---|---|---|---|---|
| SEQ_ID_NO_1285 | NGDAVPRSYQ | NG--GGKVAA | RQPPVKVQ-- | ---------- | ---- | 455 |
| SEQ_ID_NO_1297 | NGDAAPRSYQ | NG--GGKV-A | RQPPVKAQ-- | ---------- | ---- | 447 |
| SEQ_ID_NO_1284 | -GEGYHQG-- | ----RGRG-G | RSSGQKQNAV | SN-------- | ---- | 462 |
| SEQ_ID_NO_1300 | ADVGYQRVDH | ASYAGGRG-G | RTAAAGAPAK | ---------- | ---- | 481 |
| SEQ_ID_NO_1294 | PDVGYQRVD- | ----GGRG-G | RTSAGPGAPA | K--------- | ---- | 482 |
| SEQ_ID_NO_1295 | PDVGYQRVD- | ----GGRG-G | RTSAGPGAPA | K--------- | ---- | 480 |
| SEQ_ID_NO_1287 | GDVGYQRVDH | SGT-GGRGGA | RAAAK----- | ---------- | ---- | 486 |
| SEQ_ID_NO_1289 | GDVGYQRVDY | SGTSSGRG-A | RAPSAAAAMA | K--------- | ---- | 488 |
| SEQ_ID_NO_1291 | -EVGYQRVDH | SGTAGGRG-T | RPASAATAAK | ---------- | ---- | 495 |
| SEQ_ID_NO_1274 | DGGGFPRANG | N---NGRV-R | RGGGIDANRA | TKPVDDAPHV | SVTA | 488 |
| SEQ_ID_NO_1276 | GGDGYQRGEH | MGGNGGRV-S | RSGEATFNAS | TKNV--APRV | SAPA | 469 |
| SEQ_ID_NO_1280 | GGDGYRRADK | MGNNGGRA-N | RSGGLGLNGT | AKTT--APRV | SATA | 511 |

Figure 44

| SEQ_ID | Col1 | Col2 | Col3 | Col4 | Col5 | Col6 | Pos |
|---|---|---|---|---|---|---|---|
| SEQ_ID_NO_1327 | MVVTVAATG- | PDTAETLHST | TFASRYVRDQ | LPRYRMPENS | PKEAAYQII | | 49 |
| SEQ_ID_NO_1333 | MVVSVAATGA | GTDAEPVTST | FFASRYVRDP | LRRYRMPERS | PREAAYQII | | 50 |
| SEQ_ID_NO_1336 | MVVSVAATDS | DTAQPVQYST | FFASRYVRDP | LPRFRMPEQS | PREAAYQII | | 50 |
| SEQ_ID_NO_1319 | MVLTTTS-- | RDSEESLHCT | -FASRYVQEP | LPKFKMPKKS | MPKEAAYQIV | | 47 |
| SEQ_ID_NO_1302 | MVLATN---- | SDSDEHLHST | -FASRYVRAV | VPRFKMPDHC | MPKDAAYQVI | | 45 |
| SEQ_ID_NO_1311 | MVISTAA--- | TDSDENLYST | -FASRYVRTA | LPRFKMPENS | MPKDAAYQVI | | 46 |
| SEQ_ID_NO_1317 | MVLTSTATHP | DEQDQSLNYT | -FASRYVREP | PKFKMPEKS | PKDAAYQII | | 49 |
| SEQ_ID_NO_1305 | MLAAT----- | NPTEEHVHST | -FASRYVRAP | VPRFKMPEKS | PKDAAYQVI | | 44 |
| SEQ_ID_NO_1339 | MALSSA---- | TDSDGSIHST | -FASRYVQES | LPRFQIPSRS | PKDAAYQII | | 45 |
| SEQ_ID_NO_1318 | MVLSETA--- | THMDASVHST | -FASRYVRTS | LPRFKMGENS | PKEAAYQII | | 46 |
| SEQ_ID_NO_1331 | MVLSNTASSG | SESDLSIHST | -FASRYVRTS | LPRFKMPQES | PKEAAYQII | | 49 |
| SEQ_ID_NO_1313 | MVLSKTA--- | SESDVSIHST | -FASRYVRTS | LPRFEMPENS | PKEAAYQII | | 46 |
| SEQ_ID_NO_1303 | MVLSKTF--- | SESDESIHST | -FASRYVRNS | LPRFTMPENS | PKEAAYQII | | 46 |
| SEQ_ID_NO_1340 | MVLSKTA--- | SESDVSVHST | -FASRYVRAS | LPRFKMPENS | PKEAAFQII | | 46 |
| SEQ_ID_NO_1320 | MVLSKTA--- | SESDVSIHST | -FASRYVRTS | LPRFKMPENS | PKEAAYQII | | 46 |
| SEQ_ID_NO_1326 | MVLSKTV--- | SQSDVSIHST | -FASRYVRTS | LPRFKMPDNS | PKEAAYQII | | 46 |
| SEQ_ID_NO_1334 | MVLSKAV--- | SESDMSVHST | -FASRYVRAS | LPRYRMPENS | PKEAAYQII | | 46 |
| SEQ_ID_NO_1330 | MVLSHGV--- | GGSDESVHST | -FASRYVRTS | LPRYRMPEQS | PKEAAYQII | | 46 |

| SEQ_ID | Col1 | Col2 | Col3 | Col4 | Col5 | Pos |
|---|---|---|---|---|---|---|
| SEQ_ID_NO_1327 | SDELMLDGNP | RLNLASFVTT | MMEPECGKLI | NDSVNKNYVD | MDEYPVTTEL | 99 |
| SEQ_ID_NO_1333 | NDELMLDGNP | RLNLASFVTT | MMEPECDKLI | NGSINKNYVD | MDEYPVTTEL | 100 |
| SEQ_ID_NO_1336 | NDELMLDGNP | RLNLASFVTT | MMEPECDKLI | NDSVNKNYVD | MDEYPVTTEL | 100 |
| SEQ_ID_NO_1319 | NDELMLDGNP | RLNLASFVST | MMEPECDKLI | MSSINKNYVD | MDEYPVTTEL | 97 |
| SEQ_ID_NO_1302 | NDELMLDGNP | RLNLASFVTT | MMEPECDKLI | NDSVNKNYVD | MDEYPVTTEL | 95 |
| SEQ_ID_NO_1311 | NDELMLDGNP | RLNLASFVTT | MMEPECNDLI | MASINKNYVD | MDEYPVTTEL | 96 |
| SEQ_ID_NO_1317 | NDELMLDGAP | RLNLASFVTT | MMEPECDKLI | MASLNKNYVD | MDEYPVTTEL | 99 |
| SEQ_ID_NO_1305 | HDELMLDGNP | RLNLASFVTT | MMEPECDKLM | MAAINKNYVD | MDEYPVTTEL | 94 |
| SEQ_ID_NO_1339 | SDELMLDGNP | RLNLASFVTT | MMEPECDKLI | NQAINKNYVD | MDEYPVTTEL | 95 |
| SEQ_ID_NO_1318 | NDELMLDGNP | RLNLASFVTT | MMEPECDKLI | MASINKNYVD | MDEYPVTTEL | 96 |
| SEQ_ID_NO_1331 | NDELMLDGNP | RLNLASFVTT | MMEPECDKLI | MASINKNYVD | MDEYPVTTEL | 99 |
| SEQ_ID_NO_1313 | NDELMLDGNP | RLNLASFVTT | MMEPECDKLM | NESINKNYVD | MDEYPVTTEL | 96 |
| SEQ_ID_NO_1303 | NDELMLDGNP | RLNLASFVTT | MMEPECDKLM | MAAINKNYVD | MDEYPVTTEL | 96 |
| SEQ_ID_NO_1340 | NDELMLDGNP | RLNLASFVTT | MMEPECDKLI | ASINKNYVD | MDEYPVTTEL | 96 |
| SEQ_ID_NO_1320 | NDELMLDGNP | RLNLASFVTT | MMEPECNKLM | NDSINKNYVD | MDEYPVTTEL | 96 |
| SEQ_ID_NO_1326 | NDELMLDGNP | RLNLASFVTT | MMEPECDKLM | NDSINKNYVD | MDEYPVTTEL | 96 |
| SEQ_ID_NO_1334 | NDELMLDGNP | RLNLASFVTT | MMEPECDKLI | MAAINKNYVD | MDEYPVTTEL | 96 |
| SEQ_ID_NO_1330 | NDELMLDGNP | RLNLASFVTT | MMEPECDKLI | GASVNKNYVD | MDEYPVTTEL | 96 |

Figure 44 (continued)

| | | | | | | | |
|---|---|---|---|---|---|---|---|
| SEQ_ID_NO_1327 | QDRCVNMI AH | LFNAPI GEDE | TAI GVSTVGS | SEAI MLAGLA | FKRKWANKMK | 149 |
| SEQ_ID_NO_1333 | QNRCVNMI AH | LFNAPI KEDE | TAVGVGTVGS | SEAI MLAGLA | FKRKWQNKRK | 150 |
| SEQ_ID_NO_1336 | QNRCVNMI AH | LFNAPI KEDE | TAI GVGTVGS | SEAI MLAGLA | FKRKWQNKRK | 150 |
| SEQ_ID_NO_1319 | QNRCVNMLAH | LFHAPVGDDE | TAVGVGTVGS | SEAI MLAGLA | FKRKWQSKRK | 147 |
| SEQ_ID_NO_1302 | QNRCVNMI AN | FFHAPVGEDE | AAI GEGTVGS | SEAI MLAGLA | FKRKWQHRRK | 145 |
| SEQ_ID_NO_1311 | QNRCVNI I AH | LFNAPVGEKE | TAVGVGTVGS | SEAI MLAGLA | FKRKWQNKRK | 146 |
| SEQ_ID_NO_1317 | QNRCVNI I AN | FHAPI SDDE | TAVGVGTVGS | SEAI MLAGLA | FKRKWQTKRK | 149 |
| SEQ_ID_NO_1305 | QNRCVNMI AN | LFHAPVGEEE | TAVGVGTVGS | SEAI MLAGLA | FKRRWQHKRK | 144 |
| SEQ_ID_NO_1339 | QNRCVNI I AN | LFNAPLGDGE | EAVGVGTVGS | SEAI MLAGLA | FKRKWQNKRK | 145 |
| SEQ_ID_NO_1318 | QNRCVNMI AH | LFNAPLEDSE | PAVGVGTVGS | SEAI MLAGLA | FKRKWQNRRK | 146 |
| SEQ_ID_NO_1331 | QNRCVNMI AH | LFNAPLGDSD | L - - VGTVGS | SEAI MLAGLA | FKRTWQNRRK | 146 |
| SEQ_ID_NO_1313 | QNRCVNMI AR | LFNAPLGDGE | AAVGVGTVGS | SEAI MLAGLA | FKRQWQNKRK | 146 |
| SEQ_ID_NO_1303 | QNRCVNI I AR | LFNAPLEDSE | TAVGVGTVGS | SEAI MLAGLA | FKRKWQNKRK | 146 |
| SEQ_ID_NO_1340 | QNRCVNMI AH | LFNAPLGDSE | TAVGVGTVGS | SEAI MLAGLA | FKRKWQNKRK | 146 |
| SEQ_ID_NO_1320 | QNRCVNMI AH | LFNAPLGDGE | TAVGVGTVGS | SEAI MLAGLA | FKRKWQNKMK | 146 |
| SEQ_ID_NO_1326 | QNRCVNMI AH | LFNAPLEDGE | TAVGVGTVGS | SEAI MLAGLA | FKRKWQNKMK | 146 |
| SEQ_ID_NO_1334 | QNRCVNMI AH | LFHAPLGEDE | TAVGVGTVGS | SEAI MLAGLA | FKRRWQNKRK | 146 |
| SEQ_ID_NO_1330 | QNRCVNMI AH | LFNAPLGDAE | TAVGVGTVGS | SEAI MLAGLA | FKRRWQNKMK | 146 |

| | | | | | | | |
|---|---|---|---|---|---|---|---|
| SEQ_ID_NO_1327 | EQGKPCDKPN | VTGANVQVC | MEKFARYFEV | ELKEVKLTEG | YYVMDPKKAV | 199 |
| SEQ_ID_NO_1333 | EQGKPYDKPN | VTGANVQVC | MEKFARYFEV | ELKEVKLSEG | YYVMDPVKAV | 200 |
| SEQ_ID_NO_1336 | EQGKPCDKPN | VTGANVQVC | MEKFARYFEV | ELKEVKLSEG | YYVMDPVKAV | 200 |
| SEQ_ID_NO_1319 | AEGKPFDKPN | VTGANVQVC | MEKFARYFEV | ELKEVKLKEG | YYVMDPAKAV | 197 |
| SEQ_ID_NO_1302 | AQGLPIDKPN | VTGANVQVC | MEKFARYFEV | ELKEVKLSED | YYVMDPAKAV | 195 |
| SEQ_ID_NO_1311 | AEGKPYDKPN | VTGANVQVC | MEKFARYFEV | ELKEVKLTEG | YYVMDPVKAV | 196 |
| SEQ_ID_NO_1317 | AEGKPYDKPN | VTGANVQVC | MEKFARYFEV | ELKEVKLKEG | YYVMDPAKAV | 199 |
| SEQ_ID_NO_1305 | TEGKPTDNPN | VTGANVQVC | MEKFARYFEV | GLKEVKLKEG | YYVMDPEQAV | 194 |
| SEQ_ID_NO_1339 | AEGKPYDKPN | VTGANVQVC | MEKFARYFEV | ELKEVKLKKD | YYI MDPVKAV | 195 |
| SEQ_ID_NO_1318 | SEGKSCENPN | VTGANVQVC | MEKFARYFEV | ELKEVKLRDG | YYVMDPEKAA | 196 |
| SEQ_ID_NO_1331 | AEGKPHDKPN | VTGANVQVC | MEKFARYFEV | ELKEVKLSEG | YYVMDPQKAV | 196 |
| SEQ_ID_NO_1313 | AQGLPYDKPN | VTGANVQVC | MEKFARYFEV | ELKEVKLREG | YYVMDPEKAV | 196 |
| SEQ_ID_NO_1303 | AEGKPFDKPN | VTGANVQVC | MEKFARYFEV | ELKEVKLSEG | YYVMDPAKAV | 196 |
| SEQ_ID_NO_1340 | AEGKPYDKPN | VTGANVQVC | MEKFARYFEV | ELKEVKLSDG | YYVMDPEKAV | 196 |
| SEQ_ID_NO_1320 | AQGKPCDKPN | VTGANVQVC | MEKFARYFEV | ELKEVKLSDG | YYVMDPEKAV | 196 |
| SEQ_ID_NO_1326 | AQGKPCDKPN | VTGANVQVC | MEKFARYFEV | ELKEVKLSEG | YYVMDPEKAV | 196 |
| SEQ_ID_NO_1334 | AEGKPFDKPN | I TGANVQVC | MEKFARYFEV | ELKEVKLRDG | YYVMDPEKAV | 196 |
| SEQ_ID_NO_1330 | AAGKPCDKPN | VTGANVQVC | MEKFARYFEV | ELKEVKLSDG | YYVMDPQKAV | 196 |

Figure 44 (continued)

| | | | | | | |
|---|---|---|---|---|---|---|
| SEQ_ID_NO_1327 | EMVDENTICV | AAILGSTLTG | EYEDVKLLND | LLVEKNKETG | MNVPIHVDAA | 249 |
| SEQ_ID_NO_1333 | DMVDENTICV | AAILGSTLTG | EFEDVKQLND | LLTEKNKETG | MDVPIHVDAA | 250 |
| SEQ_ID_NO_1336 | EMVDENTICV | AAILGSTLTG | FFEDVKLLNN | LLTEKNKETG | MDVPIHVDAA | 250 |
| SEQ_ID_NO_1319 | EIVDENTICV | AAILGSTLTG | EFEDVKLLNE | LLTKKNKETG | METPIHVDAA | 247 |
| SEQ_ID_NO_1302 | EMVDENTICV | AAILGSTLTG | EFEDVKQLND | LLAEKNAETG | METPIHVDAA | 245 |
| SEQ_ID_NO_1311 | EMVDENTICV | AAILGSTLTG | EFEDVKLLND | LLSKKNKETG | MNTPIHVDAA | 246 |
| SEQ_ID_NO_1317 | EMVDENTICV | AAILGSTMTG | EFEDVKLLDE | LLTKKNNETG | MDTPIHVDAA | 249 |
| SEQ_ID_NO_1305 | ELVDENTICV | AAILGSTLTG | EFEDVKTLND | LLMKKNEETG | MGTPIHVDAA | 244 |
| SEQ_ID_NO_1339 | EMVDENTICV | AAILGSTYNG | EFEDVKLVND | LLIQKNKETG | MDTPIHVDAA | 245 |
| SEQ_ID_NO_1318 | EMVDENTICV | AAILGSTLNG | EFEDVKRLND | LLVEKNAETG | MDTPIHVDAA | 246 |
| SEQ_ID_NO_1331 | DLVDENTICV | AAILGSTLNG | EFEDVKRLND | LLIEKNKETG | MDTPIHVDAA | 246 |
| SEQ_ID_NO_1313 | EMVDENTICV | AAILGSTLTG | EFEDVKLLND | LLVEKNKQTG | MDTGIHVDAA | 246 |
| SEQ_ID_NO_1303 | EMVDENTICV | AAILGSTLNG | EFEDVKLLND | LLTEKNKETG | ADTPIHVDAA | 246 |
| SEQ_ID_NO_1340 | QMVDENTICV | AAILGSTLNG | EFEDVKLLND | LLVEKNKSTG | MDTPIHVDAA | 246 |
| SEQ_ID_NO_1320 | EMVDENTICV | AAILGSTLNG | EFEDVKRLND | LLIEKNKETG | MDTPIHVDAA | 246 |
| SEQ_ID_NO_1326 | EMVDENTICV | AAILGSTLNG | EFEDVKRLND | LLVEKNKETG | MDTPIHVDAA | 246 |
| SEQ_ID_NO_1334 | DMVDENTICV | AAILGSTLNG | EFEDVKLLND | LLDKKNKETG | METPIHVDAA | 246 |
| SEQ_ID_NO_1330 | DMVDENTICV | AAILGSTLNG | EFEDVKLLND | LLTKKNAETG | MDTPIHVDAA | 246 |

| | | | | | | |
|---|---|---|---|---|---|---|
| SEQ_ID_NO_1327 | SGGFIAPFLQ | PELEWDFRLP | LVKSINVSGH | KYGLVYPGVG | WIWRSKDDL | 299 |
| SEQ_ID_NO_1333 | SGGFIAPFLY | PELEWDFRLP | LVKSINVSGH | KYGLVYAGVG | WIWRSKKDL | 300 |
| SEQ_ID_NO_1336 | SGGFIAPFLY | PELEWDFRLP | LVKSINVSGH | KYGLVYPGVG | WIWRSKEDL | 300 |
| SEQ_ID_NO_1319 | SGGFIAPFLW | PDLEWDFRLP | LVKSINVSGH | KYGLVYAGVG | WIWRSKEDL | 297 |
| SEQ_ID_NO_1302 | SGGFIAPFLY | PDLEWDFRLP | WKSINVSGH | KYGLVYAGVG | WVWRTKDDL | 295 |
| SEQ_ID_NO_1311 | SGGFIAPFIW | PDLEWDFRLP | LVKSINVSGH | KYGLVYAGVG | WVWRTKEDL | 296 |
| SEQ_ID_NO_1317 | SGGFIAPFLY | PDLEWDFRLP | LVKSINVSCH | KYGLVYPGVG | WVWRSKDDL | 299 |
| SEQ_ID_NO_1305 | SGGFIAPFLY | PDLEWDFRLP | LVKSINVSGH | KYGLVYAGVG | WVWRNKEDL | 294 |
| SEQ_ID_NO_1339 | SGGFIAPFLY | PELEWDFRLP | LVKSINVSGH | KYGLVYAGIG | WIWRAKQDL | 295 |
| SEQ_ID_NO_1318 | SGGFIAPFLY | PELVMDFRLS | LVKSINVSGH | KYGLVYAGIG | MIWRSKEDL | 296 |
| SEQ_ID_NO_1331 | SGGFIAPFIY | PELEWDFRLP | LVKSINVSGH | KYGLVYAGIG | WIWRNKEDL | 296 |
| SEQ_ID_NO_1313 | SGGFIAPFLY | PELEWDFRLP | LVKSINVSGH | KYGLVYAGIG | WVWRTKSDL | 296 |
| SEQ_ID_NO_1303 | SGGFIAPFLY | PELEWDFRLP | LVKSINVSGH | KYGLVYAGIG | WVWRNKEDL | 296 |
| SEQ_ID_NO_1340 | SGGFIAPFIY | PELEWDFRLP | LVKSINVSGH | KYGLVYAGIG | WIWRNKEDL | 296 |
| SEQ_ID_NO_1320 | SGGFIAPFLY | PELEWDFRLP | LVKSINVSGH | KYGLVYAGIG | MAWRNKEDL | 296 |
| SEQ_ID_NO_1326 | SGGFIAPFIY | PELEWDFRLP | LVKSINVSGH | KYGLVYAGIG | WVWRNKDDL | 296 |
| SEQ_ID_NO_1334 | SGGFIAPFLY | PELEWDFRLP | WKSINVSGH | KYGLVYAGIG | WCWRNKEDL | 296 |
| SEQ_ID_NO_1330 | SGGFIAPFLY | PELEWDFRLP | LVKSINVSGH | KYGLVYAGIG | WCWRTKVDL | 296 |

Figure 44 (continued)

| SEQ_ID_NO | | | | | | | |
|---|---|---|---|---|---|---|---|
| SEQ_ID_NO_1327 | PEELIFHINY | LGADQPTFTL | NFSKGQ-QII | AQYYQLIRLG | FEGYKHIMEN | | 348 |
| SEQ_ID_NO_1333 | PEELIFHINY | LGTDQPTFTL | NFSKGSSQII | AQYYQLIRLG | FQGYKNIMEN | | 350 |
| SEQ_ID_NO_1336 | PEELIFHINY | LGIDQPTFTL | NFSKGSSQII | AQYYQLIRLG | FEGYKNIMQN | | 350 |
| SEQ_ID_NO_1319 | PDELVFHINY | LGSDQPTFTL | NFSKGSYQII | AQYYQLIRLG | FEGYKNVMKN | | 347 |
| SEQ_ID_NO_1302 | PEELVFHINY | LGADQPTFTL | NFSKGSSQII | AQYYQFIRLG | FEGYKNIMEN | | 345 |
| SEQ_ID_NO_1311 | PDELIFHINY | LGSDQPTFTL | NFSKGSGQII | AQYYQFIRLG | FEGYKRIMEN | | 346 |
| SEQ_ID_NO_1317 | PDELVFHINY | LGSDQPTFTL | NFSKGSSQII | AQYYQLIRLG | FEGYKNIMEN | | 349 |
| SEQ_ID_NO_1305 | PDDLVFHINY | LGSDQPTFTL | NFSKGSSQII | AQYYQFLRLG | FEGYKNIIEN | | 344 |
| SEQ_ID_NO_1339 | PEELIFHINY | LGADQPTFTL | NFSKGASQII | AQYYQLIRLG | FEGYRNIMGN | | 345 |
| SEQ_ID_NO_1318 | PEELIFHINY | LGADQPTFTL | NFSKGSSQVI | AQYYQLIRLG | YEGYRNVMEN | | 346 |
| SEQ_ID_NO_1331 | PEELIFHINY | LGADQPTFTL | NFSKGSSQII | AQYYQLIRLG | YEGYKHVMEN | | 346 |
| SEQ_ID_NO_1313 | PDELIFHINY | LGADQPTFTL | NFSKGSSQVI | AQYYQLIRLG | FEGYRNVMDN | | 346 |
| SEQ_ID_NO_1303 | PEELIFHINY | LGADQPTFTL | NFSKGSSQVI | AQYYQLIRLG | FEGYRNVMEN | | 346 |
| SEQ_ID_NO_1340 | PEELIFHINY | LGADQPTFTL | NFSKGSSQVI | AQYYQLIRLG | YEGYKNVMEN | | 346 |
| SEQ_ID_NO_1320 | PDELIFHINY | LGADQPTFTL | NFSKGSSQVI | AQYYQLIRLG | FEGYKNVMEN | | 346 |
| SEQ_ID_NO_1326 | PDELIFHINY | LGADQPTFTL | NFSKGSSQVI | AQYYQLIRLG | YEGYKNVMEN | | 346 |
| SEQ_ID_NO_1334 | PEELIFHINY | LGADQPTFTL | NFSKGSSQVI | AQYYQLIRHG | FEGYRNIMEN | | 346 |
| SEQ_ID_NO_1330 | PEELIFHINY | LGADQPTFTL | NFSKGSSQVI | AQYYQLIRLG | FEGYKNIMEN | | 346 |

| SEQ_ID_NO | | | | | | | |
|---|---|---|---|---|---|---|---|
| SEQ_ID_NO_1327 | CKLNAAVLKE | GIDATGRFDV | LSKADGVPLV | ALRLKDSTNF | SVFDISENLR | | 398 |
| SEQ_ID_NO_1333 | CMENAAILRE | GIAATGRFDI | LSKDAGVPLV | AFSLKDSSRF | SVFDISENLR | | 400 |
| SEQ_ID_NO_1336 | CMENTAILRE | GIEATGRFE | LSKEAGVPLV | AFSLKDSGRY | TVFDISEHLR | | 400 |
| SEQ_ID_NO_1319 | CLSNAKVLTE | GITKMGRFDI | VSKDVGVPVV | AFSLRDSSKY | TVFEVSEHLR | | 397 |
| SEQ_ID_NO_1302 | CMDNARRLRE | GIEMTGKFNI | VSKDIGVPLV | AFSLKDSSKH | TVFEIAESLR | | 395 |
| SEQ_ID_NO_1311 | CLENARVLRE | GLEKTGRFDI | VSKDKGVPLV | AFSLKDSSKH | TVFEIAESLR | | 396 |
| SEQ_ID_NO_1317 | CMENARVLKE | GIERTGRFNI | ISKDIGVPLV | AFSLQDSSQH | TVFEIADHLR | | 399 |
| SEQ_ID_NO_1305 | CMENMKVLKQ | GIENTGRFNI | LSKDIGVPLV | AFSLKDSSKH | TVFEIAENLR | | 394 |
| SEQ_ID_NO_1339 | CAANAKALSD | GLVRTGRFNI | LSKEIGVPLV | AFSLKDSSRH | DEYEISDHLR | | 395 |
| SEQ_ID_NO_1318 | CRDNMMVLKD | GLEKTERFE | VSKDEGVPLV | AFTLKDHNNF | NEFQISDMLK | | 396 |
| SEQ_ID_NO_1331 | CRDNMLVLKE | GLQKTGRFE | VSKDNGVPLV | AFTLKDHTHY | NEFQISDSL | | 395 |
| SEQ_ID_NO_1313 | CRENMMVLRE | GLEKTGRFNI | VSKENGVPLV | AFSLKDSSRH | DEFEVAETLR | | 396 |
| SEQ_ID_NO_1303 | CHENAMVLKE | GLEKTGRFNI | VSKDEGVPLV | AFSLKDNKRH | DEFEVAELLR | | 396 |
| SEQ_ID_NO_1340 | CRDNMLVLKQ | GLEKTGKFNI | VSKDKGVPLV | AFSLKDNSLH | NEFEVSDMLR | | 396 |
| SEQ_ID_NO_1320 | CQENARVLRE | GLEKSGRFNI | ISKEIGVPLV | AFSLKDNSQH | NEFEISETLR | | 396 |
| SEQ_ID_NO_1326 | CQENASVLRE | GLEKTGRFNI | ISKEIGVPLV | AFSLKDNRQH | NEFEISETLR | | 396 |
| SEQ_ID_NO_1334 | CHENAMVLKE | GLVKTGRFDI | VSKDEGVPLV | AFSLKDRSRH | DEFEISDMLR | | 396 |
| SEQ_ID_NO_1330 | CQENATVLKQ | GLEKTGKFNI | VSKDNGVPLV | AFSLKDSSRH | SEFEISDFLR | | 396 |

Figure 44 (continued)

| SEQ ID | col1 | col2 | col3 | col4 | col5 | col6 | num |
|---|---|---|---|---|---|---|---|
| SEQ_ID_NO_1327 | RFGWI VPAYT | MPADAEHVAV | LRI VI REDFN | RSLAQRLLAD | NKI I GELDA | | 448 |
| SEQ_ID_NO_1333 | RFGWI VPAYT | MPADAEHVAV | LRVVI REDFS | RTLLERLVGD | VLKI LRELDA | | 450 |
| SEQ_ID_NO_1336 | RFGWI VPAYT | MPANAEHVAV | LRVVI REDFS | RSLAERLVSD | VKI LHELDA | | 450 |
| SEQ_ID_NO_1319 | RFGWI VPAYT | MPPDAEHI AV | LRVVI REDFS | HSLAERLVSD | EKI LSELDT | | 447 |
| SEQ_ID_NO_1302 | KFGWI PAYT | MPADAQHI AV | LRVVI REDFS | RGLADRLI TH | QVLKEI EG | | 445 |
| SEQ_ID_NO_1311 | RFGWI PAYT | MPANAQHI AV | LRVVVREDFN | RSLAERLVSH | DQVMKETDS | | 446 |
| SEQ_ID_NO_1317 | KFGWI VPAYT | MPPDAQHI AV | LRVVI REDFS | RGLAERLAAD | EKVVKLLDT | | 449 |
| SEQ_ID_NO_1305 | RFGWI LPAYT | MPANAQHVAV | LRAVI REDFS | HGLAKRLVAH | EQVLKEMDG | | 444 |
| SEQ_ID_NO_1339 | RFGWI VPAYT | MAPDAQEVKL | LRVVVREDFN | RSLAERLVHD | EKVLHELDT | | 445 |
| SEQ_ID_NO_1318 | RHGWI PAYT | MPPDAEHVTV | LRVVI REDFS | RTFAERLVI D | TRVI HELDL | | 446 |
| SEQ_ID_NO_1331 | --------- | ---------A | LRVL...... | .......... | .........DS | | 401 |
| SEQ_ID_NO_1313 | RFGWI VPAYT | MPADAQHVTV | LRVVI REDFS | RTLAERLVAD | FEKVLHELDT | | 446 |
| SEQ_ID_NO_1303 | RFGWI VPAYT | MPADAQHI TV | LRVVI REDFS | RTLAERLVLD | TKVLHELDS | | 446 |
| SEQ_ID_NO_1340 | RFGWI VPAYT | MPPDAQHVTV | LRVVI REDFS | RTLAERLVI D | GKVLHELET | | 446 |
| SEQ_ID_NO_1320 | RFGWI PAYT | MPPNAQHVTV | LRVVI REDFS | RTLAERLVI D | EKVLHELDT | | 446 |
| SEQ_ID_NO_1326 | RFGWI VPAYT | MPPNAQHI TV | LRVVI REDFS | RTLAERLVRD | EKVLHELDT | | 446 |
| SEQ_ID_NO_1334 | RFGWI VPAYT | MPPDAQHVTV | LRVVI REEFS | RTLAERLVLD | EKVMYQLDA | | 446 |
| SEQ_ID_NO_1330 | RFGWI VPAYT | MPPDAQHVTV | LRVVI REDFS | RTLAERLVLD | EKVLHELDA | | 446 |

| SEQ ID | col1 | col2 | col3 | col4 | col5 | num |
|---|---|---|---|---|---|---|
| SEQ_ID_NO_1327 | HAVHAI KLST | AAAGGDG--- | .......... | .......... | A SKSAVDAATE | 476 |
| SEQ_ID_NO_1333 | CATHAVRYAT | ATAAVQSGDG | GGVVARK--- | .......... | S I LEI FREVAS | 489 |
| SEQ_ID_NO_1336 | HSAQVLKI SS | AI AKQQSGDD | GVVTKK---- | .......... | S VLETEREI FA | 487 |
| SEQ_ID_NO_1319 | QPPRLPTKAV | RVTAEEVRDD | KGDGLHHFHM | .......... | D TVETQKDI K | 488 |
| SEQ_ID_NO_1302 | LPSRI AHLAA | AAAVSGDDEE | VKVK------ | .......... | T AKMSLEDI TK | 480 |
| SEQ_ID_NO_1311 | LPSRVAVQAS | RI VTVDETQD | NMDGKKTVKK | .......... | S SREI DEFVTL | 487 |
| SEQ_ID_NO_1317 | LPSPLTTKAV | HI TAI TSETG | EKI KK----- | .......... | A AI ETQKEI AF | 485 |
| SEQ_ID_NO_1305 | LPSGI DHKK- | .......... | .......... | .......... | A ERETQEEVFR | 464 |
| SEQ_ID_NO_1339 | LPSKI AREVV | ASLYDGHPEL | KEVKDLGI DV | TQFKSSAVFN | EI VNSQKAVK | 495 |
| SEQ_ID_NO_1318 | VPSRVVSTNT | I TVTGGEEDA | DNDGTVTI AN | Q--------- | S VLETQRKI TT | 488 |
| SEQ_ID_NO_1331 | AGI QHAPKYS | A--------- | .......... | .......... | .......... | 412 |
| SEQ_ID_NO_1313 | LPARVQAKMA | NGNANGVKK | .......... | .......... | T EEETTREYTA | 476 |
| SEQ_ID_NO_1303 | LPSKVLVPAS | EQNGRNGKK | .......... | .......... | T EI ETQREVTT | 476 |
| SEQ_ID_NO_1340 | LPSRI SAKI V | LANEEKDAVA | AGKEKK---- | .......... | D VQNETREI T | 483 |
| SEQ_ID_NO_1320 | LPARVNAKLA | VAEANGSGVH | KK-------- | .......... | T DREVQLEI TT | 479 |
| SEQ_ID_NO_1326 | LPARVNAKLA | VAEEQAAANG | SEVHKK---- | .......... | T DSEVQLEM T | 493 |
| SEQ_ID_NO_1334 | LPSRLMPPVP | PAPLLVVAKK | .......... | .......... | S ELETQRSVTE | 477 |
| SEQ_ID_NO_1330 | LPARVPSGDL | AALAAAESSE | .......... | .......... | R EMEKQRQVS | 477 |

Figure 44 (continued)

| | | |
|---|---|---|
| SEQ_ID_NO_1327 | AFKDLAGK- - -KKAGVC- | 490 |
| SEQ_ID_NO_1333 | RMRDAVSK- - -KKTGPC- | 502 |
| SEQ_ID_NO_1336 | YMRDQVKK- - -KDTGIC- | 501 |
| SEQ_ID_NO_1319 | HWRKIAGK- - -KTSGVC- | 502 |
| SEQ_ID_NO_1302 | YWKRLVEH- - -KRNIVC- | 494 |
| SEQ_ID_NO_1311 | YMRRLASE- - -KRTGAC- | 501 |
| SEQ_ID_NO_1317 | YMKRLVDG- - -KRLGAC- | 499 |
| SEQ_ID_NO_1305 | CMKRLVDR- - -KIAGVC- | 478 |
| SEQ_ID_NO_1339 | AMKKFVAQ- - -KANRVC- | 509 |
| SEQ_ID_NO_1318 | AMKKFVMNRK - -KTNGVC- | 504 |
| SEQ_ID_NO_1331 | - - - - - - - - - - - -RDRGPCSH | 420 |
| SEQ_ID_NO_1313 | YWKKFVEAKK - SNKNRIC- | 493 |
| SEQ_ID_NO_1303 | YMRKFVSERK ANNKNKIC- | 494 |
| SEQ_ID_NO_1340 | AMRKLVVQRK - -KLNGVC- | 499 |
| SEQ_ID_NO_1320 | AMKKFVADKK K-KTNGVC- | 496 |
| SEQ_ID_NO_1326 | AMKKFVEEKK K-KTNRVC- | 500 |
| SEQ_ID_NO_1334 | AMKKFVLAK- - -RTNGVC- | 492 |
| SEQ_ID_NO_1330 | LMKRAVLAKK - -KTNGVC- | 493 |

Figure 45

| | | | | | |
|---|---|---|---|---|---|
| SEQ_ID_NO_1363 | ---------- | ---------- | ---------- | ---MSKTTNQ | NRRPSFTSST | 17 |
| SEQ_ID_NO_1373 | ---------- | ---------- | ---------- | ---------- | --------MVD | 3 |
| SEQ_ID_NO_1342 | ---------- | ---------- | ---------- | ---------- | ---------- | 0 |
| SEQ_ID_NO_1381 | ---------- | ---------- | ---------- | ---------- | ---------- | 0 |
| SEQ_ID_NO_1382 | ---------- | ---------- | ---------- | ---------- | ---------- | 0 |
| SEQ_ID_NO_1371 | ---------- | ---------- | ---------- | ---------- | ---------- | 0 |
| SEQ_ID_NO_1366 | ---------- | ---------- | ---------- | ---------- | ---------M | 1 |
| SEQ_ID_NO_1370 | ---------- | ---------- | ---------- | ---------- | ---------- | 0 |
| SEQ_ID_NO_1346 | ---------- | ---------- | ---------- | ---------- | ---------- | 0 |
| SEQ_ID_NO_1372 | ---------- | ---------- | ---------- | ---------- | ---------- | 0 |
| SEQ_ID_NO_1374 | ---------- | ---------- | ---------- | ---------- | --MKKQEKEA | 8 |
| SEQ_ID_NO_1355 | ---------- | ---------- | ---------- | ---------- | ---------- | 0 |
| SEQ_ID_NO_1364 | ---------- | ---------- | ---------- | ---------- | ---------- | 0 |
| SEQ_ID_NO_1378 | MGSRHQVVQQ | QNRGDVVPGA | IKQKSMAVEK | KNRRALGDIG | NVV-TVRGVE | 49 |
| SEQ_ID_NO_1377 | ---MNTNRAV | LVPHRGEVGG | KQKNGQADGR | NNRRVLGDIG | NLVTGAPVIE | 47 |
| SEQ_ID_NO_1379 | MGSRAVVVPD | QQPRGR--GG | KQKNGQAEGR | -NRRVLRDIG | NLV-PVPTVE | 46 |
| SEQ_ID_NO_1380 | ---------- | ---------- | ---------- | ---MAGADEN | HGAVKLANFR | 17 |
| SEQ_ID_NO_1383 | ---------- | ---------- | ---------- | ---------- | ---------- | 0 |

| | | | | | |
|---|---|---|---|---|---|
| SEQ_ID_NO_1363 | ESSMRKRHGP | SSSSSAVK-- | PISNTAVMVA | KKRAPLGNIT | ---------- | 55 |
| SEQ_ID_NO_1373 | EENKVPATAA | ASRGSNKR-- | AFDSAITNE | NDPLQISERP | ---------- | 41 |
| SEQ_ID_NO_1342 | ---------- | ---------- | ---------- | ---------- | ---------- | 0 |
| SEQ_ID_NO_1381 | -MADKENSTP | ASAARLTRSS | AAAGAQAKRS | AAAGVADGGA | ---------- | 39 |
| SEQ_ID_NO_1382 | -MADKENSTP | ASAARLTRSS | AAAGAQAKRS | AAAGVADGGA | ---------- | 39 |
| SEQ_ID_NO_1371 | ---------- | ---------- | -APSMTTPE- | ---------- | ---------- | 8 |
| SEQ_ID_NO_1366 | ATSENNSSAR | PQREAKKR-- | AAAASQIHG | N--------- | ---------- | 30 |
| SEQ_ID_NO_1370 | MADQDNSTRR | PQREAKKR-- | AVAALCE--- | ---------- | ---------- | 25 |
| SEQ_ID_NO_1346 | -MAEQENCTR | VTRAAKKR-- | AAALASTEDQ | ---------- | ---------- | 27 |
| SEQ_ID_NO_1372 | -MADKENCIR | VTRLAKKR-- | AVEAMAASEQ | Q--------- | ---------- | 28 |
| SEQ_ID_NO_1374 | IMADLENCGR | VTRLAKKR-- | AAEAMASHQQ | Q--------- | ---------- | 37 |
| SEQ_ID_NO_1355 | MADEKENCVR | MTRAATKRKA | SMEAAIDKE | ---------- | ---------- | 29 |
| SEQ_ID_NO_1364 | -MAENQNSTR | MTRAAAKR-- | KASVTDEN-- | ---------- | ---------- | 25 |
| SEQ_ID_NO_1378 | GKALPQVSRP | ITRGFCAQLI | ANAEAAAEN | NKNSLAVNAK | GADGALPIKR | 99 |
| SEQ_ID_NO_1377 | GKPKAQISRP | ATRSFCAQLL | ANAQAEKNKV | KPLAEVVNKV | ---------- | 87 |
| SEQ_ID_NO_1379 | EKPQNQISRP | VTRSLCVQ-- | PAAAEKKNK | KPLAEVVNGG | GEVKAAAAAH | 94 |
| SEQ_ID_NO_1380 | ETTNRRALKD | IKNFVGAP-- | SFPCAANKRQ | LKEVVCGNND | ---------- | 55 |
| SEQ_ID_NO_1383 | -MITGAQGVR | QTRSKTTY-- | EVPQQQQQS | FEW------- | ---------- | 30 |

Figure 45 (continued)

| | | | | | | |
|---|---|---|---|---|---|---|
| SEQ_ID_NO_1363 | -----NQRKD | SRIFPNSSSA | DSAHCPNKSA | KLKLAAPTQP | VCVNACETKS | 100 |
| SEQ_ID_NO_1373 | -----YPANK | KRVVLGELNN | LGNV------ | --IVSTQNSD | LTETHESKRK | 78 |
| SEQ_ID_NO_1342 | ------MGYL | WRVRLSSFAA | GAAT------ | --ASAAGFFL | LYKDHLLARA | 36 |
| SEQ_ID_NO_1381 | -----PPAKR | KRVALSDLPT | LSNA------ | --VVVAPRQP | HHPVVIKPSS | 76 |
| SEQ_ID_NO_1382 | -----PPAKR | KRVALSDLPT | LSNA------ | --VVVAPRQP | HHPVVIKPSS | 76 |
| SEQ_ID_NO_1371 | ------PASK | RRVVLGEISN | NSSA------ | --VSGNEDLL | CREFEVPKCV | 44 |
| SEQ_ID_NO_1366 | ------AAKK | KRVVLGDVTN | VSSS------ | ---------- | -----DVAVS | 53 |
| SEQ_ID_NO_1370 | ------QRKR | KRVALGDITN | DVVS------ | --ETEKLVSD | SHSHTQKKKK | 61 |
| SEQ_ID_NO_1346 | ------PLNK | KRVVLGELPN | LSNA------ | --IVSS---- | -NEPQKDKAK | 58 |
| SEQ_ID_NO_1372 | ------RPSK | KRVVLGELKN | LSSN------ | ---ISSIQTY | DFSSGPDKQQ | 63 |
| SEQ_ID_NO_1374 | ------HPSK | KRVVLGEIQN | FSNL------ | --GVSQIKGL | NTEPKKQPKS | 73 |
| SEQ_ID_NO_1355 | ------RINK | KRVVLGELPN | LSNT------ | ---------- | ----KKSRKA | 53 |
| SEQ_ID_NO_1364 | ------PVSK | KRVVLGELPN | NSNV------ | ----PAPLIP | LQERETQKPK | 59 |
| SEQ_ID_NO_1378 | AVAR--VPVQ | KKTVKSKPQE | IEISPDTEK | KKAPVLEKEI | TGEKSLKKKA | 147 |
| SEQ_ID_NO_1377 | ------PAKK | KASDKPAVQE | AVIVISPDEE | VKKKTIEKSP | LSKRKAKKTG | 131 |
| SEQ_ID_NO_1379 | KKHYDPPKPE | TVIVISSDEE | LESE------ | --EKKKPVAV | IARKSRVGSS | 136 |
| SEQ_ID_NO_1380 | -----SVIPR | RPITRQFAST | LASK------ | --SQQSHGET | SNKHGQITGN | 92 |
| SEQ_ID_NO_1383 | ------GRTS | QRTSHGKPRR | GSVM------ | -------GGT | MTTAGADVDM | 61 |

| | | | | | | |
|---|---|---|---|---|---|---|
| SEQ_ID_NO_1363 | TCEEVVPIE | RKAFSNLCIT | PSSDTTTNVM | SETENKEEKF | MNDNKDDAD | 150 |
| SEQ_ID_NO_1373 | IKLRKTRNVV | KETVELKTSA | NSSPK----- | ---------- | --------DN | 105 |
| SEQ_ID_NO_1342 | ADAESNSASY | SPPLATADTA | FSAPP----- | ---------- | RAVAP---AD | 68 |
| SEQ_ID_NO_1381 | KQPEPAAEAA | APSGGGGSP | VSSAST---- | ---------- | STASPSSGWD | 112 |
| SEQ_ID_NO_1382 | KQPEPAAEAA | APSGGGGSP | VSSAST---- | ---------- | STASPSSGWD | 112 |
| SEQ_ID_NO_1371 | AQKKRKRGVK | EDVGVDFGEK | F--------- | ---------- | --------DD | 67 |
| SEQ_ID_NO_1366 | VSKKPVQTHK | NVKLEKPAAP | VAIPE----- | ---------- | ---KVEERHD | 85 |
| SEQ_ID_NO_1370 | RNIAKSPVPE | KL-------- | ---------- | ---------- | --------ED | 75 |
| SEQ_ID_NO_1346 | AKPKARKGAS | TKKEGVLKED | VDGNP----- | ---------- | --------ED | 85 |
| SEQ_ID_NO_1372 | KNKNKRKAKE | SLGFEVKEKK | VEEAG----- | ---------- | IDVFSQS-DD | 97 |
| SEQ_ID_NO_1374 | KQQQSKRKLK | RAVTSKIDKE | ELNVD----- | ---------- | -NVDANY-DD | 106 |
| SEQ_ID_NO_1355 | TTKQKKKSVS | IPTIETLNSD | IDTRS----- | ---------- | --------DD | 80 |
| SEQ_ID_NO_1364 | STLFAAKKQT | KTPPIPQTVD | FESGS----- | ---------- | --------SD | 86 |
| SEQ_ID_NO_1378 | PTLTSTLTAR | SKAASVVRTK | PKEQI----- | ---------- | VDDAADVNN | 182 |
| SEQ_ID_NO_1377 | KTLTSTLTAR | SKAACGLSNR | PKNEI----- | ---------- | DDDAADAAN | 166 |
| SEQ_ID_NO_1379 | RTMTSILTAR | SKALCGPTTK | PKVPI----- | ---------- | ADDAADVDN | 171 |
| SEQ_ID_NO_1380 | EKHNPIIIDE | DVPMVEESEE | MEECELVEEI | TMEDIVIDSA | QDDIGDVGN | 142 |
| SEQ_ID_NO_1383 | RESYSTYLER | SSAADVMTDA | L--------- | ---------- | PDDLYDHDN | 92 |

Figure 45 (continued)

| | | | | | | | |
|---|---|---|---|---|---|---|---|
| SEQ_ID_NO_1363 | PQLYATFACD | YNHLRAAE- | -AKKQPAVDY | MEIVQKDVNS | TMRGILVDWL | | 198 |
| SEQ_ID_NO_1373 | LDKCS-YGPL | YQHLHSLEV | EERRRPLSNY | MEKVQNNVIP | SMRTVLVDWL | | 154 |
| SEQ_ID_NO_1342 | LDLSGSYASD | YTYLRSLEV | DPQRRSRSDY | IEAVQADVTA | HMRSILVDWL | | 118 |
| SEQ_ID_NO_1381 | PQ---YASD | YTYLRSMEV | EARRQSAADY | ESVQVDVTA | NMRAILVDWL | | 158 |
| SEQ_ID_NO_1382 | PQ---YASD | YTYLRSMEV | EARRQSAADY | EAVQVDVTA | NMRAILVDWL | | 158 |
| SEQ_ID_NO_1371 | PQMCSAYVSD | VYEYLKQMEM | ETKRRPMMNY | EQVQKDVTS | NMRGVLVDWL | | 117 |
| SEQ_ID_NO_1366 | PQLCGPYVSD | IYEYLRGMEV | DPSKRPLMDY | VQKIQRDVNA | NMRGVLVDWL | | 135 |
| SEQ_ID_NO_1370 | PQLCEPYVSD | HDYLRNLEV | DPSKRPLPDY | QKVQRDINA | NMRGVLVDWL | | 125 |
| SEQ_ID_NO_1346 | PQMCAPYASD | YEYLHKMEV | DPKRRPLPDY | EKVQKDVSP | NMRGILVDWL | | 135 |
| SEQ_ID_NO_1372 | PQMCGAYVSD | YEYLHKMEM | ETKRRPLPDY | LDKVQKDVTA | NMRGVLIDWL | | 147 |
| SEQ_ID_NO_1374 | PQMCSAYVSD | YDYLRKMEI | EEKRRPLPDY | LEKVQKDLSP | NMRGVLVDWL | | 156 |
| SEQ_ID_NO_1355 | PQMCGPYVTS | IFEYLRQLE- | -VKSRPLVDY | EKIQKDVTS | NMRGVLVDWL | | 128 |
| SEQ_ID_NO_1364 | PQMCGPFVAD | CAYLREMEG | KLKQRPLHDY | EKVQSDLTP | SMRGVLMDWL | | 136 |
| SEQ_ID_NO_1378 | DLAVVEYVED | MYKFYKSAE- | -NDSRPH-DY | MDFSQPEINE | KMRAILIDWL | | 228 |
| SEQ_ID_NO_1377 | HLAVVEYVED | YNFYKLTE- | -DESRVN-NY | MEFFQPELNH | KMRAILVDWL | | 212 |
| SEQ_ID_NO_1379 | ELAVVEYVED | YKFYKLTE- | -GESRVH-DY | MDFSQPEINS | KMRSILIDWL | | 217 |
| SEQ_ID_NO_1380 | PLAVVDYVDD | YNVYRRVE- | -ASSCVHPDY | MS-NQFDIND | KMRAILIDWL | | 189 |
| SEQ_ID_NO_1383 | PLAVTQYVND | YQYMYKVE- | -PDTRVSETY | M-LQGDINY | KMRAILIDWL | | 139 |

| | | | | | | | |
|---|---|---|---|---|---|---|---|
| SEQ_ID_NO_1363 | VEVSEEYRLV | PETLYLTVNY | IDRYLSGNVL | SRQKLQLLGV | ACMMIAA-KY | | 247 |
| SEQ_ID_NO_1373 | VEVTEEYKLV | SDTLYLAVSY | IDRFLSSHVL | AMEKLQLLGV | SCMLVAS-KY | | 203 |
| SEQ_ID_NO_1342 | VEVAEEYKLV | ADTLYLTISY | VDRFLSVNAL | GRDKLQLLGV | ASMLIAA-KF | | 167 |
| SEQ_ID_NO_1381 | VEVADEYKLV | ADTLYLAVSY | LDRYLSAHPL | RRNRLQLLGV | GAMLIAA-KY | | 207 |
| SEQ_ID_NO_1382 | VEVADEYKLV | ADTLYLAVSY | LDRYLSAHPL | RRNRLQLLGV | GAMLIAA-KY | | 207 |
| SEQ_ID_NO_1371 | VEVSLEYKLL | PETLYLAISY | VDRYLSVNVL | NRQKLQLLGV | SSFLIAS-KY | | 166 |
| SEQ_ID_NO_1366 | VEVAEEYKLV | SDTLYFSVAY | IDRFLSLNIL | SRQRLQLLGV | ASMLIAS-KY | | 184 |
| SEQ_ID_NO_1370 | VEVAEEYKLV | ADTLYFSVSY | IDRFLSLNDL | SRQKLQLLGV | SSMLIAS-KY | | 174 |
| SEQ_ID_NO_1346 | VEVAEEYKLV | SETLYLTVSY | VDRFLSFNVL | SRQRLQLLGV | SSMLLAS-KY | | 184 |
| SEQ_ID_NO_1372 | VEVAEEYKLL | PDTLYLTVSY | IDRFLSMNAL | SRQKLQLLGV | SSMLIAS-KY | | 196 |
| SEQ_ID_NO_1374 | VEVAEEYKLL | SDTLYLAVSY | IDRFLSTNV | TRQKLQLLGV | SSMLISA-KY | | 205 |
| SEQ_ID_NO_1355 | VEVAEEYKLL | SDTLYLAVSY | IDRFLSLKTV | NKQRLQLLGV | TSMLIAS-KY | | 177 |
| SEQ_ID_NO_1364 | VEVAEEYKLV | SDTLYLTVSY | VDRFLSAKPL | NRQRLQLVGV | SAMLIASRKY | | 186 |
| SEQ_ID_NO_1378 | VQVHYKFELS | PETLYLTIN | VDRYLASKTT | SRRELQLLGM | SSMLIAS-KY | | 277 |
| SEQ_ID_NO_1377 | LEVHRKFELM | PESLYLTIN | LDRFLSMKTV | PRKELQLVGI | SAMLIAC-KY | | 261 |
| SEQ_ID_NO_1379 | TEVHRKFELM | PETLYLTIN | VDRYLSMNAV | PRRELQLVGI | SSMLIAC-KY | | 266 |
| SEQ_ID_NO_1380 | VEVHYKFELM | EETLYLTVN | DRFLSRQAV | VRKKLQLVGV | TAMLLAC-KY | | 238 |
| SEQ_ID_NO_1383 | VEVHLKFKLM | PETLFLTTN | DRFLELKTV | TRRNLQLVGV | TAMLVAS-KY | | 188 |

Figure 45 (continued)

| | | | | | | | |
|---|---|---|---|---|---|---|---|
| SEQ_ID_NO_1363 | EEVCAPQVEE | FCYITDNTYL | KDEVLDMESA | VLNYLKFEMS | APTVKCFLRR | 297 |
| SEQ_ID_NO_1373 | EEISPPHVED | FCYITDNTYT | REEVVNMERD | LLSFLNFEIS | SPTTITFLRI | 253 |
| SEQ_ID_NO_1342 | EEISPPHPED | FCYITDNTYT | KEELLKMESD | LKLLKFELG | NPTIKTFLRR | 217 |
| SEQ_ID_NO_1381 | EEISPPHVED | FCYITDNTYT | RQEVVKMESD | LKLLEFEMG | NPTIKTFLRR | 257 |
| SEQ_ID_NO_1382 | EEISPPHVED | FCYITDNTYT | RQEVVKMESD | LKLLEFEMG | NPTIKTFLRR | 257 |
| SEQ_ID_NO_1371 | EEIKPKNVAD | FVDITDNTYS | QQEVVKMEAD | LLKTLKFEMG | SPTVKTFL-G | 215 |
| SEQ_ID_NO_1366 | EEIKPPEVED | FCYITDNTYS | KEEVVNMEAE | LKALKFELG | GPTVKTFLRR | 234 |
| SEQ_ID_NO_1370 | EEIKPPEVED | FCYITDNTYS | KEEVLSMEAE | LKTLKFELG | GPTIKTFLRR | 224 |
| SEQ_ID_NO_1346 | EEINPPHVED | FCYITDNTYT | KEEVVKMEAD | LKSLKFEMG | NPTIKTFLRR | 234 |
| SEQ_ID_NO_1372 | EEISPPHVED | FCYITDNTYK | KEEVVKMEAD | VLKFLKFEMG | NPTIKTFLRR | 246 |
| SEQ_ID_NO_1374 | EEISPPHVED | FCYITDNTYT | KEEVVKMEAD | VLKTLNFEMG | NPTVKTFLRR | 255 |
| SEQ_ID_NO_1355 | EEITPPNVDD | FCYITDNTYT | KQEIVKMEAD | LLALQFELG | NPTSNTFLRR | 227 |
| SEQ_ID_NO_1364 | EEISPPKVED | FMYITDNTFT | RQDVVSMEAD | LLALQFELG | CPTIKTFLRR | 236 |
| SEQ_ID_NO_1378 | EEIWAPEVND | LVCISDGSYS | NFQVLRMEKK | LGALEWYLT | VPTPYVFLVR | 327 |
| SEQ_ID_NO_1377 | EEIWAPEVND | FMHISDNWYT | RDHILQMEKA | LGKLEWYLT | VPTPYVFLVR | 311 |
| SEQ_ID_NO_1379 | EEIWAPEVSD | FIVISDNAYV | REQILIMEKA | LGKLEWYLT | VPTPYVFLVR | 316 |
| SEQ_ID_NO_1380 | EEVSVPNVDD | LVTISDRAYT | RKEVLDMEKS | IVKTLQFNTS | VPTPFVFLRR | 288 |
| SEQ_ID_NO_1363 | EEIWAPEVRD | FMYISDRAYT | RQQILEMEKQ | MLNTLGFHLT | VPTPYCFLNR | 238 |

| | | | | | | | |
|---|---|---|---|---|---|---|---|
| SEQ_ID_NO_1363 | LF-SGCPRVH | EAPCMQLECM | ASYIAELSLL | EY-TMLSHPP | SLVAASAIFL | 345 |
| SEQ_ID_NO_1373 | FL-KAAQDNL | SFLTLQFEFL | SCYLAELSLL | DY-SCVRFLP | SMTAASAIFL | 301 |
| SEQ_ID_NO_1342 | FI-RSAHEDK | KGSILLMEFL | GSYLAELSLL | DY-GCLRFLP | SVVAASVMFV | 265 |
| SEQ_ID_NO_1381 | FT-RSCQEDK | KRSSLLLEFM | GSYLAELSLL | DY-SCLRFLP | SVVAASVVFV | 305 |
| SEQ_ID_NO_1382 | FT-RSCQEDK | KRSSLLLEFM | GSYLAELSLL | DY-GCLRFLP | SVVAASVVFV | 305 |
| SEQ_ID_NO_1371 | FI-RAVQENP | DVPKLKFEFL | ANYLAELSLL | DY-GCLEFVP | SLIAASVTFL | 263 |
| SEQ_ID_NO_1366 | FS-RVGQEGV | DTSDLQFEFL | SCYLAELSLL | DY-NCIKFLP | SLVAASVVFL | 282 |
| SEQ_ID_NO_1370 | FITKVGQEGV | DASELQFEFL | CCYLAELSLL | DY-NCVKFLP | SMVAASVVFL | 273 |
| SEQ_ID_NO_1346 | FT-RVALEDY | KTSNLQLEFL | GFYLAELSLL | DY-NCVKFLP | SLVAASVIFL | 282 |
| SEQ_ID_NO_1372 | LT-RVVQDGD | KNPNLQFEFL | GYYLAELSLL | DY-GCVKFLP | SLIASSVIFL | 294 |
| SEQ_ID_NO_1374 | FT-GVAQEDY | KTPNLQLEFL | GYYLAELSIL | DY-SCVKYVP | SLLAAAVVFL | 303 |
| SEQ_ID_NO_1355 | FT-RVAQEDF | EMSHLQMEFL | CSYLSELSML | DY-QSVKFLP | STVAASAVFL | 275 |
| SEQ_ID_NO_1364 | FT-RVAQEDF | NESLLQIECL | CCYLSELSLL | DY-SCVKFLP | SMLAASAVFL | 284 |
| SEQ_ID_NO_1378 | FI-KASLPDS | DI----VEKNM | VYFLAELGMM | NYATII MYCP | SMIAAAAVYA | 372 |
| SEQ_ID_NO_1377 | YI-KAAMPSD | DQ---EIQNM | AFFEAELGLM | NYTTTISYCP | SMLAASAVYA | 357 |
| SEQ_ID_NO_1379 | FI-KASVPSN | DHRE-EMENM | VFFLAELGLM | HYPTIILYCP | SMIAASAVYA | 364 |
| SEQ_ID_NO_1380 | FL-KAAGSEK | K-----LELL | SSFIIELSLV | EY-QMLKFQP | SLLAAAAIYT | 331 |
| SEQ_ID_NO_1383 | FF-KAAGGDR | Q-----FQLY | ASYAVECALP | EY-GMLKYSG | STLAAGVYI | 281 |

Figure 45 (continued)

| | | | | | | | |
|---|---|---|---|---|---|---|---|
| SEQ_ID_NO_1363 | AKYTLDPTRR | PWNSTLRHYT | QYEAMELRGC | VMDLQRLCSN | AHV---STLP | | 392 |
| SEQ_ID_NO_1373 | SRFTVLPEVC | PWTLALQQCT | GYKPSELKDC | VLVIHELQSS | LME---ATGR | | 348 |
| SEQ_ID_NO_1342 | ARLTIDPNTN | PWNTKLQKMT | GYKVSELKDC | VAIHDLQLN | RKC---PSLT | | 312 |
| SEQ_ID_NO_1381 | AKLNIDPYTN | PWSKKMQKLT | GYKVSELKDC | LAIHDLQLR | KKC---SNLT | | 352 |
| SEQ_ID_NO_1382 | AKLNIDPYTN | PWSKKMQKLT | GYKVSELKDC | LAIHDLQLR | KKC---SNLT | | 352 |
| SEQ_ID_NO_1371 | ARFTIRPNVN | PWSIALQKCS | GYKSKDLKEC | VLLLHDLQMG | RRG---GSLS | | 310 |
| SEQ_ID_NO_1366 | ARFMFSTKTH | PWNSALHQLT | RYKPADLKEC | VLNLHDLYLS | RRG---ASLQ | | 329 |
| SEQ_ID_NO_1370 | ARFMLNPKSR | PWNSAICQFT | SYKPADLKEC | VLNMHDLYLS | RKG---ATLQ | | 320 |
| SEQ_ID_NO_1346 | TRFLMRPKTN | PWSSTLQQYT | GYKAADLREC | VLTIHDLYLS | RRG---GGLQ | | 329 |
| SEQ_ID_NO_1372 | SRFTLDPKVH | PWNSLLQHNS | GYKPADLKEC | VLIIHDLQLS | KRG---SSLV | | 341 |
| SEQ_ID_NO_1374 | SRFTLQPNTH | PWSLALQQYS | GYKAADLKEC | LILHDLQLS | RRG---GSLA | | 350 |
| SEQ_ID_NO_1355 | ARFIIRPKQH | PWNYMLEEYT | RYKAGDLKEC | VAMIHDLYLS | RKC---GALE | | 322 |
| SEQ_ID_NO_1364 | ARFIIRPKQR | PWNQMLEEYT | KYKASDLGQP | VGIIHDLYLS | RRG---NSLE | | 331 |
| SEQ_ID_NO_1378 | ARCTLNKMPI | -WNETLRMHT | GFSEVQLMDC | AKLLIDFHGG | STD---QKLQ | | 418 |
| SEQ_ID_NO_1377 | ARGTLNKGPL | -WTPTLQHHT | GYSEEQLMEC | TKQLVSYHKG | AAE---SKLK | | 403 |
| SEQ_ID_NO_1379 | ARCTLNSNPL | -WTETLKHHT | GYSEDOLGDC | AKMLARFHSD | GGGVEKSKLK | | 413 |
| SEQ_ID_NO_1380 | AQCSLKGFKF | -WTRTCEQYT | MYTEDQLLEC | SKMMVGFHRN | AGS---GKLT | | 377 |
| SEQ_ID_NO_1383 | AIRGLQTGS- | -WNHTMEAHT | RLSESEVYPC | ACDMAELMRK | APT---ATLT | | 326 |

| | | | | | | |
|---|---|---|---|---|---|---|
| SEQ_ID_NO_1363 | AVRDKYSQHK | YKFVAKKFCP | SIIPPDFFK- | ---NSLY- | | 425 |
| SEQ_ID_NO_1373 | ALREKYMNHK | YKCVAALHPP | -DIPSCFFD- | ---DA--- | | 378 |
| SEQ_ID_NO_1342 | AIRDKYKQHK | FKCVSLILVP | VVIPTSYFE- | ---DLAE- | | 345 |
| SEQ_ID_NO_1381 | AIRDKYKQHK | FKCVSTLLPP | VDIPASYLQ- | ---DLTE- | | 385 |
| SEQ_ID_NO_1382 | AIRDKYKQHK | FKCVSTLLPP | VDIPASYLQ- | ---DLTE- | | 385 |
| SEQ_ID_NO_1371 | AVRDKYKKHK | FKCVSTLSPA | PEIPESIFN- | ---DV-- | | 341 |
| SEQ_ID_NO_1366 | AVREKYKQHK | FKCVATTPSP | PEIPLSFFEF | EGQILRQL | | 367 |
| SEQ_ID_NO_1370 | AVRDKYKQHK | FKCVATTPSP | PEISLSFFEF | RGADP--- | | 355 |
| SEQ_ID_NO_1346 | AVREKYKQHK | FKCVANMPSP | PELPALYFE- | ---EVI-- | | 360 |
| SEQ_ID_NO_1372 | AVRDKYKQHK | FKCVSTLTAP | PSIPDEFFE- | ---DI--- | | 372 |
| SEQ_ID_NO_1374 | AVRDKYKQHK | FKCVSSLTSP | VEIPASFFE- | ---DMRQL | | 384 |
| SEQ_ID_NO_1355 | AIREKYKQHK | FKCVATMPVS | PELPLTNFE- | ---DVNI- | | 355 |
| SEQ_ID_NO_1364 | AVRNKYKQHK | FKCVATMPVS | PELPQAFFE- | ---DVTIR | | 365 |
| SEQ_ID_NO_1378 | GIYRKYSRLE | KGAVALLPQP | LLA------ | -------- | | 441 |
| SEQ_ID_NO_1377 | AIYRKFSSPD | RGAVALFPPA | RNLLPTTTT- | ---TTTSS | | 437 |
| SEQ_ID_NO_1379 | AVYKKFSSSD | RSSVALFPPA | RSLLLVL--- | -------- | | 440 |
| SEQ_ID_NO_1380 | GVHRKYSTSK | FGFAGKSYPA | LFLLDNRL-- | -------- | | 405 |
| SEQ_ID_NO_1383 | AVYKKYSSEK | FMKIATLPVP | HDLRL----- | -------- | | 351 |

Figure 46

```
SEQ_ID_NO_1404   -MA-------   ...SEWSKEE   NKLFEQAIAY   YGEGAPDLWH   KVSRAMGGTK   39
SEQ_ID_NO_1401   -MSGSRSSSP   NSKSEWSRKE   NKMFEEALAY   YGEDTPNRWD   KVASAMGGTK   49
SEQ_ID_NO_1400   -MAGSDSSSP   NSNSTWSLKE   NKMFEEALAY   YGESTPNLWD   KVSSAIGGTK   49
SEQ_ID_NO_1385   -MSASRSSSP   NSISQWSQKE   NKMFEEALAY   YGEGTSNRWD   KVSRAMGGTK   49
SEQ_ID_NO_1407   -MSASRSSSP   NSMSKWSPKE   NKMFEQALAY   YGESTPNRWD   KVSSAMGGTK   49
SEQ_ID_NO_1387   -MSSHQTPR    NSSSSWTPRE   NKLFEKALAL   FDKDTPDRWQ   NIAKAVGGVK   49
SEQ_ID_NO_1393   MASSSLSKQK   ASDSSWTPKQ   NKLFEKALAK   YDKDTPDRWQ   NVAKAYGGTK   49
SEQ_ID_NO_1390   MASSSMSSQ-   -SSGSWTAKQ   NKAFEQALAT   YDQDTPNRWQ   NVAKVVGGTK   47
SEQ_ID_NO_1395   --MSSMSSQH   GSSGSWTAKQ   NKAFEKALAV   YDKETRDRWS   NVAKAVGGTK   47
SEQ_ID_NO_1398   MASGSMS---   ---SSWTAKE   NKMFEKALAV   YDRDTPDRWH   KIARAIGGTK   43
SEQ_ID_NO_1396   -MASTRGSG-   ---RPWSAKE   NKAFERALAV   YDKDTPDRWA   NVARAVEGTR   44
SEQ_ID_NO_1394   MASSSMSAS-   ---GSWSVKE   NKAFERALAV   YDKDTPDRWY   NVAHAVGGTK   45

SEQ_ID_NO_1404   TADEVRLHFE   LVDDIKLIE   ARRVPFPKYN   TQGAWN----   ----------   75
SEQ_ID_NO_1401   SAEEIRCHYE   DLTDDVKTIE   SGRVDFPKYK   TQGYWT----   ----------   85
SEQ_ID_NO_1400   SAEEVRCHYE   DLVDDVKMIE   SGRVTYPKYK   TQGFWTRG--   ----------   87
SEQ_ID_NO_1385   SAEEVRCHYE   DLDYDVKMIE   SGHVPYPKYK   THGFWT----   ----------   85
SEQ_ID_NO_1407   SAEEVRCHYE   DLDYDVKMIE   SGHVPYPQYK   TQGFWTRGSL   MPTNYVGSNP   99
SEQ_ID_NO_1387   SAEEMKRHYE   FLIEDLKHIE   SGRVPIPNYK   SSRSYSNTNE   EER-------   92
SEQ_ID_NO_1393   SADEVKRHYE   ILEDLRHIE   SGHVPLPKYK   STGSSTNVEE   EERLLKYLKL   99
SEQ_ID_NO_1390   TTEEVKRHYE   LLVQDINSIE   NGHVPFPNYR   TSGGCTNGRL   SQEEKRYVLS   97
SEQ_ID_NO_1395   TAEEVKRHYE   LLRDVFFID   NGMVPFPKYK   TTGGSHNSTS   D---------   88
SEQ_ID_NO_1398   TADEVKRYYD   LLVEDVRRIE   AGQMPYANYR   SSNGRG----   ----------   79
SEQ_ID_NO_1396   TPEEVKKHYE   LVEDIKYIE   SGKVPFPNYR   TTGGNMKTDE   KRFRNLKIR-   93
SEQ_ID_NO_1394   TPEEVKKHYE   LLVEDIKHIE   SGKVPFPNYK   KISVSHEEKR   MRNMSLH---   92

SEQ_ID_NO_1404   ----------   75
SEQ_ID_NO_1401   ----------   85
SEQ_ID_NO_1400   ----------   87
SEQ_ID_NO_1385   ----------   85
SEQ_ID_NO_1407   SIMTKISYFQ   109
SEQ_ID_NO_1387   ----------   92
SEQ_ID_NO_1393   N---------   100
SEQ_ID_NO_1390   ----------   97
SEQ_ID_NO_1395   ----------   88
SEQ_ID_NO_1398   ----------   79
SEQ_ID_NO_1396   ----------   93
SEQ_ID_NO_1394   ----------   92
```

Figure 47

```
SEQ_ID_NO_1419    - - - - - - - - - -   - - - - - MSFYL   F - - - - - - - -   - - - - - - - - - -   - - FLFITMPL    14
SEQ_ID_NO_1421    - - - - - - - - - -   - - - - - MAC- -   F - - - - - - - -   - - - - - - - - - -   - - RSRSRAAA    12
SEQ_ID_NO_1409    - - - - - - - - - -   - - - - - MGQRR   F - - - - - - - -   - - - - - - - - - -   - - EDERAALA    14
SEQ_ID_NO_1425    - - - - - - - - - -   - - - - - MADC-   - - - - - - - - -   - - - - - - - - - -   - - -TTMRLAS    11
SEQ_ID_NO_1424    MEPWRWQI CL           VTPRSFLFQA        FVRTGFRAMR          VSSASSTPPP           PAFAAAAMAV     50
SEQ_ID_NO_1413    - - - - - - - - - -   - - - - - MNRRF   L - - - - - - - -   - - - - - - - - - -   - - FVLSSLSF    14
SEQ_ID_NO_1418    - - - - - - - - - -   - - - - - MRMEH   I - - - - - - - -   - - - - - - - - - -   - - YKFQHWLF    14
SEQ_ID_NO_1415    MEGELKMRGG            DLI RPGRFCI      L - - - - - - - -   - - - - - - - - - -   - - SVATISS     29

SEQ_ID_NO_1419    IVFCDF- - - -         - - - - - - - - - -   - -EMPSGSST   QIFHSFHE- -         - - - - - - - - -    36
SEQ_ID_NO_1421    VVVVTM- - -           - - - - - - - - - -   -LLLQACSEV   SASSSPQF- -         - - - -RKM- - -      38
SEQ_ID_NO_1409    TVASLL- - -           - - - - - - - - - -   -LILTTAQAA   AAAASGRH- -         - - - -LSLPT-        42
SEQ_ID_NO_1425    SMTIL- - -            - - - - - - - - - -   -LLLMASQAL   VVSGESSS- -         - - - -SAM- -        37
SEQ_ID_NO_1424    VLLAML- - -           - - - - - - -RSD     VALAAAASSN   DDTGLSPLMP          PPPPLAAPVP          89
SEQ_ID_NO_1413    AMLFLF- - -           - - - - - - - - - -   LVALFSGQGK   NINGSFGL- -         - - - -KLLR- -       42
SEQ_ID_NO_1418    FIGLGM- - -           - - - - - - - - - L   LSLSLSVKAN   DFEGSNDR- -         - - - -RSIALK        45
SEQ_ID_NO_1415    LLAVFFEDIY            HSSMHASSLV          SLLLNPVQTQ   SLTELFHL- -         - - - -KAVSEI         73

SEQ_ID_NO_1419    - - - - - - -DKN       GSLTVSEKVE          HAH- - - - - - -   - - - - - - - - - -   - - - - - -YTPR    56
SEQ_ID_NO_1421    - - - - - - - - - -   -LVSVNASSM          SSS- - - - - - -   - - - - - - - - - -   - GG- GGHSAE       58
SEQ_ID_NO_1409    - -QKAAAARM          NDTSSSDMQV          ITP- - - - - - -   - - - - - - - - - -   - APLAISTAA       72
SEQ_ID_NO_1425    - -QSKTLNMN          KLLNISED- -         HSP- - - - - - -   - - - - - - - - - -   - NG- GRHWMQ       64
SEQ_ID_NO_1424    AAVSPAPATP           PAVLSPRKLL          RPPGADVVGV   GFVSGSGGGG           GGGGGGDGVR          139
SEQ_ID_NO_1413    - -LRINQGNH          TLLTPHRKLL          RTA- - - - - - -   - - - - - - - - - -   - - - -LAEPN       68
SEQ_ID_NO_1418    A-RSFVSINE           NRTALSRKLL          LSP- - - - - - -   - - - - - - - - - -   - DI - -GDGTN      74
SEQ_ID_NO_1415    GSKKPVFYKE           NNTNFARKLL          QLP- - - - - - -   - - - - - - - - - -   - DA- - -GSITN     102

SEQ_ID_NO_1419    KFWFHGSCTK           - RDISISQSK          GST- - SGIPQ   YLVQIVNTCV           SG- - - - - - -    95
SEQ_ID_NO_1421    PLE-LEECSK           - DLLEVFQNN          APSMAGGMPT   YSVEITNTCI           - D- - - - - - -   97
SEQ_ID_NO_1409    RMG- PDGCSG          - EDVAVYQSS          ANPLPSGIPA   YTVRINVCS            GS- - - - - - -    112
SEQ_ID_NO_1425    RMQ- PDSCSE          - QNVMVYQNN          AEHLPSGIPT   YSVEIINVCT           - A- - - - - - -    103
SEQ_ID_NO_1424    TRRVDDGCAG           ADDIA YQGR           ATPLPSGVPA   YTVDVMNRCA           GGGGGGGDEE         189
SEQ_ID_NO_1413    RIW- GEKCSK          - ADIVLNQGP          TAPLPSGIPT   YTVEILNVCV           SG- - - - - - -    108
SEQ_ID_NO_1418    RIG- -QDCSK          - DDIVLFQGS          TNPLPSGVPS   YTVEIFNSCV           SD- - - - - - -    113
SEQ_ID_NO_1415    RIG- -AACSK          - DGIDIVQGS          TAPLPNGIPS   YTVQILNVCV           SG- - - - - - -    141
```

Figure 47 (continued)

| | | | | | | | |
|---|---|---|---|---|---|---|---|
| SEQ_ID_NO_1419 | CAPYDIHLHC | GWFASARIIN | PKLFKRLSYD | DCLVHGGKPL | TSNQIRFIY | | 145 |
| SEQ_ID_NO_1421 | CAVCDVHIAC | GDFASNDVID | PDKFRRLGFN | DCLVNGGGSI | EPSFPVSFQY | | 147 |
| SEQ_ID_NO_1409 | CTVYDVHVSC | GDFASTELVD | PAKFQRVGFN | DCVVKGGGAL | EPSETVSFQY | | 162 |
| SEQ_ID_NO_1425 | CTVYDVHISC | GEFASAELVD | PSQFQRIGFN | DCLVKGGGRL | GPSEAVSFQY | | 153 |
| SEQ_ID_NO_1424 | CAIAGIHVRC | GWFSSVSLVD | PRVFRRLGHD | DCLLNDGRPL | LAGETVSFEY | | 239 |
| SEQ_ID_NO_1413 | CDISGIHLTC | GWFSSARLIN | PKIFKRLRYN | DCLVNDGKPL | INGGTLSFQY | | 158 |
| SEQ_ID_NO_1418 | CNIAEIHVSC | GWFSSVRLVN | PRVFRRLDYD | DCLVNDGQPL | GPGQSLSFQY | | 163 |
| SEQ_ID_NO_1415 | CSISNIHVSC | GWFSSAKLIN | PSVFRRIYYD | DCLVNDGEPL | GPGETLSFQY | | 191 |

| | | | | | | | |
|---|---|---|---|---|---|---|---|
| SEQ_ID_NO_1419 | SNSFMYPLAF | KSARFC---- | ---------- | ---------- | ---------- | | 161 |
| SEQ_ID_NO_1421 | GNSFPYPMTV | ASABCDCN-- | ---------- | ---------- | ---------- | | 165 |
| SEQ_ID_NO_1409 | SNSFSYHLSV | ASVACR---- | ---------- | ---------- | ---------- | | 178 |
| SEQ_ID_NO_1425 | SNSFAYPLAV | ANVACFHYSI | VWASMIPCLP | EHACHTASSV | KGLGPRPHA | | 202 |
| SEQ_ID_NO_1424 | TNSFPYKLSV | SVATCVVDPA | AP-------- | ---------- | ---------- | | 261 |
| SEQ_ID_NO_1413 | ANTFLYPLSV | SRMVCS---- | ---------- | ---------- | ---------- | | 174 |
| SEQ_ID_NO_1418 | ANSFSYPLSV | ASVSCF---- | ---------- | ---------- | ---------- | | 179 |
| SEQ_ID_NO_1415 | ANSFLYPLSV | SSVACC---- | ---------- | ---------- | ---------- | | 207 |

Figure 48

```
SEQ_ID_NO_1436              ----------  --MTRPARFL  ETAATPPQPS  EQ--------  --------MLA   23
SEQ_ID_NO_1444              ----------  -MGVHARAMSWY TSPPGSPAPG  AAAEA-DHAL  SSSPRGGDTS   40
SEQ_ID_NO_1452              ----------  -MGVHGRSMGWY LGPPGSPAPG  AVAEADHAL   SSSPGGGDAS   41
SEQ_ID_NO_1428              ----------  --MHRL--LL   ESHGGGNETS  GSGGG-----  --DGYTRDMN   29
SEQ_ID_NO_1430              MMQAKTAMVT  TLYHRPHRLL   LDTQPNASPS  LPNGS----R  TRNAFANEAN   46
SEQ_ID_NO_1432              ----------  --MHR--RML   DTVPLDVAPA  NGN------R  THDSYINETN   30
SEQ_ID_NO_1439              ----------  ---------MPP ----------  SYGGG----N  TSDTFISDAN   19
SEQ_ID_NO_1442              ----------  --MRRLSDAG   EATPLLVTPA  AAAAAGGTLA  SPAAAGSNAN   37
SEQ_ID_NO_1453              ----------  --MRRLGDVV   EAPALVLTPA  SMQQA-----  -GGRGSSGA    31
SEQ_ID_NO_1457              ----------  --MRRLVDVV   EAPALVLTPA  WAATA----S  MQQAGGSSGA   34

SEQ_ID_NO_1436              AESDMVVILS  ALLCALICVA  GLAAVVRCAL  -MLRRFTTGE  NSPSANK---   68
SEQ_ID_NO_1444              FDTNMVVVLA  ALLFALLFAL  GINSLARCLI  RWARRAPAAE  GGGG------   84
SEQ_ID_NO_1452              FDTNMVIILA  ALLFALLFAL  GLNDLARCLI  RWARRASEGE  AGARGG----   87
SEQ_ID_NO_1428              FDANMVIILA  ALLCALILAL  GLNSILRCAM  RCGFGLSSSA  AAGTVADRAL   78
SEQ_ID_NO_1430              FDTNMVIILA  ALLCALICAL  GLNSIMRCTF  RCGRRFGLDA  TELTAARLAA   96
SEQ_ID_NO_1432              FDTNMVIILA  ALLCALIGAL  GLNSIVRCLL  RCSSRFALET  TEEAAARLAA   80
SEQ_ID_NO_1439              FDTNMVIILA  ALLCALICAL  GLNSIVARCAL RCGRPFGNET  AEQAAARLAG   69
SEQ_ID_NO_1442              FDANMVIILA  ALLCVLIFAL  GLNSVIRCVL  HCGRRLAPSS  SLAASATTAR   87
SEQ_ID_NO_1453              LDASMVVILA  ALLCVVICAL  GLTSLIRCAL  HCARGLSPTT  ATPTPSVSTA   81
SEQ_ID_NO_1457              LDANMVIVLA  ALLCVVICSL  GLSSLIRCAL  HCARGLSPSP  AMATPAAATT   84

SEQ_ID_NO_1436              ---------G  LKKKALQSLP  RSTFTAAEST  SGTAAEDG--  --GDSTECAI  105
SEQ_ID_NO_1444              ---------G  FEKRVLRSMP  VEVY------  -GAAAV----  --TVADVCAI  112
SEQ_ID_NO_1452              ---------G  KRRALRSIP   VEVY------  -GACGADGAA  A-VAADVCAI  120
SEQ_ID_NO_1428              ---------G  LKKRELKKFP  VAEV------  -GSGEVK---  --AATECAI   107
SEQ_ID_NO_1430              AT-------G  LKKSALRRLP  VAVY------  -GSGMD----  -MKATECPI   126
SEQ_ID_NO_1432              TL-------G  LKKRDLRQIP  VAIY------  -GAGGSL---  --SATECPI   109
SEQ_ID_NO_1439              TL-------G  LKKRELSRIP  VAVY------  -GAAGENT--  --PATECPI   100
SEQ_ID_NO_1442              TTTSVHVQAG  LKRKALRKIP  VEVY------  -GBAKSSGGA  LPATATECAX  130
SEQ_ID_NO_1453              AT-----AG   LKKTELRRIP  VEVY------  -GAKQAG---  --VPDGECAI  113
SEQ_ID_NO_1457              TG-------G  LKKKELRRIT  VEVY------  -GAKQAG---  --VPDAECAI  115
```

Figure 48 (continued)

| | | | | | | | | |
|---|---|---|---|---|---|---|---|---|
| SEQ_ID_NO_1436 | CLSDFADGEE | IRVLPLCGHS | FHVECIDKML | VSRSSCPXCR | XILRPV--X | | | 152 |
| SEQ_ID_NO_1444 | CLGEFADGEK | VRVLPRCTHG | FHVRCVDTWL | LSHDSCPTCR | ASVLDG---- | | | 158 |
| SEQ_ID_NO_1452 | CLGEFADGEK | VRVLPRCAHG | FHVRCVDTWL | LSHDSCPTCR | GTVLEAAAPG | | | 170 |
| SEQ_ID_NO_1428 | CLGEFADGER | VRVLPPCNHS | FHMSCIDTWL | VSHSSCPNCR | HSLIEV---- | | | 153 |
| SEQ_ID_NO_1430 | CLGEFMGGEK | VRVLPKCNHG | FHVRCIDTWL | LSHSSCPTCR | QSLLDQA--T | | | 174 |
| SEQ_ID_NO_1432 | CLGEFVDGEK | VRVLPKCNHG | FHVRCIDTWL | LSHSSCPNCR | HSLLEH---T | | | 156 |
| SEQ_ID_NO_1439 | CLGEFEKGDR | VRMLPKCNHG | FHVRCIDTWL | LSHSSCPNCR | HSLLEK---- | | | 146 |
| SEQ_ID_NO_1442 | CLGEFADGEK | VRVLPRCHHG | FHVRCIDMAL | ATHTSCPNCR | ASLAED---- | | | 176 |
| SEQ_ID_NO_1453 | CLGDFADGDK | VRVLPRCHHG | FHVRCIDTWL | AAHTSCPTCR | DSILSV---- | | | 159 |
| SEQ_ID_NO_1457 | CLGDFADGDK | VRVLPRCHHG | FHVGCIDTWL | AAHTSCPTCR | DSILSV---- | | | 161 |

| | | | | | | | |
|---|---|---|---|---|---|---|---|
| SEQ_ID_NO_1436 | CDRCGHASXA | GSQMKDHQHX | QHXSDITSXX | XTFXP | | 187 | |
| SEQ_ID_NO_1444 | --AKAATPAG | GGSRMQGSEA | AAIAVVIR-- | ----- | | 184 | |
| SEQ_ID_NO_1452 | KDKAAASAPA | GGSRRQGSEA | AAIAVVIG-- | ----- | | 198 | |
| SEQ_ID_NO_1428 | --------HVA | GSE------- | ---------- | ----- | | 159 | |
| SEQ_ID_NO_1430 | SSSDGAVEIE | NGIRPHGNSS | GGDQADVPVP | ADEVG | | 209 | |
| SEQ_ID_NO_1432 | TDSGAAQEVT | GAARPGENDP | GRQARGWP-- | -EHGG | | 188 | |
| SEQ_ID_NO_1439 | ---PAAAPES | GSGRRSEVVV | VVEQAS---- | ----- | | 169 | |
| SEQ_ID_NO_1442 | ----GAAAAN | GGGR------ | ---------- | ----- | | 186 | |
| SEQ_ID_NO_1453 | -----HGVVA | GGQT------ | ---------- | ----- | | 168 | |
| SEQ_ID_NO_1457 | -----HAGVT | GGQT------ | ---------- | ----- | | 170 | |

Figure 49

| | | | | | | | |
|---|---|---|---|---|---|---|---|
| SEQ_ID_NO_1473 | ---------- | --- | MKLVWCP | ETASQAFIAG | VSALSDAEHG | PAGSAG-VAE | 36 |
| SEQ_ID_NO_1474 | ---------- | ---------- | -MASKAYIDG | VRALAG--HD | LAGAAADVAE | | 27 |
| SEQ_ID_NO_1476 | MAPPPPPAAQ | VVRMKLVWCP | EMASKAYIDG | VRALAG--HD | LAGAAADVAE | | 48 |
| SEQ_ID_NO_1471 | ---------- | --- | MKLAWSP | ERASKAYIDT | VQSCQV--FR | ESG---VAE | 31 |
| SEQ_ID_NO_1463 | ---------- | --- | MKLVWSP | ETASDAYIDT | VKSCKS--DK | ESG---VAE | 31 |
| SEQ_ID_NO_1465 | ---------- | --- | MKLVWTP | DTALKAYVCI | VKTCED--FK | ESS---VAE | 31 |

| | | | | | | | |
|---|---|---|---|---|---|---|---|
| SEQ_ID_NO_1473 | LVSAMVGGWN | AQLVVEAPEV | SAPDSATMSL | ALAAAAGRTG | GRYARVLPDE | | 86 |
| SEQ_ID_NO_1474 | LVSAMAGGWN | ARLVVEAPDS | AAPAAAATSL | ALAAVARRTG | GRYALVLPDR | | 77 |
| SEQ_ID_NO_1476 | LVSAMAGGWN | ARLIVEAPDS | AAPAAAATSL | ALAAAARRTG | GRYALVLPDR | | 98 |
| SEQ_ID_NO_1471 | FISAMAAGWN | SQLIVETWSQ | GGL---ATSV | GLALARSHTC | GRHVCVVPDE | | 79 |
| SEQ_ID_NO_1463 | FLSATAAGWN | ARLIVETWSR | GDP---TTSV | GLAVAATHTG | GRHVCIVPDE | | 79 |
| SEQ_ID_NO_1465 | LLSAMAAGWN | AKLIVESWSK | AGP---ATSI | GLAVAAKHTC | GRHVCVVPDE | | 79 |

| | | | | | | | |
|---|---|---|---|---|---|---|---|
| SEQ_ID_NO_1473 | DA-------- | ---------- | ---DRAMA | ELEGVDFLVV | DARRRDGAAV | | 113 |
| SEQ_ID_NO_1474 | DAAASAAET | -------AEV | VVGEADEAMA | GLHGVDLLVV | DARRRDAAAV | | 120 |
| SEQ_ID_NO_1476 | DAAASAAET | -------AEV | VVGEADEAMA | GLHGVDLLVV | DARRRDAAAV | | 141 |
| SEQ_ID_NO_1471 | RARSEYAERM | GEAGVT-AEI | VVGEPEENME | GLVGVDFLVV | DSRRKDFTRV | | 128 |
| SEQ_ID_NO_1463 | QSKLEYVLAM | RGFVTTEVVV | VGESVFNTME | EFPGVDFLVV | DSKRREFVRT | | 129 |
| SEQ_ID_NO_1465 | GSRSEYVKAM | HGAGMRETEV | LVGEAEEVMA | GLVGVDFLVA | DCRRRDFVRV | | 129 |

| | | | | | | | |
|---|---|---|---|---|---|---|---|
| SEQ_ID_NO_1473 | LAAARPGPRG | MVVV-RHGDE | RRPGTKALEA | SMAAGT-RV | VRSVYLPVDK | | 160 |
| SEQ_ID_NO_1474 | LRAARPGARG | MVVV-RHGDG | RQRGAKDLAA | SMAAGT-RV | VRSVYLPIGK | | 167 |
| SEQ_ID_NO_1476 | LRAARPGARG | MVVV-RHGDG | RQRGAKDLAA | SMAAGT-RV | VRSVYLPIGK | | 188 |
| SEQ_ID_NO_1471 | LRLAKLSNKG | AVLLCKNANS | NSKGFIARS | LVAKGSRRV | VRSAFLPVGK | | 177 |
| SEQ_ID_NO_1463 | LRFAKLSNKG | AVLVCKNAMH | RAISGFKMHD | VLKRGT-RV | VRSVFLPVGS | | 177 |
| SEQ_ID_NO_1465 | LRFAKLSHKG | AVLACKNAFQ | QSVSGFKMHG | VLFRGT-RV | VKTAYLPVGQ | | 177 |

| | | | | | | | |
|---|---|---|---|---|---|---|---|
| SEQ_ID_NO_1473 | GVEVLHVGV | GKGPSLQCRR | SRSASSRWIR | HVDHKTGEEH | LFRRP | | 204 |
| SEQ_ID_NO_1474 | GVEVLHVGV | GKGPSLQNHR | DRRSTSRWIR | HVDHDTGEEH | VFRRQ | | 211 |
| SEQ_ID_NO_1476 | GVEVLHVGV | GKGPSLQNHR | DRRSTSRWIR | HVDHDTGEEH | VFRRQ | | 232 |
| SEQ_ID_NO_1471 | GLDMAHVSAS | GIG----N- | -NSSGHRWIK | HVDQHSGDVH | FIRR- | | 213 |
| SEQ_ID_NO_1463 | GLDIVHGAT | GRG-----D | SRNLRSRWIR | HVDHLSGEEH | LFRR- | | 215 |
| SEQ_ID_NO_1465 | GLDMAHIGSN | GIG----DKR | SRGGPSRWIK | HIDRKSGEEH | VFRE- | | 216 |

Figure 50

| SEQ_ID_NO_1493 | MTFLMPSPEV ---STAFAKI FSNPT-PRHK FLKSCAISKN DDEKVWSKTN | 46 |
| SEQ_ID_NO_1503 | MAFLLPKLTT ---PSCKLPP S--PL-LKPQ LADPVHGGGK IQGSVFGSVA | 44 |
| SEQ_ID_NO_1508 | MAFLLPKLTT PSGPSCKLPP S--PL-LKPQ LADPGHSGGK IQGSVSGAGA | 47 |
| SEQ_ID_NO_1501 | MAFLLPKLTT ---PPCRSPP P--SP-LKPQ LGLPSHGGGR ----LHGAGS | 40 |
| SEQ_ID_NO_1504 | MAFLLPKLTT ---PSCKSPP S--P--LKSD LGLPGGGKLQ ---------P | 34 |
| SEQ_ID_NO_1505 | MAFLLPKLTT ---PSCKSPP S--P--LKSD LGLPGGGKLQ ---------P | 34 |
| SEQ_ID_NO_1495 | MAFLLPNLSF ---PSLLINS KSFKDREKPV LYQTQTLPSH ---------- | 36 |
| SEQ_ID_NO_1499 | MAFLLPNLSL ---PSFLLQT GKSLK-EKPI STHSLSISSS -----SSSSN | 40 |
| SEQ_ID_NO_1491 | MAFLLSNLSS ---PSIHLQT GKYPN-LKPI FSQSLSSSSS ---------V | 37 |

| SEQ_ID_NO_1493 | ARVGVKDVGS TMSGLSQNLR LYVQFSAPVK -------RGS KSSKEEEEKQ | 89 |
| SEQ_ID_NO_1503 | AQVAAPGHLS LLLLLSASQQ AAAP-AAKST ATKNR---- QKGGGDPQRS | 89 |
| SEQ_ID_NO_1508 | AQVAAPGHLS LLLLLSAPQQ AADP-ASKST ATKNR---- QKGGGDPQRS | 91 |
| SEQ_ID_NO_1501 | AQAAAPTHLN LPLLLSASQQ EAP-TAKSA ETRNRAASGG GGGGDPRRS | 88 |
| SEQ_ID_NO_1504 | AQAVAPSHLN LLLLLGASQQ EAAAVPTPKS RSKNGGGRSG GGGGEDPRRS | 84 |
| SEQ_ID_NO_1505 | AQAVAPSHLN LLLLLGASQQ EAAAVPTPKS RSKNGGGRSG GGGGEDPRRS | 84 |
| SEQ_ID_NO_1495 | -YQTTTTTTS TTTKKPTNTN SSMPPPLQVK T------PPG AQDKEQHQRD | 79 |
| SEQ_ID_NO_1499 | SYEFEEGSLS LLSLPVQAP- -----PAPGA QVKTM--PSE QDKHQQHGKD | 82 |
| SEQ_ID_NO_1491 | SYEFVEENLS TLSLLSIQS- ---PI-PLKDIT QVQTR--HSS QDKHNNHDRD | 80 |

| SEQ_ID_NO_1493 | DYYVNMGYAI RTLRKELPDI FYRELSFDIY RDDIVFKDPL NTFLGIDNYK | 139 |
| SEQ_ID_NO_1503 | DFYLNLGTAV RTLRDDLPDV FVREPNYDIY REDITFVDPL NTFHGIDNYK | 138 |
| SEQ_ID_NO_1508 | DFYLNLGTAV RTLRDDLPDV FDREPNYDIY REDITFVDPL NTFHGIDNYK | 141 |
| SEQ_ID_NO_1501 | DFYLNLGAAV RALRDDLPAV FILREPNYDIY REDITFVDPL NTFHGIDNYK | 138 |
| SEQ_ID_NO_1504 | DYYLNLGTAV RTLRDDLPAV FVREPNYDIY REDITFVDPL NTFHGIDNYK | 134 |
| SEQ_ID_NO_1505 | DYYLNLGTAV RTLRDDLPAV FVREPNYDIY REDITFVDPL NTFHGIDNYK | 134 |
| SEQ_ID_NO_1495 | EFYVNLGLAV RTLREDLPVL FTEDLNYDIY RDDITFIDPL NTFTGIDNYK | 129 |
| SEQ_ID_NO_1499 | EFYINLGLAI RTLREDLPLL FSKDLNYDIY RDDITLVDPA NTFSGIENYK | 132 |
| SEQ_ID_NO_1491 | EFYINLGYAV RTLREDLPLL FTRDLNYDIY RDDITFVDPM NTFTGMDNYK | 130 |

| SEQ_ID_NO_1493 | SFFSAPRFHG RIFFKALNLD VSVWQPMEN VIMVRWIHG IPRVPWESHG | 189 |
| SEQ_ID_NO_1503 | TIFWALRFHG RLLFREIGLD VSRIWQLTEN SIVVRWELWG TPRVPWESYG | 188 |
| SEQ_ID_NO_1508 | TIFWALRFHG RLLFREIGLD VSRIWQLTET SIVVRWELWG TPRVPWESYG | 191 |
| SEQ_ID_NO_1501 | TIFWALRFHG RLLFSEIGLD VSRIWQLTET SIVVRWELWG TPRVPWESYG | 188 |
| SEQ_ID_NO_1504 | TIFWALRFHG RLLFREIGLD ISRIWQLTEN SIVVRWELWG TPRVPWESYG | 184 |
| SEQ_ID_NO_1505 | TIFWALRFHG RLLFREIGLD ISRIWQLTEN SIVVRWELWG TPRVPWESYG | 184 |
| SEQ_ID_NO_1495 | LFWALRFHG KMLFREISLE VYRIWQPSEN VILIRWNLKG VPRVPWEAKG | 179 |
| SEQ_ID_NO_1499 | LFWALRFHG KILFRDXXXE XYRVWQPSEN MLIRWNXKG VPRVPWEAKG | 182 |
| SEQ_ID_NO_1491 | IFWALRFHG KILFRDISLE IFRVWQPSEN MLIRWNLKG VPRVPWEAKG | 180 |

Figure 50 (continued)

| | | |
|---|---|---|
| SEQ_ID_NO_1493 | RFDGTSEYKL DKKGKI YEHR VDNTALNSPP KF-HMLAVED LIRSVGCPST | 238 |
| SEQ_ID_NO_1503 | CFSGTSRYKV DRNGKI YEHK VDNLALDFPR SVAKVGSIAD MV-VATP--S | 235 |
| SEQ_ID_NO_1508 | CFSGTSRYKV DRNGKI YEHK VDNLALDFPR SVAKVGSIAD MV-VATP--S | 238 |
| SEQ_ID_NO_1501 | CFSGTSRYKV DRNGKI YEHK VDNLALDFPR PAVKVSSITN LV-VAAYPPS | 237 |
| SEQ_ID_NO_1504 | CFSGTSRYKV DRNGKI YEHK VDNLALDFPR PAAKVGSIAD IV-VATCPPS | 233 |
| SEQ_ID_NO_1505 | CFSGTSRYKV DRNGKI YEHK VDNLALDFPR PAAKVGSIAD IV-VASCPPS | 233 |
| SEQ_ID_NO_1495 | EFQGTSRYKL DRNGKI YEHK VDNLAFNFPQ QLKPAASVLD LV--AACPAS | 227 |
| SEQ_ID_NO_1499 | EFQGTSRYKL DRNGKI YEHK VDNLAFNFPH QLKPATSVLD LV--TACPAS | 230 |
| SEQ_ID_NO_1491 | EFQGTSRYKL DRNGKI YEHK VDNLAFNFPQ QLKPAASVLD LV-TASPASS | 229 |

| | | |
|---|---|---|
| SEQ_ID_NO_1493 | PRPTY---- ---------- ---------F ELSSASPPEK NI-----IKP | 259 |
| SEQ_ID_NO_1503 | PNLTF-MNVV G-TGDGCSWT KLYEAVLEAV EREEHSSTGI GVGALGPVGC | 283 |
| SEQ_ID_NO_1508 | PNLTF-MNVV G-PGDGCSWT KLYEAVVEAV EREEHGSTGI GVGGL-PVPC | 285 |
| SEQ_ID_NO_1501 | PNPTF-MDVV G-TGDGCSWT KLYRAVLETV EREGDIPAGI CMEGL--LTC | 283 |
| SEQ_ID_NO_1504 | PNLTF-MDMV GSTGDGCSWA NLYQAVVETV EQEGNDPAGI AIEGL--LTC | 280 |
| SEQ_ID_NO_1505 | PNLTF-MDMV GSTGDGCSWA NLYQAVVETV EREGNDPAGI AIEGL--LTC | 280 |
| SEQ_ID_NO_1495 | PNPTFLMGPA D--VYSSSW EFYRAVRETL DXEN---STN CFCKM--ATC | 270 |
| SEQ_ID_NO_1499 | PNPTFMFGS- ---SYSSSW EFYQAVQRTL DKQQDQI--M MQDRF--VLC | 272 |
| SEQ_ID_NO_1491 | PNPTFFFSPV D--SYSSSW KFYQAVRGIL ETEDMFVTTD CL----VTC | 272 |

| | | |
|---|---|---|
| SEQ_ID_NO_1493 | P--------- | 260 |
| SEQ_ID_NO_1503 | G----CGCSF | 289 |
| SEQ_ID_NO_1508 | SFGCGCGSSF | 295 |
| SEQ_ID_NO_1501 | S--------- | 284 |
| SEQ_ID_NO_1504 | S--------- | 281 |
| SEQ_ID_NO_1505 | S--------- | 281 |
| SEQ_ID_NO_1495 | S--------- | 271 |
| SEQ_ID_NO_1499 | L--------- | 273 |
| SEQ_ID_NO_1491 | S--------- | 273 |

Figure 51

| | | | | | | | |
|---|---|---|---|---|---|---|---|
| SEQ_ID_NO_1520 | MDSLPKLR- | ---------- | -HPSPFPTPL | SSSLSFRSLP | PPHFPSSSFR | | 37 |
| SEQ_ID_NO_1510 | MESLGKLQLH | HQPFHLSFTH | TSSSTFPKNL | -----FKSSI | QPISSL--LK | | 42 |
| SEQ_ID_NO_1512 | MESLTKLHCR | LQPLHLSFNH | QRPSFAKPI | SSSVSFRTS- | ---SSSSPFK | | 45 |
| SEQ_ID_NO_1516 | MESVAKLHCR | HQPFNLSLNP | HRPSFPKPI | -ISLSFKTPP | PSSSSPFKLS | | 48 |

| | | | | | | | |
|---|---|---|---|---|---|---|---|
| SEQ_ID_NO_1520 | LPSIRASSSP | SQNDPAFRTP | RNTPSLPPLL | QTLTSFLSPL | LETTCIVLLA | | 86 |
| SEQ_ID_NO_1510 | SASIKASSSK | FQNS---TP | LPK------ | ST----PFRL | FKSTCITLTT | | 78 |
| SEQ_ID_NO_1512 | LTSIRALSSS | SSS---SVP | LHQTPKPSLL | QT----LAPL | LKTTCITITA | | 87 |
| SEQ_ID_NO_1516 | STSIRASSSS | SSR----TP | LN-------- | KN----LGTI | IKITSITLTA | | 82 |

| | | | | | | | |
|---|---|---|---|---|---|---|---|
| SEQ_ID_NO_1520 | AAAFFMRFH | HT-PAVIAAP | LTSPAAETDT | -----AFTQE | EAERLLEERL | | 130 |
| SEQ_ID_NO_1510 | AAALLLANLH | LKSPAIAAPI | APPPSVESKE | -----NVTLE | EEERALDEHL | | 123 |
| SEQ_ID_NO_1512 | GAALLFMRFH | QK-PALAATP | TVTPTVEPAQ | TDS-NVSLE | DQEKTIEEHL | | 134 |
| SEQ_ID_NO_1516 | AAALFFTRLN | IK-PAIASPL | TASSTVDPTE | ESSKENVSYE | EQERALQDYL | | 131 |

| | | | | | | | |
|---|---|---|---|---|---|---|---|
| SEQ_ID_NO_1520 | STNPRDTEAL | HALMEVKIKA | RKMDEAFEVL | NRLIELEPEE | QEWPLLKANM | | 180 |
| SEQ_ID_NO_1510 | ITHPSDVDAL | RSLMEVKIKS | RKLTEAVEVI | DRLIKLEPEE | KEWPVLKANI | | 173 |
| SEQ_ID_NO_1512 | TQYPNDVEAL | QSLMEVRIKS | RKLPQAIEVI | DRLIQLEPED | TEWPMLRAQI | | 184 |
| SEQ_ID_NO_1516 | SQNPNDIEAL | RSLMEVRIKS | KKLVEAIEVV | DRLIELEPNE | QEWPLLKSQI | | 181 |

| | | | | | | | |
|---|---|---|---|---|---|---|---|
| SEQ_ID_NO_1520 | HLYNDDHASA | RKLFEEILKK | DPLRVEAFHG | LVMATAQSNE | PLKSLLKRVE | | 230 |
| SEQ_ID_NO_1510 | FTYSGDLDLA | KTGFEEILAK | DPLRVEAYHG | LLMAYSDAGL | DLKEVESRIE | | 223 |
| SEQ_ID_NO_1512 | HSYSGDFALA | KNEFEEILAK | DPVRVEAFHG | LVMASSESGQ | KLKELEKRIE | | 234 |
| SEQ_ID_NO_1516 | YTYSGDFESA | KDGFEAILKK | DPLRVEAYHG | LVMANSESGG | SLEVVLKRIE | | 231 |

| | | | | | | | |
|---|---|---|---|---|---|---|---|
| SEQ_ID_NO_1520 | EAIEVCKKQK | KDSDVRDFRL | LIAQIKVMEG | DYTEALKAYQ | ELVKEEPRDF | | 280 |
| SEQ_ID_NO_1510 | EAMLKCKKEN | NQNDFRDFKL | LVAQIRVIEG | KHSEALKLYQ | ELVKEEPRDF | | 273 |
| SEQ_ID_NO_1512 | GAMEKCKKEK | KNKDFRDFKL | LIAQIRVIEG | DHLEALKVYE | GLVKEEPRDF | | 284 |
| SEQ_ID_NO_1516 | SAMDKCKKEK | KTSDLRDFKL | LVAQVRVMEE | KYLDALKVYE | ELVKEEPRDF | | 281 |

| | | | | | | | |
|---|---|---|---|---|---|---|---|
| SEQ_ID_NO_1520 | RPYLCQGIIY | TLLRKKDEAD | KQFNKFRRLV | PKDHPYKDYF | EDNMFATKFF | | 330 |
| SEQ_ID_NO_1510 | RPYLCQGIIY | TLLKKKDKAE | EQFDNFRKLV | PKNHPYREYF | MDNMIATKLF | | 323 |
| SEQ_ID_NO_1512 | RPYLCMGIIY | SLMKKKDEAE | KHFEKVRKLV | PRNHPYREYF | VDNMVATKLF | | 334 |
| SEQ_ID_NO_1516 | RPYLCQGIIY | TLLRKKDEAE | KKFEQFKKLV | PKNHPYREYL | VDNMFATKFF | | 331 |

Figure 51 (continued)

| | | |
|---|---|---|
| SEQ_ID_NO_1520 | SQKLEREGA ···GARG | 343 |
| SEQ_ID_NO_1510 | SEKAQREMAE EMAGSTS | 340 |
| SEQ_ID_NO_1512 | SERAEREGA ------- | 343 |
| SEQ_ID_NO_1516 | SDKVERERS ------- | 340 |

Figure 52

| | | | | | | | |
|---|---|---|---|---|---|---|---|
| SEQ_ID_NO_1525 | ---------- | MAFPQRKRTP | SFSSSVLDSV | YRSIDESDG | LQSDLKGS N | | 39 |
| SEQ_ID_NO_1535 | ---------- | MALPQRQRTQ | SFSSSVLDSI | YRSIDESDG | LQSDLRGT N | | 39 |
| SEQ_ID_NO_1527 | MYKKERSSRE | STFHPRRRTP | SFSSTLLDSI | YRSIDESNG | -EEQHVLGIK | | 48 |
| SEQ_ID_NO_1534 | MHERSMKEAA | GTCPQRRRTP | SFSSSLLDAI | YRSIDESKSN | LHDDQLGLH | | 50 |

| | | | | | | | |
|---|---|---|---|---|---|---|---|
| SEQ_ID_NO_1525 | EN----VSS | SSSSPSPNKK | DDKLTTLRRA | MDEEHWLYA | RSS------ | | 77 |
| SEQ_ID_NO_1535 | SNNNENVSSS | SSSSPSPNKK | DDKLTTLRRA | MDEEHWLYG | RSS---TTT | | 85 |
| SEQ_ID_NO_1527 | KQSCNSVSTT | RRDTSFLEEE | KEVSTTLRRA | VR-TESWMEK | KST-RGSMQ | | 95 |
| SEQ_ID_NO_1534 | HHD---QTT | HSFTSEKGGK | KERMNLRRA | VMLEDWMEK | HGSHSLNAQL | | 94 |

| | | | | | | | |
|---|---|---|---|---|---|---|---|
| SEQ_ID_NO_1525 | -TTTTNSSDS | SS-------- | --FSSSEAES | -----YRTKR | RLRKLAEQGK | | 111 |
| SEQ_ID_NO_1535 | TTTTTNSSDS | SA-------- | --FSSSEAES | -----FRTKR | RLRKLAEQGN | | 120 |
| SEQ_ID_NO_1527 | YNSTSSSSDS | SSAGGGGSGG | GVFSSSENES | ------SVR | GNSSSCQQRT | | 138 |
| SEQ_ID_NO_1534 | LNSSSSSSED | SSA------G | GIFSSSETDT | TTTLTLKKQR | PARLTSEKKK | | 138 |

| | | | | | | | |
|---|---|---|---|---|---|---|---|
| SEQ_ID_NO_1525 | RSGDERQRTK | RTVMDNDSRL | FSKSDDDKKP | KAVKILEEL | KRSKQPVSPG | | 160 |
| SEQ_ID_NO_1535 | RLGEERQRT | ---------- | --KSDDDIKV | KAVKMFEEL | KRSKQPVSPG | | 156 |
| SEQ_ID_NO_1527 | KPLSDKPHQK | PKCEG----- | --GGFHKTKL | RALKIYGEL | KKVKQPISPG | | 180 |
| SEQ_ID_NO_1534 | KKQDRIMSSE | KQNKE----- | --SGFTRTKL | RALKIYGELN | QRVKQPISPG | | 181 |

| | | | | | | | |
|---|---|---|---|---|---|---|---|
| SEQ_ID_NO_1525 | ARLTSFLNSI | FQSN--AKKV | KLCSVGKTTD | VK------- | --------SSS | | 193 |
| SEQ_ID_NO_1535 | ARLTSFLNSI | FQSN--AKKV | KFCSVGKTTD | VK------- | --------SSSS | | 190 |
| SEQ_ID_NO_1527 | GRIASFLNSI | FNSASAAKKV | KMCSIGAMDD | VSFERKSKSA | CSSA-TSFS | | 228 |
| SEQ_ID_NO_1534 | SRIASFLSSI | FNSQN-VKKA | KMCYAGAVED | VSFEHKSNGP | CFSS PSSFS | | 230 |

| | | | | | | | |
|---|---|---|---|---|---|---|---|
| SEQ_ID_NO_1525 | SKSCFSRTRN | KTDNNNNNC- | --KKLERSIR | FYPVRVTIDG | DCRDYAQKH | | 239 |
| SEQ_ID_NO_1535 | SRSCFSRTRN | KTNNNNNNAN | NFKKLERSIR | FYPVRVTIDG | DCRDYAHKN | | 239 |
| SEQ_ID_NO_1527 | -RSCLSKTPP | PRGKPSNG- | ----TKRSVR | FYPVGVIVDE | DSRPCGHKS- | | 270 |
| SEQ_ID_NO_1534 | RRSCMSKTPS | SAKKSNNNE- | ----VKRSVR | FYPVSVILGE | DSEPDSSYHK | | 275 |

| | | | | | | | |
|---|---|---|---|---|---|---|---|
| SEQ_ID_NO_1525 | ---TRVRK- | --PIPEFTAK | -KSVKE--- | EIKTNDHHTE | FTCITRNI- | | 276 |
| SEQ_ID_NO_1535 | ---TR---- | --PIPTKVHQ | TELMKE--- | EIKTVHQTE | LTCITRK- | | 274 |
| SEQ_ID_NO_1527 | ---YEDDPG | LMPTPRKVVK | SSSVKELEVA | KGAAADYLRS | YH-QRKNV- | | 314 |
| SEQ_ID_NO_1534 | CNILYE--- | --SEPNLGVR | SSSIKELKKN | TARGNENGAE | EAAARGFVKG | | 319 |

Figure 52 (continued)

```
SEQ_ID_NO_1525      ------GLKD FVRSNKY EG KEEEGDAWSH SSSDLFELDS YRI GMGRYLK    319
SEQ_ID_NO_1535      ------GLKD YVRSSNI DEG KEEEDDVWSY SSSDLFELDH YRI GMGRYLK    318
SEQ_ID_NO_1527      ------SEFD FRGFHNYVAD DSDSDDEF SC TSSDLFELDH LF GI GRYRE     356
SEQ_ID_NO_1534      YRNSGQGEFD FRGF--YDDD DEDDDDDVSC SSSDLFELDH LF GAARYDE      366

SEQ_ID_NO_1525      ELPVYETTDF KTNQAI ARSL LL    341
SEQ_ID_NO_1535      ELPVYETTDF KFNQAI ARGL LL    340
SEQ_ID_NO_1527      ELPVYETTNF KTNQAI ANGF FP    378
SEQ_ID_NO_1534      ELPVYETTNL ETNKAI ASGL CL    388
```

Figure 53

```
SEQ_ID_NO_1550    MDMNESSEKG ME---GNGS SGPGGGI PVE MQSQFS---G GGFS-A---    38
SEQ_ID_NO_1552    MYSGQQSDQC PS---ANS- ---------- --------G REFSEA---    22
SEQ_ID_NO_1537    MLEGLVSQES LSLNS-MDMS VLER----LK WVQQQQDQLQ QVVSHS---    41
SEQ_ID_NO_1543    MLESLVSLES MSLSS-MDVS VLER----LK WLQQQ----Q QQVLST---    37
SEQ_ID_NO_1545    MLGYANPSGN LAVD--GDMT VLERQRARMK WQEEQEYFSG NSFNGV----   44
SEQ_ID_NO_1539    MLHC------ ------TDITI VLERQRACIK WQQEQQDQQQ VQLQQQEISY    38
SEQ_ID_NO_1548    MLHCLNTSGN LVGGIISDMT VLERQRARKK FQHEHDD-Q QFFMVG----   45

SEQ_ID_NO_1550    HQHQQHPHMM DSFGSGMWS- --------AA SQHGAGFLAP VPGFLPPPGL   79
SEQ_ID_NO_1552    NRNTVTMHQK MGYNSG---- ---------- ---------- ------PYGF   42
SEQ_ID_NO_1537    SNNSPELLQI LGFHGSN--- ------ND ELLESSFSQF Q---MLGSGF   77
SEQ_ID_NO_1543    TNASPELLQF HGTN------ ------ND ELLQNTFSHF Q---MLRSGF   70
SEQ_ID_NO_1545    FSSSSSLHVP DSIMVAADS- --------G CALAEVVAQA QPRSINKPSA   84
SEQ_ID_NO_1539    FTELTGVFQQ AGFHEGGLSE VVTRSVKPDP GLMDNGANND H---VVGLGV   85
SEQ_ID_NO_1548    CDSALGEVVA NSMKPG---- ---------- ---------- ----------   61

SEQ_ID_NO_1550    GGHFPVDSG- -FIE----RA ARSSCFVGPG AGGGMVGAGA FGGAGDQQMG  123
SEQ_ID_NO_1552    GP---YNMG- -LEE----RP GLYQSSSGTF SQNIQM---- --------S   70
SEQ_ID_NO_1537    GPNYNMGFGP PHES---IS RTSSCHMEPV DTMEVL---- ------LKTG  113
SEQ_ID_NO_1543    GPNYSMGFGP SHEAMDGCIS ITNSCQMDQA DTVGVM---- ------LKNS  110
SEQ_ID_NO_1545    AP-----G- -LHANSSSIS RTFSCPPALV DPEPKPT--- ---------D  114
SEQ_ID_NO_1539    GPLYDNGSG- -FELNYGAIS RISSCPPAAV AAVAAATVKG SESVVSDKS   133
SEQ_ID_NO_1548    ------DLG- -FEN------ ---------- ---------- ----------   67

SEQ_ID_NO_1550    SAFGEGYLDH RRKEGGDKAE PELAGSGGVP SSEAAGGDCS SKGSDSKKRR  173
SEQ_ID_NO_1552    DEHSGGVKKR KGMD------ ---------- ----DCV AMLQNAGDQQ   97
SEQ_ID_NO_1537    EETRAVALKN KRKP------ ---------- ----EVK TREEQKTEKK  140
SEQ_ID_NO_1543    EENITISLKN KRKS------ ---------- ----EVK TREEEKTEKK  137
SEQ_ID_NO_1545    SSIGKDSFKK RKTD------ ---------- --KPHN-PKV VAENENKDKR  145
SEQ_ID_NO_1539    SGVGRESSKK RKVD------ ---------- --NKQNNSKV DAEEDTRDKR  165
SEQ_ID_NO_1548    ---VEFTVKK RKAD------ ---------- ------H KVDMKSKDKR   89
```

Figure 53 (continued)

| SEQ_ID_NO_1550 | RPSEVMGGDD VQSSNVAADS ANESAQSKDK GEESSPATGT TTGGKSKGKG | 223 |
| --- | --- | --- |
| SEQ_ID_NO_1552 | ----TEGSSQ PE- - - - - - - - - -RNSLEG NRKI SPKMQS ---KEDSSDG | 128 |
| SEQ_ID_NO_1537 | ----IKVEAE TESSMK---- ----GKSNMG NTEASSDTSK ---ETSKGAS | 175 |
| SEQ_ID_NO_1543 | ----IKVEAE TELNMK---- ----VKSNLS NTEASSETSK ---QKSKAAS | 172 |
| SEQ_ID_NO_1545 | ----IKVGAD DGESKITKCN T---INTNTN NKETCTDTSN ---SKQNSKA | 185 |
| SEQ_ID_NO_1539 | ----IKGCAE EGESKITEKN NNKNSRNNNT NKNNNSNKES SA-GNSKDNS | 210 |
| SEQ_ID_NO_1548 | ----IKVSVE EGESKITEQI KGN-KNTKLK NRENCDDVGS ----KENSKG | 130 |

| SEQ_ID_NO_1550 | AKESSEKEDY HVRARRGQA TNSHSLAERL RREKI SERMK LLQDLVPGCS | 273 |
| --- | --- | --- |
| SEQ_ID_NO_1552 | DG---TKEDY VHVRAKQGQA TNSHSLAERL RRKKI SERMK LLQDLVPGCS | 175 |
| SEQ_ID_NO_1537 | EN---QKLDY IHVRARRGQA TDRHSLAERA RREKI SKKMK YLQDIVPGCN | 222 |
| SEQ_ID_NO_1543 | EN---QKLDY HVRARRGQA TDRHSLAERA RREKI SKKMK YLQDLVPGCN | 219 |
| SEQ_ID_NO_1545 | S----EKPDY HVRARRGQA TDSHSLAERV RREKI SERMN YLQDLVPGCN | 231 |
| SEQ_ID_NO_1539 | KVTEVQKPDY HVRARRGQA TDSHSLAERV RREKI SERMK YLQDLVPGCN | 260 |
| SEQ_ID_NO_1548 | SEIQNHKPDY HVRARRGQA TDSHSLAERV RREKI SERMK YLQDLVPGCN | 180 |

| SEQ_ID_NO_1550 | KVTGKAVMLD EIINYVQSLQ RQVEFLSMKL ATVNPRLDLN IEGLLSKDLL | 323 |
| --- | --- | --- |
| SEQ_ID_NO_1552 | KITGKAVMLD EIINYVQSLQ RQVEFLSMKL ATVNPELGFD IEDLSKQMM | 225 |
| SEQ_ID_NO_1537 | KVTGKAGMLD EIINYVQCLQ RQVEFLSMKL AVLNPELELA VEDVSVKQAY | 272 |
| SEQ_ID_NO_1543 | KVTGRAGMLD EIINYVQSLQ RQVEFLSMKL AVLNPELELA MEDLSVKQLF | 268 |
| SEQ_ID_NO_1545 | KVTGKAGMLD EIINYVQSLQ RQVEFLSMKL AAVNPRLDFS MDDLFDKDVF | 281 |
| SEQ_ID_NO_1539 | KITGKAGMLD EIINYVQSLQ RQVEFLSMKL AAVNPRLDFN FDNLFAREAF | 310 |
| SEQ_ID_NO_1548 | KIAGKAGMLD EIINYVQSLQ RQVEFLSMKL AAVNPRLDFN IDELFAKEVF | 230 |

| SEQ_ID_NO_1550 | RF------- ---PGVSSSS MGFSPEMMHP QLQLSQPGLM QGGARAMANS | 362 |
| --- | --- | --- |
| SEQ_ID_NO_1552 | LSQDRHFAFY GVDPGSSSLA SQFSDGIMQP QM------- --MCNISNPA | 265 |
| SEQ_ID_NO_1537 | FTNV----- --------VA SKQSIMVDVP LFPLDQQGSL --DLSANPN | 306 |
| SEQ_ID_NO_1543 | QAYFTNLPVV --------VA SKPSLMVDAP LFPLDQQGSL --DLSVINPN | 308 |
| SEQ_ID_NO_1545 | PTCAANFPNI GMSSTSSDIT NPAYLPFNSP QQIFQYDGL- --DTGINPSD | 328 |
| SEQ_ID_NO_1539 | PACSVNFPTI GM---SSDMT NPAYLDFNPA QQQLVTCCGL --DMGTDPPD | 355 |
| SEQ_ID_NO_1548 | TQNFQMM--- -----QSEMS NPAYLDFNSA QDQVSCCGGL INNMGILPPE | 272 |

Figure 53 (continued)

| | | |
|---|---|---|
| SEQ_ID_NO_1550 | DVFRRIMDAD ········L GAKDCSHSQM AHALNGPFSD HVAQMAYPSM | 403 |
| SEQ_ID_NO_1552 | DVLQGTIHDV ·············STMNQI PAMAEG-LQN -LPQMNFNPG | 299 |
| SEQ_ID_NO_1537 | QT········ ·············TSIEAP SGSWETQSQS -LYN······ | 327 |
| SEQ_ID_NO_1543 | QA········ ·············TTIEAP SASWETQSQS -LYN······ | 329 |
| SEQ_ID_NO_1545 | YGLRRTISAP VS--MPETYL QSSCFTQMLP SSTWEGDFQN -LCNFDVDQA | 375 |
| SEQ_ID_NO_1539 | MGLKRTTSSP ES--IPETFL DSSCFTQAHP PPAWDADLQN -LYNVAFDQG | 402 |
| SEQ_ID_NO_1548 | IGVRRNINAP ASASLPEIFL DPSCFTHILP SSTWEGDFQN -LHSVDFDQG | 321 |

| | | |
|---|---|---|
| SEQ_ID_NO_1550 | GSSHSHSQDL S········ RPSQDAYQM | 424 |
| SEQ_ID_NO_1552 | VAADSSANN· ··········· SGSMKIED | 316 |
| SEQ_ID_NO_1537 | ·········· ··········· TSSLGFHY | 335 |
| SEQ_ID_NO_1543 | ·········· ··········· TSSLGFDY | 337 |
| SEQ_ID_NO_1545 | RATSFPSQLL SGL·····V EASNLKMEM | 398 |
| SEQ_ID_NO_1539 | RQTSFPTQPF TGKIKLSCS EASNLKMEM | 431 |
| SEQ_ID_NO_1548 | RSTSFPSQPF TGM····· EASNLKMEM | 344 |

Figure 54

```
SEQ_ID_NO_1571    MAVEAVS...  ......GNGG  EAVAPAPA..  ..........  ..........   19
SEQ_ID_NO_1567    MAEEPQ...   ......PQAA  AAPAAAAT..  ..........  .EVVVAEKAP   27
SEQ_ID_NO_1572    MAEEPQ...   ......PEAA  PAAVAATT..  ..........  .EVAVAEKAP   27
SEQ_ID_NO_1574    MAEEPQ...   ......PEAA  PAAVAATT..  ..........  .EVAVAEKAP   27
SEQ_ID_NO_1555    MAEETDK...  ......PAAA  EAPTSTQP..  ..........  .VPEEPAVVP   29
SEQ_ID_NO_1563    MSQEQDVVVV  TDV...PQAE  KTAPVPPT..  ..........  MPVVVEKEPP   35
SEQ_ID_NO_1575    MAEEPQK...  ......PTEQ  VATTPATS..  ..........  .ETTLEKTPP   28
SEQ_ID_NO_1554    MAEEPTTTTL  VTPEKLPSPS  LTPSEVSEST  QDALPTETET  LEKVTETNPP   50
SEQ_ID_NO_1565    MAQNDSN...  ......PTPP  PEPHVAAE..  ..........  ..........P  20

SEQ_ID_NO_1571    ..........  ..........  PV KEVSAK..  ..........  ....VEAKEA   33
SEQ_ID_NO_1567    ..AEVEKKAE  EL......PA  AEAEAE....  ..........  .ETAAVADDG   53
SEQ_ID_NO_1572    VEAEKEKKVE  EET.....PA  VEAEAK....  ..EEKKDEAA  ...AAGGDEA   63
SEQ_ID_NO_1574    VEAEKEKKVE  EET.....PA  VEAEAK....  ..EEKKDEAA  AAAAAGGDEA   66
SEQ_ID_NO_1555    PVPAAEIQLP  DSAPAPPQPE  ASPAKP....  ..DSVAEVAE  DEKPKASEEF   73
SEQ_ID_NO_1563    V.........  ........PV  PETEEEPMKP  KQVEEGAVET  QVLKPSGGDD   68
SEQ_ID_NO_1575    PQAEEVVAAA  DADAVVVPPV  VAEETE....  ..KPAEDVKP  ADETAAATDK   72
SEQ_ID_NO_1554    ETADTTTKPE  EETAAEHHPP  TVTETETAST  EKQEVKDEAS  QKEVAEEKKS   100
SEQ_ID_NO_1565    ITEDLVQDKE  EEDDSSKIVI  PVPESE....  ..........  ..........   46

SEQ_ID_NO_1571    AAVTKNASFR  EESNFLDDLK  ESERKALAEL  RDKVEAATLE  GKLFDDGKPE   83
SEQ_ID_NO_1567    GAVEATGSFK  EESNLVADLP  DPEKKALDEF  KELIVAALAA  GEFNLPPPPP   103
SEQ_ID_NO_1572    GAIEGTGSFK  EESNLVADLP  DPEKKALDEF  KQLIAAALAA  CEFNLPPPPP   113
SEQ_ID_NO_1574    GAIEGTGSFK  EESNLVADLP  DPEKKALDEF  KQLIAAALAA  CEFNLPPPPP   116
SEQ_ID_NO_1555    EKISQSVSFK  EESNVVGELP  ESQRKALADL  KVLIQEALNK  HEFTAPPAPL   123
SEQ_ID_NO_1563    EKMPQLVSFK  EESTKVADLL  DSEKKALQEF  KQLVQEALN.  ..........   107
SEQ_ID_NO_1575    KILQLSVSFK  EETNVVSELP  ESQKKALDEL  KQLIQEALNK  HEFTAPPPPP   121
SEQ_ID_NO_1554    MIPQNLGSFK  EESSKLSDLS  NSEKKSLDEL  KHLVREALDN  HQFTN.....  145
SEQ_ID_NO_1565    ....SLSLK  EDSNRVSD..  .SEKNAIDEL  KKLLKEELED  ..........   78

SEQ_ID_NO_1571    ..........  ..........  VKEKREAKKK  AEKAPEEKKE  EEEEGKKEPE   113
SEQ_ID_NO_1567    PPKAKTEAAA  EETKTEAPAK  EEAKTEEPAK  AEEPAKEEPK  AEEPAKAEAA   153
SEQ_ID_NO_1572    PPKAKVEAAV  EETKA.....  EESKAEEEPK  AEEPAKEEEP  KAEVAAAAAA   158
SEQ_ID_NO_1574    PPKAKVEAAV  EETKA.....  EETKAEEEPK  AEEPAKEEEP  KAEVAAAAAA   161
SEQ_ID_NO_1555    PPK.....E  EEKPA.....  EEKKEDTEKP  AEQPQIDE.P  AKEPVIEEPP   161
SEQ_ID_NO_1563    ..........  ..........  ..........  ..........  ..........  107
SEQ_ID_NO_1575    PTKAVAEVAE  EKKPE.....  EEEKKTEEVV  AEEKKVEEVV  AEEKKVEEAV   166
SEQ_ID_NO_1554    ..........  ..........  ..........  ..........  ..........  145
SEQ_ID_NO_1565    ..........  ..........  ..........  ..........  ..........  78
```

Figure 54 (continued)

| | | | | | | |
|---|---|---|---|---|---|---|
| SEQ_ID_NO_1571 | AVEKKGEEDD | KKEAEVEGKE | EEEESKKEAE | KEMEDEE--- | ---------- | 150 |
| SEQ_ID_NO_1567 | AAEPAAEEPK | AVVA------ | ----AEAAAE | EPAKEEPK-- | ---AEEAKPA | 188 |
| SEQ_ID_NO_1572 | PPEAGTEEPK | AEASSEEAKT | EEPKAEAAAD | EPAKDESKAE | AAPAEEAKPA | 208 |
| SEQ_ID_NO_1574 | PPEAGTEEPK | AEASSEEAKT | EEPKAEAAAD | EPAKEESKAE | AAPAEEAKPA | 211 |
| SEQ_ID_NO_1555 | KTEAEPEPVT | ETVTVKVEET | ITPHPAPETS | LAPEADEKAA | EPSTVVEKVA | 211 |
| SEQ_ID_NO_1563 | ---------- | ---------- | ---------- | ---------- | ---------- | 107 |
| SEQ_ID_NO_1575 | AEEKKVEEVE | KKEEEKGSSS | EEPKTEAKIE | AEPEAKKEET | VLEVVEKIAT | 216 |
| SEQ_ID_NO_1554 | ---------- | ---------- | ---------- | ---------- | ---------- | 145 |
| SEQ_ID_NO_1565 | ---------- | ---------- | ---------- | ---------- | ---------- | 78 |

| | | | | | | |
|---|---|---|---|---|---|---|
| SEQ_ID_NO_1571 | ---------- | ---------- | ---------- | --AGEAEKVA | AAAEEKPAET | 168 |
| SEQ_ID_NO_1567 | EPKKEEEAVV | VAEE--GTKT | ------AEPV | EEAAAAATTT | EQAAAPEPEA | 230 |
| SEQ_ID_NO_1572 | EPEPEEKTVV | VTEEEAATKT | VEAIEETVVP | AAAAPAAAAT | EEAAAPEPEV | 258 |
| SEQ_ID_NO_1574 | EPEPGGED-- | ---------- | ------RRGH | RGRGGHQDGG | SDRGNRRARC | 243 |
| SEQ_ID_NO_1555 | VIDEDGAKTV | EAIEESVVAV | ------STPP | PEESAPSKEE | AEVEVEAAEA | 255 |
| SEQ_ID_NO_1563 | ---------- | ---------- | ---------- | ---------- | ---------- | 107 |
| SEQ_ID_NO_1575 | STEEDGAKTV | EAIOESIVSV | ------TVTD | GEQPVTETVG | EAVAVAEVEL | 259 |
| SEQ_ID_NO_1554 | ---------- | ---------- | ---------- | ---------- | ---------- | 145 |
| SEQ_ID_NO_1565 | ---------- | ---------- | ---------- | ---------- | ---------- | 78 |

| | | | | | | |
|---|---|---|---|---|---|---|
| SEQ_ID_NO_1571 | AAVVVDKDIA | LWGVPLLPSK | GDE-AIDVVL | LKFLRARDFK | AGAAFEMLRR | 217 |
| SEQ_ID_NO_1567 | E-AAAPEPVF | IWGVPLV--- | GDDERTDAVL | LKFLRAREFK | VKEAMAMLRS | 276 |
| SEQ_ID_NO_1572 | QAAAPEPVL | IWGVPLV--- | GDDERTDIVL | LKFLRAREFK | VKEAMAMLRS | 305 |
| SEQ_ID_NO_1574 | CCACCRRHGG | SRGAGTG--- | GDDERTDIVL | LKFLRAREFK | VKEAMAMLRS | 290 |
| SEQ_ID_NO_1555 | VPPPPPEEVF | IWGIPLL--- | GDE-RSDVIL | LKFLRARDFK | VKDAFTMIKN | 301 |
| SEQ_ID_NO_1563 | ---------- | -------- | ----KSDVIL | LKFLRARDFK | VKDAFTMLKS | 133 |
| SEQ_ID_NO_1575 | VTPTTPEEVE | IWGIPLL--- | ADE-RSDVIL | LKFLRARDFK | VKEAYTMIKQ | 305 |
| SEQ_ID_NO_1554 | ----TPEEVK | IWGIPLL--- | EDD-RSDVVL | LKFLRAREFK | VKDSFAMLKN | 187 |
| SEQ_ID_NO_1565 | ------EEVS | IWGVPLF--- | KDD-RTDVIL | LKFLRARELK | VKDALVMFQN | 118 |

| | | | | | | |
|---|---|---|---|---|---|---|
| SEQ_ID_NO_1571 | TLRWRRDWPG | FDADADADLP | -EELAGACVL | DGADREGHPV | CYNALRVFAD | 266 |
| SEQ_ID_NO_1567 | AVLWRKRF-G | IESLLEADLA | FPELEKVVFY | RGADREGHPV | CYNVYGEFQD | 325 |
| SEQ_ID_NO_1572 | AVLWRKRF-G | IESLLDADLA | LPELDSVVFY | RGADREGHPV | CYNVYGEFQD | 354 |
| SEQ_ID_NO_1574 | AVLWRKRF-G | IESLLDADLA | LPELDSVVFY | RGADREGHPV | CYNVYGEFQD | 339 |
| SEQ_ID_NO_1555 | TVRWRKQF-D | IEALLDEDLG | -NQMDKYVFS | HGVDREGHPV | CYNVFGEFEN | 349 |
| SEQ_ID_NO_1563 | TIRWRKEF-G | IDELLEQDLG | FDDLGKVVFM | HGLDKEGHPV | CYNVYGEFQN | 182 |
| SEQ_ID_NO_1575 | TVLWRKEF-G | IEALLQEDLG | -TDMDKYVFT | DGYDKEGHPV | YYNVFGEFEN | 353 |
| SEQ_ID_NO_1554 | TIKWRKEF-K | IDEL VEEDLV | -DDLDKVVFM | HGHDREGHPV | CYNVYGEFQN | 235 |
| SEQ_ID_NO_1565 | TLRWRKDF-N | IDALLDEDLG | -DHLEKVVFM | HGHGREGHPV | CYNVYGEFQN | 166 |

Figure 54 (continued)

| SEQ_ID_NO_1571 | DAVYKKAL GT | EEGKARFLRW | RVRAMERHV- | AELDLKP- GG | AASLLQVTDL | 314 |
| SEQ_ID_NO_1567 | KEVYEKAFGD | EEKRERFLKW | RIQLLERGL | SQLDFAP- SG | CSMVQVTDL | 374 |
| SEQ_ID_NO_1572 | KDLYEKAFGD | EEKRERFLKW | RIQLLERGL | SQLDFSP- SG | CSMVQVTDL | 403 |
| SEQ_ID_NO_1574 | KDLYEKAFGD | EEKRERFLKW | RIQLLERGL | SQLDFSP- SG | CSMVQVTDL | 388 |
| SEQ_ID_NO_1555 | KDLYQTFSD | DEKSLKFLRW | RVQFLEKSI- | RKLDFSP- NG | STIVQVNDL | 397 |
| SEQ_ID_NO_1563 | KELYKNSFSD | EEKRQRFLRW | RIQFLEKSI- | RTLDFSP- GG | STIVQVNDL | 230 |
| SEQ_ID_NO_1575 | KELYQNTFSD | DEKRTKFIRW | RIQSLEKSI- | RKLDFTP- SG | STIVQVNDL | 401 |
| SEQ_ID_NO_1554 | KELYNKTFSD | EEKRKHFLRT | RIQFLERSI- | RKLDFSS- GG | VSTIFQVNDM | 283 |
| SEQ_ID_NO_1565 | KDLYHKAFSS | QDNRNKFLRW | RIQLLERSI- | RHLDFTPSSG | NTIFQVNDL | 215 |

| SEQ_ID_NO_1571 | KNSPGPAKKD | FRVAVKQVLD | LFQDNYPELV | ARNLL NVPF | WYYAFSTLFY | 364 |
| SEQ_ID_NO_1567 | KNSPPMLGKH | -RAVTRQAVA | LLQDNYPEFI | AKKVFI NVPW | WYLAANKMMS | 423 |
| SEQ_ID_NO_1572 | KNSPPMLGKH | -RAVTRQAVA | LLQDNYPEFI | AKKVFI NVPW | WYLAANKMMS | 452 |
| SEQ_ID_NO_1574 | KNSPPMLGKH | -RAVTRQAVA | LLQDNYPEFI | AKKVFI NVPW | WYLAANKMMS | 437 |
| SEQ_ID_NO_1555 | KNSPGLTKNE | LRNATKRALQ | LFQDNYPEFA | AKQVFI NVPW | WYLAVNRMIS | 447 |
| SEQ_ID_NO_1563 | KNSPGPAKRE | LRQATRQALQ | LLQDNYPEFV | AKQIFI NVPW | WYLTVNRMIS | 280 |
| SEQ_ID_NO_1575 | KNSPGLGKKE | LRQATNKALQ | LLQDNYPEFV | AKQVFI NVPW | WYLAFSRFLS | 451 |
| SEQ_ID_NO_1554 | KNSPGLGKKE | LRSATKQAVE | LLQDNYPEFV | FKQAFI NVPW | WYLVFYTVIG | 333 |
| SEQ_ID_NO_1565 | KNSPGPAKRE | LRLATKQALQ | LLQDNYPEFV | AKQVFI NVPW | WYLAFYTMIN | 265 |

| SEQ_ID_NO_1571 | PFLTQRTKSK | FVLARPSKVT | ETLLKYIPIE | AI PVKYGGLK | RDD---DTEF | 411 |
| SEQ_ID_NO_1567 | PFLTQRTKSK | FVFASQAKSP | ETLFRYIAPE | QVPVQFGGLF | KED---DPDF | 470 |
| SEQ_ID_NO_1572 | PFLTQRTKSK | FIFASPAKSA | ETLFRYIAPE | QVPVQFGGLF | KED---DPEF | 499 |
| SEQ_ID_NO_1574 | PFLTQRTKSK | FIFASPAKSA | ETLFRYIAPE | QVPVQFGGLF | KED---DPEF | 484 |
| SEQ_ID_NO_1555 | PFFTQRTKSK | FVFAGPSKTA | ETLFKYVTPE | QVPVQYGGLS | REG---EQEF | 494 |
| SEQ_ID_NO_1563 | PFLTQRTRSK | FVFVGPSKSA | ETLLRYIAAE | QI PVKYGGLS | KDG-----EF | 325 |
| SEQ_ID_NO_1575 | AFLTQRTKSK | FVFAGPSKSA | DTLFKYIAPE | QVPVQYGGLS | REG---EQEF | 498 |
| SEQ_ID_NO_1554 | PFMTPRSKSK | LVFAGPSRSA | ETLFKYISPE | QVPVQYGGLS | VDPCDCNPDF | 383 |
| SEQ_ID_NO_1565 | PFLTSRTKSK | FVFAGPSKSP | DTLFKYIFPE | QVPVQYGGLS | VDFCDCNPDF | 315 |

| SEQ_ID_NO_1571 | SSADDGEVAE | LTVKGSSTET | IEIEAAEADA | TLTMDLTVLG | MEVNYKEEFV | 461 |
| SEQ_ID_NO_1567 | TTSD--SVTE | LTIKASSKET | IEIPVTE-NS | TIVWELRVLG | MEVSHGAEFT | 517 |
| SEQ_ID_NO_1572 | TTSD--AVTE | LTIKPSSKET | VEIPVTE-NS | TIGMELRVLG | MEVSYGAEFT | 546 |
| SEQ_ID_NO_1574 | TTSD--AVTE | LTIKPSSKET | VEIPVTE-NS | TIGMELRVLG | MEVSYGAEFT | 531 |
| SEQ_ID_NO_1555 | SIDD--PVTE | VAIKAATKHT | VEFPISE-PS | LLVWELRVVG | MDVSYGAEFL | 541 |
| SEQ_ID_NO_1563 | GSAD--AVTE | ITVKPAAKHT | VEFPVTE-TC | LLTMEVRVAG | MDVSYSAEFV | 372 |
| SEQ_ID_NO_1575 | TTAD--PATE | VTIKPATKHA | VEFPISE-KS | TLVWEVRVVD | NSVNYGAEFV | 545 |
| SEQ_ID_NO_1554 | SLED--SASE | ITVKPGTKQT | VEI LYE-KC | ELVWEIRVTG | MEVSYKAEFV | 430 |
| SEQ_ID_NO_1565 | TMSD--PVTE | LPLKPTTKQT | VEIALYE-KC | IFVWELRVVG | MEVSYNAEFK | 362 |

Figure 54 (continued)

| | | | | | | | | |
|---|---|---|---|---|---|---|---|---|
| SEQ_ID_NO_1571 | PADEGSYTII | VRKGKKMGAG | EEAVLRNSFR | AGEPGKVVLT | VENTSH-KKK | | | 509 |
| SEQ_ID_NO_1567 | PDAEGAYTVI | VQKTRKVPAN | EEPIMKGSFK | AGEAGKIVLT | VSNAAS-KKK | | | 566 |
| SEQ_ID_NO_1572 | PDAEGGYTVI | VQKTRKVPAN | EEPIMKGSFK | VGEPGKIVLT | INNPAS-KKK | | | 595 |
| SEQ_ID_NO_1574 | PDAEGGYTVI | VQKTRKVPAN | EEPIMKGSFK | VGEPGKIVLT | INNPAS-KKK | | | 580 |
| SEQ_ID_NO_1555 | PSAEGGYTVI | VQKTAKLGPA | DEPVISNSYR | VGEAGKIVLT | IDNLSSKKKK | | | 591 |
| SEQ_ID_NO_1563 | PSAEDSYTVI | IQKARKVAAT | EEPVVCNSFK | IGEPGKVVLT | IDNSTSKKKK | | | 422 |
| SEQ_ID_NO_1575 | PSAEDGYTVI | IQKNRKVAPA | DETIISNTFK | IGEPGKVILT | IDNQSS-KKK | | | 594 |
| SEQ_ID_NO_1554 | PEEKDAYTVV | IQKPRKMRPS | DEPVLTHSFK | VNELGKVLLT | VDNPTS-KKK | | | 479 |
| SEQ_ID_NO_1565 | PDVEDAYTVI | IQKATKMSPT | DEPVVSNSFK | VVELGKLLLT | IDNPTL-KKK | | | 411 |

| | | | | |
|---|---|---|---|---|
| SEQ_ID_NO_1571 | KVLFRHKSKS | AFAKKC---- | - | 525 |
| SEQ_ID_NO_1567 | KLLYRSKVKC | STGESVEADI | P | 587 |
| SEQ_ID_NO_1572 | KLLYRSKVKS | TSESV----- | - | 610 |
| SEQ_ID_NO_1574 | KLLYRSKVKS | TSESV----- | - | 595 |
| SEQ_ID_NO_1555 | ILLYRSKTKP | ISD------- | - | 604 |
| SEQ_ID_NO_1563 | KLLYRLKTKP | ASSD------ | - | 436 |
| SEQ_ID_NO_1575 | KLLYRSKTIP | ISE------- | - | 607 |
| SEQ_ID_NO_1554 | KLVYRFNVKP | L--------- | - | 490 |
| SEQ_ID_NO_1565 | RLLYRFKIKP | YSD------- | - | 424 |

Figure 55

| SEQ_ID | Seq1 | Seq2 | Seq3 | Seq4 | Seq5 | Seq6 | # |
|---|---|---|---|---|---|---|---|
| SEQ_ID_NO_1578 | ---------- | ---------- | ---------- | ---------- | ---------- | -MSFYRGTAS | 9 |
| SEQ_ID_NO_1607 | MADNKDGVTP | KSSAAFPLR- | ---------N | PNVTLNERNF | AAFTNRSAAA | | 40 |
| SEQ_ID_NO_1440 | MDEEMNAVAE | MNAVASKVKE | EY-------R | RAPKLNQRII | SSMSRRSVAA | | 43 |
| SEQ_ID_NO_1648 | ----MSEEAA | TETGSSSVK- | ---------R | TTPKLNERIL | SSLSRRSVAA | | 36 |
| SEQ_ID_NO_1651 | ---MSQENGA | TNGHLAEEQQ | DVWMEVEPKR | RAPRLNERIL | SSLSRRSVAA | | 47 |
| SEQ_ID_NO_1487 | MSSENGENGH | GAADEVVEPY | QQTP-----R | PGPKLNERIL | SSLSRRSVAA | | 45 |
| SEQ_ID_NO_1040 | --MSQEDSTS | AAAAQQPTS- | ---------R | PAPKLNERIL | SSLSRRGGGA | | 38 |
| SEQ_ID_NO_1465 | ---MSEEDTN | AAAGQP---- | ---------R | RAPKLNERIL | SSLSRRSVAA | | 34 |
| SEQ_ID_NO_1580 | ----MSEEDK | NEAKVLETP- | ---------R | KPPRLNERIL | SSMSRRSVAA | | 36 |
| SEQ_ID_NO_1623 | --------MS | NENDDLSPQ- | ---------R | RAPRLNERIL | SSISRRSVAA | | 32 |
| SEQ_ID_NO_1622 | MSEHDDEVQE | VQENVQEIH- | ---------R | PVPRLNERIL | SSLSRRSVAA | | 40 |
| SEQ_ID_NO_1041 | ----MSDVTK | TQENEVETK- | ---------H | QAPRLNERIL | SSLSRRTVAA | | 36 |
| SEQ_ID_NO_1590 | ---MSDETKT | QENEVVEAK- | ---------R | QAPRLNERIL | SSLSRRTVAA | | 37 |
| SEQ_ID_NO_1577 | ---MNGEEVK | TSQPQKKLQ- | ---------N | PTPRLNERIL | SSLSKRSVAA | | 37 |
| SEQ_ID_NO_1611 | ---MSEEVKE | NQSDKLQ--- | ---------R | TAPRLNERIL | SSLSRKSVAA | | 35 |
| SEQ_ID_NO_1637 | ---MSEEVKE | NQSGKLQ--- | ---------K | PTPRLNERIL | SSLSKRSVAA | | 35 |
| SEQ_ID_NO_1627 | -MAPSQEVAA | ATKEPSTNGN | GTQAAAAPKT | KTPALNERIL | SSITRRSVAA | | 49 |
| SEQ_ID_NO_1608 | MAPPLETVQK | VQPPPNAIEP | HVTYHHDH-S | SHPPLNERIL | SSMTRRSIAA | | 49 |
| SEQ_ID_NO_1609 | ---MSPPIES | PAKVAITQH- | ---------S | KPPPLNERII | SSMTRRSVAA | | 37 |

| SEQ_ID | Seq1 | Seq2 | Seq3 | Seq4 | Seq5 | Seq6 | # |
|---|---|---|---|---|---|---|---|
| SEQ_ID_NO_1578 | HPWHDLHPGN | DAPNFVSCVI | EIPRGSKVKY | ELDKDTGLCF | VDRILYSSVV | | 59 |
| SEQ_ID_NO_1607 | HPWHDLEIGP | EAPAVFNCVV | EISKGGKVKY | ELDKNSGLIK | VDRVLYSSIV | | 90 |
| SEQ_ID_NO_1440 | HPWHDLEIGP | NAPEIFNCVV | EIPKGSKVKY | ELDKKTGLIM | VDRILYSSVV | | 93 |
| SEQ_ID_NO_1648 | HPWHDLEIGP | GAPSVVNAVV | EITKGSKVKY | ELDKKTGMIK | VDRVLYSSVV | | 86 |
| SEQ_ID_NO_1651 | HPWHDLEIGP | EAPAVFNVVV | EITKGSKVKY | ELDKKTGLIK | VDRVLYSSVV | | 97 |
| SEQ_ID_NO_1487 | HPWHDLEIGP | DAPAVFNVVV | EITKGSKVKY | ELDKKTGLIK | VDRILYSSVV | | 95 |
| SEQ_ID_NO_1040 | HPWHDLEIGP | GAPAVFNVVV | EITKGSKVKY | ELDKKTGLIK | VDRVLYSSVV | | 88 |
| SEQ_ID_NO_1465 | HPWHDLEIGP | GAPAVFNVVV | EITKGSKVKY | ELDKKTGLIK | VDRVLYSSVV | | 84 |
| SEQ_ID_NO_1580 | HPWHDLEIGP | GAPAIFNCVV | EIPKGSKVKY | ELDKKTGLIK | VDRVLYSSVV | | 86 |
| SEQ_ID_NO_1623 | HPWHDLEIGP | EAPSVFNVVI | EISKGSKVKY | ELDKKTGLIK | VDRILYSSVV | | 82 |
| SEQ_ID_NO_1622 | HPWHDLEIGP | GAPHIFNCVV | EITKGSKVKY | ELDKKTGLIK | VDRILYSSVV | | 90 |
| SEQ_ID_NO_1041 | HPWHDLEIGP | GAPHIFNVVV | EITKGSKVKY | ELDKKTGLIK | VDRILYSSVV | | 86 |
| SEQ_ID_NO_1590 | HPWHDLEIGP | GAPHIFNVVV | EITKGSKVKY | ELDKKTGLIK | VDRILYSSVV | | 87 |
| SEQ_ID_NO_1577 | HPWHDLEIGP | GAPVIFNVVI | EISKGSKVKY | ELDKKTGLIK | VDRILYSSVV | | 87 |
| SEQ_ID_NO_1611 | HPWHDLEIGP | GAPSIFNVVI | EISKGSKVKY | ELDKKTGLIK | VDRILYSSVV | | 85 |
| SEQ_ID_NO_1637 | HPWHDLEIGP | GAPVIFNVVV | EISKGSKVKY | ELDKKTGLIK | VDRILYSSVV | | 85 |
| SEQ_ID_NO_1627 | HPWHDLEIGP | DAPTIFNCVI | EIPKGSKVKY | ELDKKTGLIK | VDRVLYSSVV | | 99 |
| SEQ_ID_NO_1608 | HPWHDLEIGP | GAPKIFNCVI | EIPKGSKVKY | ELDKKTGLIK | GDRILDSSVV | | 99 |
| SEQ_ID_NO_1609 | HPWHDLEIGP | EAPKIFNCVV | EIGKGSKVKY | ELDKKTGLIK | VDRVLYSSVV | | 67 |

Figure 55 (continued)

| SEQ ID | Col1 | Col2 | Col3 | Col4 | Col5 | Pos |
|---|---|---|---|---|---|---|
| SEQ_ID_NO_1578 | YPHNYGFVPK | TLCEDGDPLD | VLVLMQEPVV | PMCFLRAKP | GVMMLDQGE | 109 |
| SEQ_ID_NO_1607 | YPHNYGFIPR | TICEDSDPID | VLVLMQEPVL | TGSFLRARAI | GLMPMIDQGE | 140 |
| SEQ_ID_NO_1440 | YPHNYGFIPR | TLCEDGDPMD | VLVLMQEPVV | PGRFLRARAI | GLMPMIDQGE | 143 |
| SEQ_ID_NO_1648 | YPHNYGFIPR | TLCEDNDPLD | VLILMQEPVL | PGCFLRRAI | GLMPMIDQGE | 136 |
| SEQ_ID_NO_1651 | YPHNYGFIPR | SLCEDNDPMD | VLVLMQEPVL | PGAFLRARAI | GLMPMIDQGE | 147 |
| SEQ_ID_NO_1487 | YPHNYGFIPR | TLCEDNDPMD | VLVLMQEPVL | PGSFLRARAI | GLMPMIDQGE | 145 |
| SEQ_ID_NO_1040 | YPHNYGFIPR | TLCEDNDPMD | VLVLMQEPVI | PGSFLRARAI | GLMPMIDQGE | 138 |
| SEQ_ID_NO_1485 | YPHNYGFIPR | TLCEDNDPMD | VLVLMQEPVI | PGSFLRARAI | GLMPMIDQGE | 134 |
| SEQ_ID_NO_1580 | YPHNYGFIPR | TLCEDNDPLD | CLVIMQEPVL | PGCFLRARAL | GLMPMIDQGE | 136 |
| SEQ_ID_NO_1623 | YPQNYGFIPR | TLCEDNDPMD | VLVLMQEPVL | PGCFLRARAI | GLMPMIDQGE | 132 |
| SEQ_ID_NO_1622 | YPHNYGFIPR | TLCEDNDPID | VLVLMQEPVL | PGCFLRARAI | GLMPMIDQGE | 140 |
| SEQ_ID_NO_1041 | YPHNYGFIPR | TLCEDNDPLD | VLVLMQEPVL | PGCFLRARAI | GLMPMIDQGE | 136 |
| SEQ_ID_NO_1590 | YPHNYGFIPR | TLCEDNDPLD | VLVLMQEPVL | PGCFLRARAI | GLMPMIDQGE | 137 |
| SEQ_ID_NO_1577 | YPHNYGFVPR | TLCEDNDPID | VLVIMQEPVL | PGCFLRARAI | GLMPMIDQGE | 137 |
| SEQ_ID_NO_1611 | YPHNYGFIPR | TLCEDNDPLD | VLVIMQEPVL | PGCFLRARAI | GLMPMIDQGE | 135 |
| SEQ_ID_NO_1637 | YPHNYGFIPR | TLCEDNDPLD | VLVIMQEPVL | PGCFLRARAI | GLMPMIDQGE | 135 |
| SEQ_ID_NO_1627 | YPHNYGFIPR | TLCDDSDPID | VLVIMQEPVV | PGCFLRAKAI | GLMPMIDQGE | 149 |
| SEQ_ID_NO_1608 | YPHNYGFIPR | TLCEDNDPLS | CLDIMQEPVV | PGCFLRAKAI | GLMPMIDQGE | 149 |
| SEQ_ID_NO_1609 | YPHNYGFIPR | TICEDSDPMD | VLVIMQEPVL | PGCFLRAKAI | GLMPMIDQGE | 137 |

| SEQ ID | Col1 | Col2 | Col3 | Col4 | Col5 | Pos |
|---|---|---|---|---|---|---|
| SEQ_ID_NO_1578 | RDDKLIAVHA | DDPEYKGFTD | ISQLPPHRLA | EIKRFFEDYK | KNEHKEVVVD | 159 |
| SEQ_ID_NO_1607 | KDDKIIAVCA | DDPEFRHYRD | IKELPPHRLA | EIRRFFEDYK | KNENKKVAVE | 190 |
| SEQ_ID_NO_1440 | KDDKIIAVCA | DDPEVRHYTD | INQLPPHRLA | EIRRFFEDYK | KNENKEVAVN | 193 |
| SEQ_ID_NO_1648 | KDDKIIAVCA | DDPEYRHYTD | IKQLAPHRLA | EIRRFFEDYK | KNENKEVAVN | 186 |
| SEQ_ID_NO_1651 | KDDKIIAVCA | DDPEYRHYND | ISELSPHRLQ | EIRRFFEDYK | KNENKEVAVN | 197 |
| SEQ_ID_NO_1487 | KDDKIIAVCA | DDPEYRHFNN | LSELSPHRLQ | EIRRFFEDYK | KNENKEVAVN | 195 |
| SEQ_ID_NO_1040 | KDDKIIAVCA | DDPEYRHYSI | SVSLPFRLQ | ELKRFLEDYK | KNENKEVAVD | 186 |
| SEQ_ID_NO_1485 | KDDKIIAVCA | DDPEYRHYND | IN........ | .........K | KNENKEVAVD | 167 |
| SEQ_ID_NO_1580 | KDDKIIAVCV | DDPEYKHYTD | IKDLPPHRLT | EIRRFFEDYK | KNENKEVAVD | 186 |
| SEQ_ID_NO_1623 | KDDKIIAVCA | DDPEYRHYTD | IKQLPPHRLA | EIRRFFEDYK | KNENKDVAVD | 182 |
| SEQ_ID_NO_1622 | KDDKIIAVCA | DDPEYKHFTD | YKELAPHRIM | EIRRFFEDYK | KNENKEVAVN | 190 |
| SEQ_ID_NO_1041 | KDDKIIAVCA | DDPEYKHYTD | IKELAPHRLS | EIRRFFEDYK | KNENKEVAVN | 186 |
| SEQ_ID_NO_1590 | KDDKIIAVCA | DDPEYKHYTD | IRELAPHRLS | EIRRFFEDYK | KNENKEVAVN | 187 |
| SEQ_ID_NO_1577 | KDDKIIAVCV | DDPEYKHITN | INELPPHRLS | EIRRFFEDYK | KNENKEVAVN | 187 |
| SEQ_ID_NO_1611 | KDDKIIAVCV | DDPEYKHYTD | IKELPPHRLS | EIRRFFEDYK | KNENKEVAVN | 185 |
| SEQ_ID_NO_1637 | KDDKIIAVCV | DDPEYKHYTD | IKELPPHRLT | EIRRFFEDYK | KNENKEVAVN | 185 |
| SEQ_ID_NO_1627 | ADDKIIAVCA | DDPEYRHFND | IKELPPHRLA | EIRRFFEDYK | KNENKEVAVN | 199 |
| SEQ_ID_NO_1608 | KDDQIIAVCA | DDPEYRHYND | IKELPPHRLA | EIRRFFEDYK | KNENKEVAVD | 199 |
| SEQ_ID_NO_1609 | KDDKIIAVCA | DDPEYRHYND | IKELPPHRLA | EIRRFFEDYK | KNENKEVEVH | 187 |

Figure 55 (continued)

| | | | | | |
|---|---|---|---|---|---|
| SEQ_ID_NO_1578 | DFLGAEEAKK | VVKDSLNMYQ | EHYVPRKLRN | VYE | 192 |
| SEQ_ID_NO_1607 | GFLPAQAAID | AIKDSMDLYA | A-YIKAGLQR | --- | 219 |
| SEQ_ID_NO_1440 | EFLPAQIAHD | AIQHSMDLYA | E-YILQTLRR | --- | 222 |
| SEQ_ID_NO_1648 | DFLPSATAHE | AIQYSMDLYA | E-YIMMSLRR | --- | 215 |
| SEQ_ID_NO_1651 | EFLPAEAARE | AIQYSMDLYG | Q-YIMQTLRR | --- | 226 |
| SEQ_ID_NO_1487 | DFLPAPTARE | AIQYSMDLYA | Q-YILQSLKR | --- | 224 |
| SEQ_ID_NO_1040 | AFLPATTARE | AIQYSMDLYA | Q-YILQSLRQ | --- | 215 |
| SEQ_ID_NO_1485 | AFLPANTARD | AIQYSMDLYA | Q-YILQSLRQ | --- | 196 |
| SEQ_ID_NO_1580 | KFLPATAAVE | AVQYSMDLYA | E-YIMQTLRR | --- | 215 |
| SEQ_ID_NO_1623 | DFLPPNSAVN | AIQYSMDLYA | E-YILHSLRK | --- | 211 |
| SEQ_ID_NO_1622 | DFLPPSTAVE | AIQYSMDLYA | E-YILHTLRR | --- | 219 |
| SEQ_ID_NO_1041 | DFLPSNTAVE | AIQYSMDLYA | E-YILHTLRR | --- | 215 |
| SEQ_ID_NO_1590 | DFLPSNSAVE | AIQYSMDLYA | E-YILHTLRR | --- | 216 |
| SEQ_ID_NO_1577 | DFLQPGPAIE | AIQYSMDLYA | E-YILHTLRR | --- | 216 |
| SEQ_ID_NO_1611 | DFLPNGPAVE | AIQYSMDLYA | E-YILHTLRR | --- | 214 |
| SEQ_ID_NO_1637 | DFLPNGPAVE | AIQYSMDLYA | E-YILHTLRR | --- | 214 |
| SEQ_ID_NO_1627 | DFLPSEDAYE | AIQHSMDLYA | T-YICEGLRR | --- | 228 |
| SEQ_ID_NO_1608 | DFLPASTAFD | AIQHSMNLYA | D-YIVESLRR | --- | 228 |
| SEQ_ID_NO_1609 | DFLLATTAMR | AIKHSMTLYA | D-YIVESLRR | --- | 216 |

Figure 56

```
SEQ_ID_NO_361    - - MNGGI GDA LMQP- - QHVQ V- MSS- - - - - - - - - - - - S LPMVASTFVA    31
SEQ_ID_NO_443    MDDPGASADP AARHHLSPQQ LGGQP- - - - - - - - - - - - P VPRSPTPLDL    36
SEQ_ID_NO_212    - MDDPGAADP GARP- - HHLS PGQPP- - - - - - - - - - - - V VPRSPTPLDL    33
SEQ_ID_NO_421    - - - - - - - - - - - - - - - - - - - - - - - - - - - - - - - - - - - -     0
SEQ_ID_NO_1437   MGGGSDTTDT NMMQRVNSSS GTSSS- - - - - - - - - - - - S PKHNLHLNP    36
SEQ_ID_NO_740    - MGDTEEANS EMIQRLQSSF GTTQSSSTTM AKQPFSLINQ DVSQLSLNP    49
SEQ_ID_NO_173    - MEDTEAASS FKMN- - NHME QLTIP- - - - - - - - - - - - Q FNASSQSQMR    33
SEQ_ID_NO_1461   - MEDTEAASS FKMN- - NHME QLTIP- - - - - - - - - - - - Q FNASSQSQMR    33

SEQ_ID_NO_361    EPAAAAAA- - - - - - - - - - - - - - - - - - - - - ANKP- RAAG - - - - LPPTP    52
SEQ_ID_NO_443    ASAAAASG- - - YRRLSPS- - - - LRPPAHP QARLP- SPYG - - - - QIPSP    72
SEQ_ID_NO_212    SSAAAAAAAA SYRRLSPS- - - - LRPPAHP QARLP- SPYP - - - - QIPSSS    73
SEQ_ID_NO_421    - - - - - - - - - - - - - - - - - - - - - MADS NSKPPMSSQN - - - - - - - - -    14
SEQ_ID_NO_1437   ALIRSHHH- - - - - - - FRH- - - - PFTGAPP PPIPPISPYS - - - - QIPAFL    69
SEQ_ID_NO_740    TQMRARHFTN FSQNFSGDSN KRVGFPPSHP NQIPPISPYS - - - - QIPVSR    95
SEQ_ID_NO_173    TVTRNHHH- - - - NQRGG- - - - GIPPSHP HQIPPISPYS HMNNQIPVSR    73
SEQ_ID_NO_1461   TVTRNHHH- - - - NQRGG- - - - GIPPSHP HQIPPISPYS HMNNQIPVSR    73

SEQ_ID_NO_361    - - - - - - - - - - - - - - - - - - - - - - - P- QVFA AQRAAAAA- - - - - - - - - -    65
SEQ_ID_NO_443    - - - - - - - - - - - GAGA- HHAR SLSQP- LFFS LDSLPPPP- - - - - - - - - -    97
SEQ_ID_NO_212    S- - - - - - APA AGSSG- HHAR SLSQP- LFFS LDSLPPLP- - - - - - - - - -   103
SEQ_ID_NO_421    - - - - - - - - - - FGVGAVSHVR SLSQS- SIFS NSCLPPLSPF PPSEPGMVSG    53
SEQ_ID_NO_1437   - - - - - - - - - - - LQP- RHSR SMSQPSSFFS FDSLPPLNPS APL- - - - - - -    98
SEQ_ID_NO_740    PVNQQMGPQB FSLGP- THSR SLQPSSFFS LDSLPPLSPA PFRDSSSPSV   144
SEQ_ID_NO_173    P- - - QMPSHS TSPTP- SHTR SLSQP- SFFS LDSLPPLSPC TFRESSSTSD   118
SEQ_ID_NO_1461   P- - - QMPSHS TSPTP- SHTR SLSQP- SFFS LDSLPPLSPC TFRESSSTSD   118

SEQ_ID_NO_361    - - - - GGDVCM EESAQGGGG- - - - - - - - - - - - - - - - - - - - GLPPRKA-    87
SEQ_ID_NO_443    - - - - YADL- - - - - - - GAAP AVPPSPPP- - - - STSDPPPL - - GLPPRRAG   129
SEQ_ID_NO_212    - - - - YADL- - - - - - - AAPP AIPPSPPS- - - SSSDPPPP - - GLPPRKGG   135
SEQ_ID_NO_421    RSS- LKDISM EEADVNSQGV GVVSS- - - - - - - FTRD- - - - GLPPRKG-    88
SEQ_ID_NO_1437   - - - - SVSVSV EEKTGAGFSP SLPPSPFTMC HSSSSRNAGD GENLPPRKS-   143
SEQ_ID_NO_740    SDPISTDVEM EEKDGGSHSL - LPPSPF- - - - NRGNAPRN VESLPPRKA-   187
SEQ_ID_NO_173    - - - HADVSM EDRDVTSHSP - LPP- - - - - - - FAARNP- - - SLPPRKS-   150
SEQ_ID_NO_1461   - - - HADVSM EDRDVTSHSP - LPP- - - - - - - FAARNP- - - SLPPRKS-   150
```

Figure 56 (continued)

| | | | | | | | |
|---|---|---|---|---|---|---|---|
| SEQ_ID_NO_361 | HRRSSSDVPF | GYL-----A | GQHQLLPP- | ---------- | ---------- | ---------- | 109 |
| SEQ_ID_NO_443 | HRRSQSDIPF | GFA-----Q | LSPPLPPP- | ---------- | ---------- | ---------- | 151 |
| SEQ_ID_NO_212 | HRRSQSDIPF | GFS-----H | LSPPLPPP- | ---------- | ---------- | ---------- | 157 |
| SEQ_ID_NO_421 | HRRSNSDVPL | GFSAMI--Q | SSPQLMPI- | ---------- | ---------- | ---------S | 114 |
| SEQ_ID_NO_1437 | HRRSNSDVTF | GFSSMMSQNQ | KSPPLSSLER | SISGEDT--- | ---------- | --------SD | 182 |
| SEQ_ID_NO_740 | HRRSNSDIPF | GLANVL--Q | CSPPLIPS-R | GSSGLERSMS | GRENLGMAKP | | 233 |
| SEQ_ID_NO_173 | HRRSNSDIPF | GFSTVL--Q | SSPPLIPL-R | GREGV----- | ---------- | --------KP | 183 |
| SEQ_ID_NO_1461 | HRRSNSDIPF | GFSTVL--Q | SSPPLIPL-R | GREGV----- | ---------- | --------KP | 183 |

| | | | | | | | |
|---|---|---|---|---|---|---|---|
| SEQ_ID_NO_361 | -----KVEAG | A-----GHL | GACA----GG | AAAADDLFNA | YLNLDGLDGL | | 144 |
| SEQ_ID_NO_443 | --APVKREVT | A-----AAD | GCRSDGGGGD | DAALYDLVNA | YMDLDGLDPL | | 193 |
| SEQ_ID_NO_212 | --APVKREAA | T-----AAE | GCRSD---GD | DFALYDLVNS | YMDLDGMEAL | | 196 |
| SEQ_ID_NO_421 | GDKVLGRAVS | LG-----DSN | GKIDERKPKG | ELVTDELLFS | YMNLENIETL | | 158 |
| SEQ_ID_NO_1437 | WSNLVKKE-- | ------PRE | GFYKGRKPEV | EAAMDDVFTA | YMNLDNIDVL | | 223 |
| SEQ_ID_NO_740 | ADSVKK---E | WERGCDSNAE | GMGERKS-EG | ELVVDDLFSA | YMNLDNIDVL | | 278 |
| SEQ_ID_NO_173 | NSSVVKRETN | WEHG--NVE | GSGEKKSPEG | ELVVDDLFSA | YMNLDSFDTL | | 229 |
| SEQ_ID_NO_1461 | NSSVVKRETN | WEHG--NVE | EKIKSLSPEG | ELVVDDLFSA | YMNLDNIDAI | | 228 |

| | | | | | | | |
|---|---|---|---|---|---|---|---|
| SEQ_ID_NO_361 | NSSDDRH-DE | GD------- | SRGSSI-KTN | GADSSENESE | ECADDTRGGI | | 184 |
| SEQ_ID_NO_443 | NSSEDRH-DD | RD------- | SRASGTRAGS | AAESSENEAE | S--------- | | 225 |
| SEQ_ID_NO_212 | NSSEERH-ED | RD------- | SRASGTRTGS | VADSSENEAE | S--------- | | 228 |
| SEQ_ID_NO_421 | NGSGTKD-RD | KD------- | SIVSGT-KVT | GSESSNNEAE | SVNKGNNVS- | | 197 |
| SEQ_ID_NO_1437 | NSFGGEDGKN | GNENVFEMES | SRGSGTKKTN | GGDSSDSEGD | SSASGNVK-- | | 271 |
| SEQ_ID_NO_740 | NSSGTDD-KN | GNENREDLD- | SRASGT-KTN | GGDSSDNEAE | SSVNESGGNL | | 325 |
| SEQ_ID_NO_173 | NSSGTDD-KN | GRENRDDLD- | SRADGT-KTN | GGDSSDNEAE | SSVNESGH-- | | 274 |
| SEQ_ID_NO_1461 | NDDKNAATDD | ---------- | SRASGT-KTN | GGDSSDNEAE | SSVNESG--- | | 264 |

| | | | | | | | |
|---|---|---|---|---|---|---|---|
| SEQ_ID_NO_361 | RLWS-ADGGE | RREGVKRNAA | GEPATAPLAR | HARSLSMDS- | LIGKFNFTAG | | 232 |
| SEQ_ID_NO_443 | ---------- | QSTSADRKDG | GK-----BR | HCRSLSIDS- | FMGKLSFAAG | | 258 |
| SEQ_ID_NO_212 | ---------- | HSTPVERKDG | GG-----KSR | HCRSLSVDS- | FIEKLNF--- | | 259 |
| SEQ_ID_NO_421 | ----IQPTN | LREGTKRSAD | AN--IAPAAR | HFRSLSMDS- | AIGNFHY--G | | 237 |
| SEQ_ID_NO_1437 | ----VALSS | SSSGVKRRAG | GD--IAPTGR | HYRSVSMDSC | FMGKLNF--G | | 312 |
| SEQ_ID_NO_740 | PRAGLSSSTE | KREGIKRSAG | GD--IAPTTR | HYRSVSMDS- | FMGKLNF--G | | 370 |
| SEQ_ID_NO_173 | ------GGSE | KREGMKRSAG | GE--IAPTTR | HYRSVSMDS- | FIGKLNF--G | | 313 |
| SEQ_ID_NO_1461 | ------DSMQ | RREGNKRSAG | GD--IAPTTR | HYRSVSMDS- | FIGKLNF--N | | 303 |

Figure 56 (continued)

| | | | | | | |
|---|---|---|---|---|---|---|
| SEQ_ID_NO_361 | TA------- AAAGNGVALG | PN------- | RFSLEFGSGE | FTPSEMKKIM | 266 |
| SEQ_ID_NO_443 | EESP-KLPLP SPGGSLTRSG | SGSLEGGAVA | LFNMEFTNGE | FTDSEKKKIM | 307 |
| SEQ_ID_NO_212 | DESP-KLPLP SPSGGLSRSG | SGSLDGGAAS | LFSAEFANGE | FTEAEKKKIM | 308 |
| SEQ_ID_NO_421 | DESP-NLP-T SLMMRSGQLS | PSNSGNESSS | KHNLDFGNSE | FSEAEMKKIM | 285 |
| SEQ_ID_NO_1437 | DESSLKLP-P SSSA---KVS | PTNSGEGNSS | AYSVEFGNSE | FTAAEMKKIA | 358 |
| SEQ_ID_NO_740 | NESP-KLP-P SPGTRPGQLS | PTDSIDGN-- | AFSLDFGNGE | FSGAELKKIM | 416 |
| SEQ_ID_NO_173 | DESP-KLP-P SPGDRGRLMS | PAGGDGNSA | AFSLEFGSGE | FSGPELKKIM | 361 |
| SEQ_ID_NO_1461 | DESL-KMP-P SPGG---LMS | PGNSGDGNNA | AFSLEFGNGE | FSGPELKKIM | 348 |

| | | | | | | |
|---|---|---|---|---|---|---|
| SEQ_ID_NO_361 | ADEKLAEMAL | ADPKRVKRVL | ANRQSAARSK | ERKMRYIAEL | EQKVQLQSE | 316 |
| SEQ_ID_NO_443 | ANERLAEIAL | TDPKRVKRIL | ANRQSAARSK | ERKMRYIQEL | EHKVQVLQTE | 357 |
| SEQ_ID_NO_212 | ANERLAEIAL | TDPKRVKRIL | ANRQSAARSK | ERKMRYIQEL | EHKVQVLQTE | 358 |
| SEQ_ID_NO_421 | ADERLAEIAV | LDPKRAKRIL | ANRLSAARSK | ERKTRYISEL | EHKVQKLQTE | 335 |
| SEQ_ID_NO_1437 | ADEKLAEIVM | ADPKRVKRIL | ANRVSAARSK | ERKTRYMAEL | EHKVQTLQTE | 408 |
| SEQ_ID_NO_740 | ANEKLAEIAL | ADPKRAKRIL | ANRQSAARSK | ERKMRYISEL | EHKVQTLQTE | 466 |
| SEQ_ID_NO_173 | ANEKLAEIAL | TDPKRAKRIL | ANRQSAARSK | ERKMRYISEL | EHKVQTLQTE | 411 |
| SEQ_ID_NO_1461 | ANEKLAEIAM | ADPKRAKRIL | ANRQSAARSK | ERKMRYISEL | EHKVQTLQTE | 398 |

| | | | | | | |
|---|---|---|---|---|---|---|
| SEQ_ID_NO_361 | ATNLSAQLTM | MQRDSAGLAT | QNNELKFRLH | AMEQQAQLRD | ALNEALTTFV | 366 |
| SEQ_ID_NO_443 | ATTLSAQLTM | LQRDSAGLAT | QNNELKIRLQ | AMEQQAQLRD | ALNEALTAEV | 407 |
| SEQ_ID_NO_212 | ATTLSAQLTM | LQRDSTGLAT | QNNELKIRLQ | AMEQQAQLRD | ALNEALTAEV | 408 |
| SEQ_ID_NO_421 | TTTLSTQVTI | LQKNFVESS | LNSELKFRIQ | AMEQQAQLRD | ALHEALTAEV | 385 |
| SEQ_ID_NO_1437 | ATTLSAQLTH | LQRDSMGLTN | QNSELKFRLQ | AMEQQAQLRD | ALSEKLNEFV | 458 |
| SEQ_ID_NO_740 | ATTLSAQLTL | LQRDSVGLTN | QNNELKFRIQ | AMEQQAQLRD | ALNEALTAEV | 516 |
| SEQ_ID_NO_173 | ATTLSAQLTL | LQRDSAGLTN | QNSELKFRLQ | SMEQQAKLRD | ALNEALTAEV | 461 |
| SEQ_ID_NO_1461 | ATTLSAQLTL | LQRDSVGLTN | QNSELKFRLQ | SMEQQAKLRD | ALNEALTAEV | 448 |

| | | | | | | |
|---|---|---|---|---|---|---|
| SEQ_ID_NO_361 | QRLKLATAEL | GDSCSSSSLA | QQLQLNAQNQ | MFQL------ | ------QQQ | 403 |
| SEQ_ID_NO_443 | QRLKLATGEV | T-DGRMPKGL | QQQM---NSQ | MLQL------ | ------QQL | 440 |
| SEQ_ID_NO_212 | QRLKLATGEI | T-DGRMSKGL | QQQM---NSQ | LLQL------ | ---------- | 438 |
| SEQ_ID_NO_421 | QRLKLAAGEH | REEGRLPNNW | TQQT-PVKHN | FQM------ | ---------- | 418 |
| SEQ_ID_NO_1437 | QRLKLVIGEP | NRRQSGSSSS | ESKMSLNPE | MFQQ------ | ---------L | 492 |
| SEQ_ID_NO_740 | RRLKIATAEQ | GGDSDPSKSM | VQQQLSINPQ | MYLQQPRPSQ | LGMHQLQQQS | 566 |
| SEQ_ID_NO_173 | QRLKIATAEL | SSDSHGSSCL | PQH-SVNPL | MFQQ------ | ------QPP | 497 |
| SEQ_ID_NO_1461 | QRLKIVTAEL | NGESLPSNCM | POH-SVNPM | MFQQ------ | ---------- | 481 |

Figure 56 (continued)

| | | | | | | |
|---|---|---|---|---|---|---|
| SEQ_ID_NO_361  | QAT QL PFYQL | QQSQ | | Q | NGAAKNNESK | E | 429 |
| SEQ_ID_NO_443  | QVQQQAPQAQ  | QQGQ | | | RQQQQQPQKS | A | 465 |
| SEQ_ID_NO_212  | --QQLQI QQQ | QSSQ | | | ----TTQDDR | L | 457 |
| SEQ_ID_NO_421  | --QRQQPSQM  | QQLS | | VGK | ASAASATPAS | A | 444 |
| SEQ_ID_NO_1437 | SI SQLQHQQM | QHSN | | QC  | STMKAKHTSN | D | 519 |
| SEQ_ID_NO_740  | SASQFNMHQR  | QRQQQQQQQQ | QSSQPQPQQN | GNTTPKPDSN | Q | 607 |
| SEQ_ID_NO_173  | SASQQNI HLQ | QQQH | | RQN | GNANSNSDLK | Q | 525 |
| SEQ_ID_NO_1461 | ---QHQHQQH  | QQQQ | | QQN | GNANSKNELK | Q | 506 |

Figure 57

| | | | | | | | |
|---|---|---|---|---|---|---|---|
| SEQ_ID_NO_97   | ----MGMKSP | NIAAFMLPLL | LILFTLSSQL | KVVESTGRKL | -AWGFSGIPI | | 45 |
| SEQ_ID_NO_2013 | MKKKMGSKSP | NIBAFVLPLL | LILFTLSSQA | RLIESTGRKL | AAWGFGGAPI | | 50 |
| SEQ_ID_NO_2015 | ----MGSKSP | NIAALVLPLL | LILFSLSSQA | RLVESSGRKL | AAWGFGGAPI | | 46 |

| | | | | | | | |
|---|---|---|---|---|---|---|---|
| SEQ_ID_NO_97   | VYTPPSRSCG | TSPAVFLSKW | RRPRPCRLPP | GRYI PRSDQS | P | 86 |
| SEQ_ID_NO_2013 | WTPPSNSCG  | ASPAVWYPKP | TKRGPCRGPP | GIGIPTSYQS | P | 91 |
| SEQ_ID_NO_2015 | RTPSSNSCG  | ASPAVWYPKP | TKPRPCRRTP | GIGIPTSHQS | P | 87 |

NUCLEOTIDE SEQUENCES AND CORRESPONDING POLYPEPTIDES CONFERRING MODIFIED PHENOTYPE CHARACTERISTICS IN PLANTS

CROSS REFERENCES TO RELATED APPLICATIONS

This application is a divisional of co-pending application Ser. No. 15/689,941, filed Aug. 29, 2017 (pending), which application is a divisional of application Ser. No. 13/644,359, now U.S. Pat. No. 9,777,287 filed Oct. 4, 2012, which application is a Continuation-in-Part of co-pending application Ser. No. 13/465,846, filed on May 7, 2012 (abandoned), and for which priority is claimed under 35 U.S.C. § 120. application Ser. No. 13/465,846 is a Division of application Ser. No. 10/572,827, now U.S. Pat. No. 8,193,409, filed on Mar. 7, 2007. The entire contents of each of which are hereby incorporated by reference, including their sequence listings.

This application is a Continuation-in-Part of co-pending application Ser. No. 11/779,266 filed on Jul. 17, 2007 and for which priority is claimed under 35 U.S.C. § 120. Applications Ser. No. 11/779,266 is a Continuation-in-Part of application Ser. No. 11/778,060, now abandoned, filed Jul. 15, 2007. Application Ser. No. 11/778,060 is a Continuation-in-Part of application Ser. No. 11/248,547, now U.S. Pat. No. 7,244,879, filed Oct. 12, 2005. The entire contents of each of which are hereby incorporated by reference, including their sequence listings.

This application is a Continuation-in-Part of co-pending application Ser. No. 12/514,991 filed on Jan. 8, 2010 and for which priority is claimed under 35 U.S.C. § 120. Application Ser. No. 12/514,991 is a national phase under 35 U.S.C. § 371 of PCT International Application No. PCT/US2007/085007 which has the International filing date of Nov. 16, 2007, which designated the United States of America, and which claims priority under 35 U.S.C. § 119(e) of U.S. Provisional Application No. 60/859,467, filed Nov. 16, 2006. The entire contents of each of which are hereby incorporated by reference, including their sequence listings.

This application is a Continuation-in-Part of co-pending application Ser. No. 12/445,005 filed on Jul. 13, 2011 and for which priority is claimed under 35 U.S.C. § 120. Application Ser. No. 12/445,005 is a national phase under 35 U.S.C. § 371 of PCT International Application No. PCT/US2007/081301 which has the International filing date of Oct. 12, 2007, which designated the United States of America, and which claims priority under 35 U.S.C. § 119(e) of U.S. Provisional Application No. 60/851,585, filed Oct. 12, 2006. The entire contents of each of which are hereby incorporated by reference, including their sequence listings.

This application is a Continuation-in-Part of co-pending application Ser. No. 12/515,707 filed on Dec. 16, 2009 and for which priority is claimed under 35 U.S.C. § 120. Application Ser. No. 12/515,707 is a national phase under 35 U.S.C. § 371 of PCT International Application No. PCT/US2007/085439 which has the International filing date of Nov. 21, 2007, which designated the United States of America, and which claims priority under 35 U.S.C. § 119(e) of U.S. Provisional Application No. 60/860,296, filed Nov. 21, 2006. The entire contents of each of which are hereby incorporated by reference, including their sequence listings.

This application is a Continuation-in-Part of co-pending application Ser. No. 12/615,920 filed on Nov. 10, 2009 and for which priority is claimed under 35 U.S.C. § 120. Application Ser. No. 12/615,920 is a Division of application Ser. No. 11/114,963, now U.S. Pat. No. 7,696,409, filed on Apr. 25, 2005. Application Ser. No. 11/114,963 claims priority under 35 U.S.C. § 119(e) of U.S. Provisional Application No. 60/564,659, filed Apr. 23, 2004. The entire contents of each of which are hereby incorporated by reference, including their sequence listings.

This application is a Continuation-in-Part of co-pending application Ser. No. 12/605,261 filed on Oct. 23, 2009 and for which priority is claimed under 35 U.S.C. § 120. Application Ser. No. 12/605,261 is a Division of application Ser. No. 11/298,391, now U.S. Pat. No. 7,663,027, filed on Dec. 8, 2005. Application Ser. No. 11/298,391 claims priority under 35 U.S.C. § 119(e) of U.S. Provisional Application Nos. 60/635,115, filed Dec. 8, 2004 and 60/635,140, filed on Dec. 8, 2004. The entire contents of each of which are hereby incorporated by reference, including their sequence listings.

This application is a Continuation-in-Part of co-pending application Ser. No. 12/377,106 filed on Aug. 13, 2010 and for which priority is claimed under 35 U.S.C. § 120. Application Ser. No. 12/377,106 is a national phase under 35 U.S.C. § 371 of PCT International Application No. PCT/US2007/075747 which has the International filing date of Aug. 10, 2007, which designated the United States of America, and which claims priority under 35 U.S.C. § 119(e) of U.S. Provisional Application No. 60/837,434, filed Aug. 11, 2006. The entire contents of each of which are hereby incorporated by reference, including their sequence listings.

This application is a Continuation-in-Part of co-pending application Ser. No. 12/541,607 filed on Aug. 14, 2009 and for which priority is claimed under 35 U.S.C. § 120. Application Ser. No. 12/541,607 is a Continuation of application Ser. No. 11/140,347, now U.S. Pat. No. 7,576,260, filed on May 27, 2005. Application Ser. No. 11/140,347 claims priority under 35 U.S.C. § 119(e) of U.S. Provisional Application No. 60/575,309, filed May 27, 2004. The entire contents of each of which are hereby incorporated by reference, including their sequence listings.

This application is a Continuation-in-Part of co-pending application Ser. No. 13/184,361 filed on Jul. 15, 2011 and for which priority is claimed under 35 U.S.C. § 120. Application Ser. No. 13/184,361 is a Division of application Ser. No. 11/140,450, now U.S. Pat. No. 8,022,273, filed on May 27, 2005. Application Ser. No. 11/140,450 claims priority under 35 U.S.C. § 119(e) of U.S. Provisional Application No. 60/575,253, filed May 27, 2004. The entire contents of each of which are hereby incorporated by reference, including their sequence listings.

This application is a Continuation-in-Part of co-pending application Ser. No. 11/654,357 filed on Jan. 16, 2007 and for which priority is claimed under 35 U.S.C. § 120. Application Ser. No. 11/654,357 is a Non-Provisional which claims priority under 35 U.S.C. § 119(e) of U.S. Provisional Application Nos. 60/778,568, filed Mar. 1, 2006 and 60/758,831, filed on Jan. 13, 2006. The entire contents of each of which are hereby incorporated by reference, including their sequence listings.

This application is a Continuation-in-Part of co-pending application Ser. No. 13/465,841 filed on May 7, 2012 and for which priority is claimed under 35 U.S.C. § 120. Application Ser. No. 13/465,841 is a Division of application Ser. No. 11/858,117, now abandoned, filed on Sep. 19, 2007. Application Ser. No. 11/858,117 is a Continuation-in-Part of Application No. PCT/US2007/06544 which has the International filing date of Mar. 14, 2007, and which claims priority under 35 U.S.C. § 119(e) of U.S. Provisional Application No. 60/782,735, filed Mar. 14, 2006. The entire contents of each of which are hereby incorporated by reference, including their sequence listings.

This application is a Continuation-in-Part of co-pending application Ser. No. 12/918,309 filed on Nov. 22, 2010 and for which priority is claimed under 35 U.S.C. § 120. Application Ser. No. 12/918,309 is a national phase under 35 U.S.C. § 371 of PCT International Application No. PCT/US2009/034638 which has the International filing date of Feb. 20, 2009, which designated the United States of America, and which claims priority under 35 U.S.C. § 119(e) of U.S. Provisional Application No. 61/030,152, filed Feb. 20, 2008. The entire contents of each of which are hereby incorporated by reference, including their sequence listings.

This application is a Continuation-in-Part of co-pending application Ser. No. 12/922,143 filed on Feb. 1, 2011 and for which priority is claimed under 35 U.S.C. § 120. Application Ser. No. 12/922,143 is a national phase under 35 U.S.C. § 371 of PCT International Application No. PCT/US2009/037025 which has the International filing date of Mar. 12, 2009, which designated the United States of America, and which claims priority under 35 U.S.C. § 119(e) of U.S. Provisional Application No. 61/036,396, filed Mar. 13, 2008. The entire contents of each of which are hereby incorporated by reference, including their sequence listings.

This application is a Continuation-in-Part of co-pending application Ser. No. 11/241,685 filed on Sep. 30, 2005 and for which priority is claimed under 35 U.S.C. § 120. Application Ser. No. 11/241,685 is a Non-provisional which claims priority under 35 U.S.C. § 119(e) of U.S. Provisional Application No. 60/615,080, filed on Sep. 30, 2004. The entire contents of each of which are hereby incorporated by reference, including their sequence listings.

This application is a Continuation-in-Part of co-pending application Ser. No. 12/863,773 filed on Nov. 23, 2010 and for which priority is claimed under 35 U.S.C. § 120. Application Ser. No. 12/863,773 is a national phase under 35 U.S.C. § 371 of PCT International Application No. PCT/US2009/031609 which has the International filing date of Jan. 21, 2009, which designated the United States of America, and which claims priority under 35 U.S.C. § 119(e) of U.S. Provisional Application No. 61/022,786, filed Jan. 22, 2008. The entire contents of each of which are hereby incorporated by reference, including their sequence listings.

This application is a Continuation-in-Part of co-pending application Ser. No. 12/282,342 filed on Nov. 17, 2008 and for which priority is claimed under 35 U.S.C. § 120. Application Ser. No. 12/282,342 is a national phase under 35 U.S.C. § 371 of PCT International Application No. PCT/US2007/06544 which has the International filing date of Mar. 14, 2007, which designated the United States of America, and which claims priority under 35 U.S.C. § 119(e) of U.S. Provisional Application No. 60/782,735, filed Mar. 14, 2006. The entire contents of each of which are hereby incorporated by reference, including their sequence listings.

This application is a Continuation-in-Part of co-pending application Ser. No. 12/776,319 filed on May 7, 2010 and for which priority is claimed under 35 U.S.C. § 120. Application Ser. No. 12/776,319 is a Division of application Ser. No. 11/324,093, now U.S. Pat. No. 7,803,983, filed on Dec. 29, 2005. Application Ser. No. 11/324,093 is a Continuation-in-Part of application Ser. No. 11/172,740, now U.S. Pat. No. 7,396,979, filed on Jun. 30, 2005. Application Ser. No. 11/172,740 claims priority under 35 U.S.C. § 119(e) of U.S. Provisional Application Nos. 60/584,829, 60/583,621, and 60/584,800, all filed on Jun. 30, 2004. The entire contents of each of which are hereby incorporated by reference, including their sequence listings.

This application is a Continuation-in-Part of co-pending application Ser. No. 12/911,698 filed on Oct. 25, 2010 and for which priority is claimed under 35 U.S.C. § 120. Application Ser. No. 12/911,698 is a Division of application Ser. No. 11/324,098, now U.S. Pat. No. 7,884,261, filed on Dec. 29, 2005. Application Ser. No. 11/324,098 is a Continuation-in-Part of application Ser. No. 11/172,740, now U.S. Pat. No. 7,396,979, filed on Jun. 30, 2005. Application Ser. No. 11/172,740 claims priority under 35 U.S.C. § 119(e) of U.S. Provisional Application Nos. 60/584,829, 60/583,621, and 60/584,800, all filed on Jun. 30, 2004. The entire contents of each of which are hereby incorporated by reference, including their sequence listings.

This application is a Continuation-in-Part of co-pending application Ser. No. 13/609,176 filed on Sep. 10, 2012 and for which priority is claimed under 35 U.S.C. § 120. Application Ser. No. 13/609,176 is a Division of application Ser. No. 12/139,269, pending, filed on Jun. 13, 2008. Application Ser. No. 12/139,269 is a Division of application Ser. No. 11/172,740, now U.S. Pat. No. 7,396,979, filed on Jun. 30, 2005. Application Ser. No. 11/172,740 claims priority under 35 U.S.C. § 119(e) of U.S. Provisional Application Nos. 60/584,829, 60/583,621, and 60/584,800, all filed on Jun. 30, 2004. The entire contents of each of which are hereby incorporated by reference, including their sequence listings.

TECHNICAL FIELD the present invention relates to methods and materials involved in tolerance of a plant to limiting exogenous nitrogen sources. For example, this document provides plants having increased low-nitrogen tolerance levels as well as materials and methods for making plants and plant products having increased low-nitrogen tolerance levels.

BACKGROUND

Nitrogen is often the rate-limiting element in plant growth, and all field crops have a fundamental dependence on exogenous nitrogen sources.

According to a recent study published in Field Crops Research (Volume 100, Issues 2-3, 1 Feb. 2007, Pages 210-217), Nitrogenous fertilizer, which is usually supplied as ammonium nitrate, potassium nitrate, or urea, typically accounts for 40% of the costs associated with crops, such as corn and wheat in intensive agriculture.

Improving nitrogen use efficiency of crop plants is an important goal towards reducing input costs and reducing the environmental consequences of intensive nitrogen fertilization on the environment. Increased efficiency of nitrogen use by plants should enable the production of higher yields with existing fertilizer inputs and/or enable existing yields of crops to be obtained with lower fertilizer input, or better yields on soils of poorer quality. Also, higher amounts of proteins in the crops could also be produced more cost-effectively.

Plants have a number of means to cope with nutrient deficiencies, such as poor nitrogen availability. One important mechanism senses nitrogen availability in the soil and respond accordingly by modulating gene expression while a second mechanism is to sequester or store nitrogen in times of abundance to be used later. The nitrogen sensing mechanism relies on regulated gene expression and enables rapid physiological and metabolic responses to changes in the supply of inorganic nitrogen in the soil by adjusting nitrogen uptake, reduction, partitioning, remobilization and transport in response to changing environmental conditions. Nitrate acts as a signal to initiate a number of responses that serve to reprogram plant metabolism, physiology and development (Redinbaugh et al. (1991) *Physiol. Plant.* 82, 640-650; Forde (2002) *Annual Review of Plant Biology* 53, 203-224). Nitrogen-inducible gene expression has been characterized for a number of genes in some detail. These include nitrate reductase, nitrite reductase, 6-phosphoglucante dehydrogenase, and nitrate and ammonium transporters (Redinbaugh et al. (1991) *Physiol. Plant.* 82, 640-650; Huber et al. (1994) *Plant Physiol* 106, 1667-1674; Hwang et al. (1997) *Plant Physiol.* 113, 853-862; Redinbaugh et al. (1998) *Plant Science* 134, 129-140; Gazzarrini et al. (1999) *Plant Cell* 11, 937-948; Glass et al. (2002) *J. Exp. Bot.* 53, 855-864; Okamoto et al. (2003) *Plant Cell Physiol.* 44, 304-317).

In the fields of agriculture and forestry, efforts are constantly being made to produce plants with an increased growth potential in order to feed the ever-increasing world population and to guarantee the supply of reproducible raw materials. There is a need for methods of increasing nitrogen use efficiency in plants, which leads to better growth potential and more biomass. This is done conventionally through plant breeding. The breeding process is, however, both time-consuming and labor-intensive. Furthermore, appropriate breeding programs must be performed for each relevant plant species. In addition, although great progresses that have been made about nitrogen utilization and the components involved in nitrogen use efficiency, such as nitrogen uptake, nitrogen assimilation and nitrogen partitioning or remobilization, much is still unknown about many of these complex interactions. Therefore, there is a continuing need for generally applicable processes that improve forest or agricultural plant growth to suit particular needs depending on specific environmental conditions. For example, genes that confer tolerance to growth on low nitrogen supply are valuable product prototypes for manipulating nitrogen use efficiency in plants (Good et al., 2004). One strategy to achieve such desirable traits involves genetic manipulation of plant characteristics through the introduction of exogenous nucleic acids conferring increased efficiency of nitrogen use by plants, which in turn should enable the production of higher yields with existing fertilizer inputs and/or enable existing yields of crops to be obtained with lower fertilizer input, or better yields on soils of poorer quality. Such approaches have the advantage of not usually being limited to one plant species, but instead being transferable among plant species. The present invention relates to a method for increasing growth potential, and/or increasing levels of nitrogen use efficiency in plants, characterized by expression of recombinant DNA molecules stably integrated into the plant genome.

SUMMARY

The present invention provides methods and materials related to plants having modulated levels of low-nitrogen tolerance. For example, the present invention provides transgenic plants and plant cells having increased levels of low-nitrogen tolerance, nucleic acids (i.e. isolated polynucleotides), polypeptides encoded thereby used to generate transgenic plants and plant cells having increased levels of low-nitrogen tolerance, and methods for making plants and plant cells having increased levels of low-nitrogen tolerance. Such plants and plant cells can be grown under limiting exogenous nitrogen without stunted growth and diminished yields. Plants having increased low-nitrogen tolerance levels may be useful to produce biomass which may be converted to a liquid fuel or other chemicals and/or to produce food and feed on land that is currently marginally productive, resulting in an overall expansion of arable land.

Methods of producing a plant tissue are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 20, using an HMM generated from the amino acid sequences depicted in one of FIGS. 1-57. The tissue has a difference in the level of low-nitrogen tolerance as compared to the corresponding level in tissue of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence encoding a polypeptide having 80 percent or greater sequence identity to an amino acid sequence set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, or SEQ ID NO:1577. A plant and/or plant tissues produced from the plant cell has a difference in the level of low-nitrogen tolerance as compared to the corresponding level of low-nitrogen tolerance of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence having 80 percent or greater sequence identity to a nucleotide sequence, or a fragment thereof, set forth in SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, or SEQ ID NO:1576. A plant and/or plant tissues produced from the plant cell has a difference in the level of low-nitrogen tolerance as compared to the corresponding level low-nitrogen tolerance of a control plant that does not comprise the exogenous nucleic acid.

In another aspect, the invention provides a method of producing a plant, the method comprising growing a plant cell comprising an exogenous nucleic acid that is effective for downregulating an endogenous nucleic acid in the plant cell, wherein the endogenous nucleic acid encodes a polypeptide, and wherein the HMM bit score of the amino acid sequence of the polypeptide is greater than about 20, said HMM based on the amino acid sequences depicted in one of FIGS. 1-57.

Methods of modulating the level of low-nitrogen tolerance in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 1-57. A plant and/or plant tissue produced from the plant cell has a difference in the level of low-nitrogen tolerance as compared to the corresponding level of low-nitrogen tolerance of a control plant that does not comprise the exogenous nucleic acid.

In certain embodiments, the HMM bit score of the amino acid sequence of the polypeptide is greater than about 40, using an HMM generated from the amino acid sequences depicted in one of FIGS. 1-57, wherein the polypeptide comprises a Pfam domain having 70 percent or greater sequence identity to a Pfam domain of any one of the polypeptides in the sequence listing.

In another aspect, a method comprises modulating the level of low-nitrogen tolerance in a plant by introducing into a plant cell an exogenous nucleic acid that comprises a regulatory region operably linked to a nucleotide sequence encoding a polypeptide having 80 percent or greater sequence identity to an amino acid sequence set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, or SEQ ID NO:1577, or a fragment thereof. A plant and/or plant tissue produced from the plant cell has a difference in the level of low-nitrogen tolerance as compared to the corresponding level of low-nitrogen tolerance of a control plant that does not comprise the exogenous nucleic acid.

In another aspect, a method comprises modulating the level of low-nitrogen tolerance in a plant by introducing into a plant cell an exogenous nucleic acid, that comprises a regulatory region operably linked to a nucleotide sequence having 80 percent or greater sequence identity to a nucleotide sequence set forth in SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, or SEQ ID NO:1576, or a fragment thereof. A plant and/or plant tissue produced from the plant cell has a difference in the level of low-nitrogen tolerance as compared to the corresponding level of low-nitrogen tolerance of a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than about 20, using an HMM based on the amino acid sequences depicted in one of FIGS. 1-57. The plant has a difference in the level of low-nitrogen tolerance as compared to the corresponding level of low-nitrogen tolerance of a control plant that does not comprise the exogenous nucleic acid. In another aspect, the exogenous nucleic acid comprises a regulatory region operably linked to a nucleotide sequence encoding a polypeptide having 80 percent or greater sequence identity to an amino acid sequence selected from the group consisting of SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, and SEQ ID NO:1577. A plant and/or plant tissue produced from the plant cell has a difference in the level of low-nitrogen tolerance as compared to the corresponding level of low-nitrogen tolerance of a control plant that does not comprise the exogenous nucleic acid. In another aspect, the exogenous nucleic acid comprises a regulatory region operably linked to a nucleotide sequence having 80 percent or greater sequence identity to a nucleotide sequence selected from the group consisting of SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, and SEQ ID NO:1576, or a fragment thereof. A plant and/or plant tissue of a plant produced from the plant cell has a difference in the level of low-nitrogen tolerance as compared to the corresponding level of low-nitrogen tolerance of a control plant that does not comprise the exogenous nucleic acid. A transgenic plant comprising such a plant cell is also provided.

Isolated nucleic acids are also provided. In one aspect, an isolated nucleic acid comprises a nucleotide sequence having 80% or greater sequence identity to the nucleotide sequence set forth in SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, or SEQ ID NO:1576. In another aspect, an isolated nucleic acid comprises a nucleotide sequence encoding a polypeptide having 80% or greater sequence identity to the amino acid sequence set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, or SEQ ID NO:1577.

In another aspect, methods of identifying a genetic polymorphism associated with variation in the level of low-nitrogen tolerance are provided. The methods include providing a population of plants, and determining whether one or more genetic polymorphisms in the population are genetically linked to the locus for a polypeptide selected from the group consisting of the polypeptides depicted in FIGS. 1-57, SEQ ID NO:556, SEQ ID NO:853, SEQ ID NO:1157, and functional homologs thereof, such as those in the Sequence Listing. The correlation between variation in the level of low-nitrogen tolerance in a tissue in plants of the population and the presence of the one or more genetic polymorphisms in plants of the population is measured, thereby permitting identification of whether or not the one or more genetic polymorphisms are associated with such variation.

In another aspect, the invention provides a method of making a plant line, said method comprising:
  a) determining whether one or more genetic polymorphisms in a population of plants is associated with the locus for a polypeptide selected from the group consisting of the polypeptides depicted in FIGS. 1-57, SEQ ID NO: 556, SEQ ID NO: 853, and SEQ ID NO: 1157 and functional homologs thereof;
  b) identifying one or more plants in said population in which the presence of at least one allele at said one or more genetic polymorphisms is associated with variation in a trait;
  c) crossing each said one or more identified plants with itself or a different plant to produce seed;
  d) crossing at least one progeny plant grown from said seed with itself or a different plant; and
  e) repeating steps c) and d) for an additional 0-5 generations to make said plant line, wherein said at least one allele is present in said plant line.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 1 is an alignment of Ceres SEEDLINE No. ME00919 (SEQ ID NO:3) with homologous and/or orthologous amino acid sequences GI No. 5921925 (SEQ ID NO:4), CeresClone: 1929222 (SEQ ID NO:6), CeresAnnot: 1471370 (SEQ ID NO:10), GI No. 84380741 (SEQ ID NO:21), GI No. 5921926 (SEQ ID NO:22), GI No. 84514161 (SEQ ID NO:25), CeresClone: 779234 (SEQ ID NO:27), CeresClone: 1600726 (SEQ ID NO:29), GI No. 78183420 (SEQ ID NO:36), CeresClone: 1877346 (SEQ ID NO:38), GI No. 125562440 (SEQ ID NO:39), GI No. 115477665 (SEQ ID NO:40), GI No. 1173624 (SEQ ID NO:46), and GI No. 84468276 (SEQ ID NO:47). In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIG. 2 is an alignment of ME01312 (SEQ ID NO:49) with homologous and/or orthologous amino acid sequences CeresClone: 1869410 (SEQ ID NO:51), CeresAnnot: 1540549 (SEQ ID NO:53), CeresClone: 978708 (SEQ ID NO:58), CeresClone: 1623097 (SEQ ID NO:60), GI No. 92873064 (SEQ ID NO:63), GI No. 37051131 (SEQ ID NO:64), GI No. 3341468 (SEQ ID NO:65), CeresClone: 937560 (SEQ ID NO:67), CeresClone: 456844 (SEQ ID NO:69), GI No. 125564100 (SEQ ID NO:70), GI No. 52077334 (SEQ ID NO:71), GI No. 113205234 (SEQ ID NO:73), and CeresAnnot: 6100272 (SEQ ID NO:75).

FIG. 3 is an alignment of ME01463 (SEQ ID NO:77) with homologous and/or orthologous amino acid sequences GI No. 2811029 (SEQ ID NO:78), CeresClone: 1853284 (SEQ ID NO:80), CeresAnnot: 1476446 (SEQ ID NO:82), CeresClone: 527024 (SEQ ID NO:87), GI No. 27527063 (SEQ ID NO:88), CeresClone: 913632 (SEQ ID NO:90), CeresClone: 1386710 (SEQ ID NO:92), GI No. 115461885 (SEQ ID NO:93), and CeresAnnot: 6054519 (SEQ ID NO:95)

FIG. 4 is an alignment of ME01910 (SEQ ID NO:100) with homologous and/or orthologous amino acid sequences GI No. 585238 (SEQ ID NO:101), GI No. 90704789 (SEQ ID NO:102), CeresClone: 1895729 (SEQ ID NO:104), CeresAnnot: 1442808 (SEQ ID NO:108), CeresClone: 1104700 (SEQ ID NO:113), GI No. 32966575 (SEQ ID NO:116), GI No. 4996567 (SEQ ID NO:117), GI No. 62286644 (SEQ ID NO:118), GI No. 2623960 (SEQ ID NO:119), GI No. 585241 (SEQ ID NO:120), GI No. 790929 (SEQ ID NO:122), CeresClone: 579112 (SEQ ID NO:125), CeresClone: 244199 (SEQ ID NO:137), CeresClone: 1725848 (SEQ ID NO:144), GI No. 6474950 (SEQ ID NO:145), GI No. 125546057 (SEQ ID NO:146), GI No. 115455945 (SEQ ID NO:147), GI No. 2641211 (SEQ ID NO:149), and GI No. 30024108 (SEQ ID NO:150).

FIG. 5 is an alignment of ME02538 (SEQ ID NO:152) with homologous and/or orthologous amino acid sequences CeresClone: 1843642 (SEQ ID NO:154), CeresAnnot: 1459112 (SEQ ID NO:158), CeresClone: 953633 (SEQ ID NO:162), and CeresClone: 587957 (SEQ ID NO:164).

FIG. 6 is an alignment of ME02603 (SEQ ID NO:166) with homologous and/or orthologous amino acid sequences CeresClone: 1857256 (SEQ ID NO:168), CeresAnnot: 1442042 (SEQ ID NO:170), GI No. 89257469 (SEQ ID NO:174), CeresClone: 389818 (SEQ ID NO:177), CeresClone: 2019147 (SEQ ID NO:181), GI No. 125537720 (SEQ ID NO:182), GI No. 115443697 (SEQ ID NO:183), and GI No. 20340241 (SEQ ID NO:184).

FIG. 7 is an alignment of ME02613 (SEQ ID NO:186) with homologous and/or orthologous amino acid sequences CeresAnnot: 1490274 (SEQ ID NO:188), CeresClone: 873093 (SEQ ID NO:193), GI No. 6635384 (SEQ ID NO:194), CeresClone: 663726 (SEQ ID NO:196), GI No. 92881411 (SEQ ID NO:197), CeresClone: 686525 (SEQ ID NO:199), CeresClone: 1524364 (SEQ ID NO:201), CeresClone: 1742159 (SEQ ID NO:203), and GI No. 125543535 (SEQ ID NO:204).

FIG. 8 is an alignment of ME02801 (SEQ ID NO:208) with homologous and/or orthologous amino acid sequences CeresClone: 981621 (SEQ ID NO:214) and CeresClone: 564714 (SEQ ID NO:216).

FIG. 9 is an alignment of ME03123 (SEQ ID NO:218) with homologous and/or orthologous amino acid sequences CeresClone: 1899168 (SEQ ID NO:220), CeresAnnot: 1494669 (SEQ ID NO:222), CeresClone: 1017441 (SEQ ID NO:225), CeresClone: 1065937 (SEQ ID NO:227), CeresClone: 1822919 (SEQ ID NO:229), GI No. 125553329 (SEQ ID NO:230), GI No. 115439053 (SEQ ID NO:231), and CeresAnnot: 6040744 (SEQ ID NO:1052).

FIG. 10 is an alignment of ME04204 (SEQ ID NO:234) with homologous and/or orthologous amino acid sequences CeresAnnot: 1519952 (SEQ ID NO:236), CeresClone: 234768 (SEQ ID NO:241), GI No. 108707052 (SEQ ID NO:242), and GI No. 55978030 (SEQ ID NO:244).

FIG. 11 is an alignment of ME04477 (SEQ ID NO:246) with homologous and/or orthologous amino acid sequences CeresClone: 1620215 (SEQ ID NO:248), GI No. 38016527 (SEQ ID NO:249), CeresClone: 1798756 (SEQ ID NO:251), CeresAnnot: 1460527 (SEQ ID NO:255), GI No. 119720772 (SEQ ID NO:260), CeresClone: 708446 (SEQ ID NO:262), GI No. 92896423 (SEQ ID NO:265), GI No. 113196593 (SEQ ID NO:267), GI No. 75133829 (SEQ ID NO:268), CeresClone: 1030374 (SEQ ID NO:270), CeresClone: 1387149 (SEQ ID NO:274), GI No. 5031281 (SEQ ID NO:277), CeresClone: 1775820 (SEQ ID NO:279), GI No. 35187687 (SEQ ID NO:286), GI No. 115468934 (SEQ ID NO:290), GI No. 118424243 (SEQ ID NO:296), and CeresAnnot: 6063957 (SEQ ID NO:298).

FIG. 12 is an alignment of ME04507 (SEQ ID NO:300) with homologous and/or orthologous amino acid sequences CeresAnnot: 1513514 (SEQ ID NO:302), CeresClone: 923483 (SEQ ID NO:310), CeresClone: 304357 (SEQ ID NO:312), CeresClone: 1902716 (SEQ ID NO:316), GI No. 116309713 (SEQ ID NO:319), GI No. 38345408 (SEQ ID NO:321), and CeresAnnot: 6017635 (SEQ ID NO:325).

FIG. 13 is an alignment of ME04587 (SEQ ID NO:332) with homologous and/or orthologous amino acid sequences Ceres ANNOT ID no. 1474882 (SEQ ID NO:334), Ceres ANNOT ID no. 553243 (SEQ ID NO:338), Public GI ID no. 5514645 (SEQ ID NO:339), Ceres CLONE ID no. 464376 (SEQ ID NO:341), Public GI ID no. 1345643 (SEQ ID NO:346), Public GI ID no. 5832707 (SEQ ID NO:347), Public GI ID no. 81157968 (SEQ ID NO:348), Public GI ID no. 6118407 (SEQ ID NO:349), Public GI ID no. 5081817 (SEQ ID NO:351), Public GI ID no. 125556057 (SEQ ID NO:353), Public GI ID no. 115468946 (SEQ ID NO:354), Public GI ID no. 5915860 (SEQ ID NO:356), Public GI ID no. 6979544 (SEQ ID NO:358), Public GI ID no. 5832709 (SEQ ID NO:359), Public GI ID no. 6979542 (SEQ ID NO:360), Public GI ID no. 14278923 (SEQ ID NO:364), Public GI ID no. 81157970 (SEQ ID NO:365), Public GI ID no. 81157972 (SEQ ID NO:366), Public GI ID no. 169793907 (SEQ ID NO:2541), Public GI ID no. 84514153

(SEQ ID NO:2543), Public GI ID no. 184202209 (SEQ ID NO:2544), Ceres ANNOT ID no. 8459850 (SEQ ID NO:2546), Ceres ANNOT ID no. 8743452 (SEQ ID NO:2548), Public GI ID no. 157327290 (SEQ ID NO:2549), Public GI ID no. 148839039 (SEQ ID NO:2550), Public GI ID no. 197209782 (SEQ ID NO:2551), Public GI ID no. 171906244 (SEQ ID NO:2553).

FIG. 14 is an alignment of ME04753 (SEQ ID NO:368) with homologous and/or orthologous amino acid sequences GI No. 21388658 (SEQ ID NO:369), GI No. 4704605 (SEQ ID NO:371), GI No. 90704785 (SEQ ID NO:372), GI No. 115529229 (SEQ ID NO:373), GI No. 20152613 (SEQ ID NO:374), CeresClone: 1916226 (SEQ ID NO:376), CeresAnnot: 1460836 (SEQ ID NO:392), GI No. 83032218 (SEQ ID NO:420), GI No. 1346180 (SEQ ID NO:422), CeresClone: 621487 (SEQ ID NO:425), GI No. 6273331 (SEQ ID NO:433), GI No. 92874469 (SEQ ID NO:434), GI No. 1778374 (SEQ ID NO:436), GI No. 18076086 (SEQ ID NO:437), GI No. 2674201 (SEQ ID NO:438), GI No. 2267567 (SEQ ID NO:440), GI No. 544426 (SEQ ID NO:441), GI No. 6911144 (SEQ ID NO:444), GI No. 469071 (SEQ ID NO:447), GI No. 1934994 (SEQ ID NO:450), GI No. 82623423 (SEQ ID NO:451), GI No. 90265701 (SEQ ID NO:454), GI No. 544423 (SEQ ID NO:455), CeresClone: 1320097 (SEQ ID NO:458), CeresClone: 1469740 (SEQ ID NO:465), CeresClone: 1740834 (SEQ ID NO:473), GI No. 2226370 (SEQ ID NO:474), GI No. 27527723 (SEQ ID NO:475), CeresClone: 1762613 (SEQ ID NO:477), GI No. 125545195 (SEQ ID NO:488), GI No. 108710322 (SEQ ID NO:494), GI No. 34851124 (SEQ ID NO:504), GI No. 111162637 (SEQ ID NO:505), GI No. 7024451 (SEQ ID NO:506), and GI No. 1229138 (SEQ ID NO:507).

FIG. 15 is an alignment of ME04772 (SEQ ID NO:510) with homologous and/or orthologous amino acid sequences GI No. 38016521 (SEQ ID NO:511), CeresClone: 1895044 (SEQ ID NO:513), CeresAnnot: 1512198 (SEQ ID NO:517), CeresClone: 682503 (SEQ ID NO:521), CeresClone: 685324 (SEQ ID NO:523), CeresClone: 1384414 (SEQ ID NO:525), CeresClone: 1739919 (SEQ ID NO:527), CeresClone: 2002832 (SEQ ID NO:529), GI No. 125531563 (SEQ ID NO:530), and GI No. 115478344 (SEQ ID NO:531).

FIG. 16 is an alignment of ME04909 (SEQ ID NO:533) with homologous and/or orthologous amino acid sequences CeresClone: 1839156 (SEQ ID NO:535), GI No. 56605378 (SEQ ID NO:536), CeresAnnot: 1467946 (SEQ ID NO:538), GI No. 110931704 (SEQ ID NO:539), GI No. 92869601 (SEQ ID NO:542), GI No. 12005328 (SEQ ID NO:543), GI No. 119331596 (SEQ ID NO:546), GI No. 7705206 (SEQ ID NO:547), GI No. 18874263 (SEQ ID NO:548), CeresClone: 753605 (SEQ ID NO:550), CeresClone: 291733 (SEQ ID NO:552), and GI No. 21902114 (SEQ ID NO:553).

FIG. 17 is an alignment of ME05194 (SEQ ID NO:558) with homologous and/or orthologous amino acid sequences GI No. 400972 (SEQ ID NO:559), GI No. 81158002 (SEQ ID NO:560), CeresClone: 1834135 (SEQ ID NO:569), CeresAnnot: 1467218 (SEQ ID NO:571), CeresClone: 1104143 (SEQ ID NO:575), GI No. 87240745 (SEQ ID NO:576), GI No. 13161397 (SEQ ID NO:577), GI No. 18652400 (SEQ ID NO:578), GI No. 18652398 (SEQ ID NO:579), CeresClone: 778892 (SEQ ID NO:581), CeresClone: 222523 (SEQ ID NO:583), GI No. 82492267 (SEQ ID NO:584), GI No. 41393750 (SEQ ID NO:585), GI No. 4335857 (SEQ ID NO:586), CeresClone: 1776394 (SEQ ID NO:588), GI No. 125555681 (SEQ ID NO:589), GI No. 115468460 (SEQ ID NO:590), and GI No. 51980210 (SEQ ID NO:591).

FIG. 18 is an alignment of ME05267 (SEQ ID NO:593) with homologous and/or orthologous amino acid sequences CeresAnnot: 1511954 (SEQ ID NO:595), CeresClone: 560687 (SEQ ID NO:599), CeresClone: 579724 (SEQ ID NO:603), CeresClone: 286197 (SEQ ID NO:605), and GI No. 115489090 (SEQ ID NO:610).

FIG. 19 is an alignment of ME05300 (SEQ ID NO:613) with homologous and/or orthologous amino acid sequences CeresAnnot: 6431448 (SEQ ID NO:615), CeresClone: 969084 (SEQ ID NO:620), CeresClone: 471052 (SEQ ID NO:622), CeresClone: 733048 (SEQ ID NO:624), CeresClone: 1062332 (SEQ ID NO:626), CeresClone: 1743166 (SEQ ID NO:634), CeresClone: 1778589 (SEQ ID NO:638), GI No. 125548354 (SEQ ID NO:643), and GI No. 115458464 (SEQ ID NO:644).

FIG. 20 is an alignment of ME05341 (SEQ ID NO:646) with homologous and/or orthologous amino acid sequences CeresClone: 1808421 (SEQ ID NO:648), CeresAnnot: 1452653 (SEQ ID NO:656), CeresClone: 1660955 (SEQ ID NO:660), CeresClone: 1287179 (SEQ ID NO:668), CeresClone: 1770929 (SEQ ID NO:676), GI No. 125542421 (SEQ ID NO:679), GI No. 115450741 (SEQ ID NO:681), and CeresAnnot: 6063505 (SEQ ID NO:685).

FIG. 21 is an alignment of ME05392 (SEQ ID NO:687) with homologous and/or orthologous amino acid sequences CeresClone: 1841531 (SEQ ID NO:689), CeresAnnot: 1507382 (SEQ ID NO:691), CeresClone: 978410 (SEQ ID NO:699), CeresClone: 527314 (SEQ ID NO:703), GI No. 92893019 (SEQ ID NO:706), CeresClone: 638935 (SEQ ID NO:708), CeresClone: 1437744 (SEQ ID NO:712), CeresClone: 1728293 (SEQ ID NO:718), GI No. 125526460 (SEQ ID NO:721), GI No. 115463325 (SEQ ID NO:724), and GI No. 40642817 (SEQ ID NO:728).

FIG. 22 is an alignment of ME05429 (SEQ ID NO:730) with homologous and/or orthologous amino acid sequences CeresAnnot: 1539629 (SEQ ID NO:732), CeresClone: 682471 (SEQ ID NO:735), CeresClone: 729869 (SEQ ID NO:737), GI No. 115459766 (SEQ ID NO:738), and CeresAnnot: 6026765 (SEQ ID NO:742).

FIG. 23 is an alignment of ME05493 (SEQ ID NO:746) with homologous and/or orthologous amino acid sequences CeresAnnot: 1455092 (SEQ ID NO:748), GI No. 15229284 (SEQ ID NO:751), CeresClone: 961796 (SEQ ID NO:753), CeresClone: 706956 (SEQ ID NO:755), GI No. 87162911 (SEQ ID NO:758), CeresClone: 1061446 (SEQ ID NO:760), GI No. 125540686 (SEQ ID NO:761), GI No. 115447931 (SEQ ID NO:762), GI No. 20152976 (SEQ ID NO:763), and CeresAnnot: 6007280 (SEQ ID NO:765).

FIG. 24 is an alignment of ME05885 (SEQ ID NO:769) with homologous and/or orthologous amino acid sequences CeresClone: 1808741 (SEQ ID NO:771), CeresAnnot: 1437729 (SEQ ID NO:773), CeresClone: 952789 (SEQ ID NO:777), CeresClone: 724313 (SEQ ID NO:779), CeresClone: 791239 (SEQ ID NO:783), CeresClone: 208975 (SEQ ID NO:785), CeresClone: 1727075 (SEQ ID NO:789), and GI No. 115475611 (SEQ ID NO:790).

FIG. 25 is an alignment of ME07344 (SEQ ID NO:792) with homologous and/or orthologous amino acid sequences CeresClone: 1843695 (SEQ ID NO:794), GI No. 56605376 (SEQ ID NO:799), CeresAnnot: 1508502 (SEQ ID NO:801), CeresClone: 1239229 (SEQ ID NO:805), GI No. 92893962 (SEQ ID NO:808), CeresClone: 327364 (SEQ ID NO:810), CeresClone: 1820378 (SEQ ID NO:816), GI No. 125524748 (SEQ ID NO:819), and GI No. 115435036 (SEQ ID NO:821).

FIG. 26 is an alignment of ME07859 (SEQ ID NO:824) with homologous amino acid sequence Fragment_of_Ceres ANNOT ID no. 6007357 (SEQ ID NO:826), Fragment_of_Ceres CLONE ID no. 771707 (SEQ ID NO:1708), and Fragment_of_Ceres CLONE ID no. 1790436 (SEQ ID NO:1713).

FIG. 27 is an alignment of ME08464 (SEQ ID NO:828) with homologous and/or orthologous amino acid sequences CeresAnnot: 1499777 (SEQ ID NO:832), GI No. 22328730 (SEQ ID NO:837), GI No. 92886131 (SEQ ID NO:839), GI No. 559921 (SEQ ID NO:840), CeresClone: 910787 (SEQ ID NO:842), CeresClone: 1797432 (SEQ ID NO:844), GI No. 116310135 (SEQ ID NO:845), GI No. 38345464 (SEQ ID NO:847), and GI No. 90657544 (SEQ ID NO:850).

FIG. 28 is an alignment of ME11735 (SEQ ID NO:855) with homologous and/or orthologous amino acid sequences GI No. 35187445 (SEQ ID NO:856), CeresClone: 1798230 (SEQ ID NO:858), CeresAnnot: 1500963 (SEQ ID NO:862), CeresClone: 567542 (SEQ ID NO:868), CeresClone: 702251 (SEQ ID NO:870), CeresClone: 1606777 (SEQ ID NO:876), CeresClone: 1789146 (SEQ ID NO:878), GI No. 116309500 (SEQ ID NO:885), and GI No. 115446281 (SEQ ID NO:886).

FIG. 29 is an alignment of ME12910 (SEQ ID NO:891) with homologous and/or orthologous amino acid sequences CeresAnnot: 1466353 (SEQ ID NO:893), CeresClone: 519143 (SEQ ID NO:898), GI No. 2501497 (SEQ ID NO:901), GI No. 119394507 (SEQ ID NO:904), GI No. 62857206 (SEQ ID NO:905), CeresClone: 766529 (SEQ ID NO:907), GI No. 62857204 (SEQ ID NO:908), GI No. 125534279 (SEQ ID NO:911), GI No. 115485437 (SEQ ID NO:912), GI No. 23955910 (SEQ ID NO:913), and GI No. 22759895 (SEQ ID NO:915).

FIG. 30 is an alignment of ME12927 (SEQ ID NO:917) with homologous and/or orthologous amino acid sequences CeresAnnot: 1503548 (SEQ ID NO:919), CeresClone: 37778 (SEQ ID NO:921), CeresClone: 681297 (SEQ ID NO:923), CeresClone: 575835 (SEQ ID NO:925), CeresClone: 1714750 (SEQ ID NO:935), CeresClone: 1721907 (SEQ ID NO:937), and GI No. 115451923 (SEQ ID NO:940).

FIG. 31 is an alignment of ME12929 (SEQ ID NO:944) with homologous and/or orthologous amino acid sequences CeresAnnot: 1447562 (SEQ ID NO:946), GI No. 98962139 (SEQ ID NO:947), CeresClone: 641607 (SEQ ID NO:950), CeresClone: 1715150 (SEQ ID NO:962), CeresClone: 1873767 (SEQ ID NO:964), GI No. 115468306 (SEQ ID NO:967), and CeresAnnot: 6059980 (SEQ ID NO:972).

FIG. 32 is an alignment of ME12954 (SEQ ID NO:976) with homologous and/or orthologous amino acid sequences CeresClone: 957229 (SEQ ID NO:978) and CeresAnnot: 1496202 (SEQ ID NO:980).

FIG. 33 is an alignment of ME12970 (SEQ ID NO:982) with homologous and/or orthologous amino acid sequences CeresClone: 1935438 (SEQ ID NO:984), GI No. 117573664 (SEQ ID NO:985), GI No. 68349002 (SEQ ID NO:991), GI No. 68348998 (SEQ ID NO:992), CeresAnnot: 1497170 (SEQ ID NO:995), GI No. 15221718 (SEQ ID NO:996), GI No. 3860331 (SEQ ID NO:1001), CeresClone: 1075911 (SEQ ID NO:1003), GI No. 2920839 (SEQ ID NO:1008), CeresClone: 698452 (SEQ ID NO:1011), CeresClone: 2019456 (SEQ ID NO:1023), GI No. 90399071 (SEQ ID NO:1026), GI No. 115459588 (SEQ ID NO:1028), and GI No. 68349016 (SEQ ID NO:1032).

FIG. 34 is an alignment of ME13021 (SEQ ID NO:1054) with homologous and/or orthologous amino acid sequences GI No. 2493647 (SEQ ID NO:1055), CeresClone: 1924252 (SEQ ID NO:1057), GI No. 461736 (SEQ ID NO:1058), CeresAnnot: 1542060 (SEQ ID NO:1061), GI No. 15226314 (SEQ ID NO:1068), GI No. 464727 (SEQ ID NO:1072), CeresClone: 480644 (SEQ ID NO:1074), GI No. 124301264 (SEQ ID NO:1075), GI No. 1710807 (SEQ ID NO:1076), GI No. 110349923 (SEQ ID NO:1077), GI No. 1762130 (SEQ ID NO:1078), CeresClone: 706098 (SEQ ID NO:1080), GI No. 3790441 (SEQ ID NO:1083), CeresClone: 1795282 (SEQ ID NO:1085), GI No. 125546535 (SEQ ID NO:1086), GI No. 115488160 (SEQ ID NO:1088), GI No. 84468456 (SEQ ID NO:1092), GI No. 116060917 (SEQ ID NO:1095), and CeresAnnot: 6039555 (SEQ ID NO:1097).

FIG. 35 is an alignment of ME13064 (SEQ ID NO:1099) with homologous and/or orthologous amino acid sequences CeresAnnot: 1528508 (SEQ ID NO:1101), CeresClone: 9248 (SEQ ID NO:1103), GI No. 87240560 (SEQ ID NO:1105), GI No. 19453 (SEQ ID NO:1106), CeresClone: 1795329 (SEQ ID NO:1108), and GI No. 108862979 (SEQ ID NO:1109).

FIG. 36 is an alignment of ME13071 (SEQ ID NO:1112) with homologous and/or orthologous amino acid sequences GI No. 125541485 (SEQ ID NO:1113), and GI No. 115449245 (SEQ ID NO:1114).

FIG. 37 is an alignment of ME13087 (SEQ ID NO:1116) with homologous and/or orthologous amino acid sequences CeresClone: 100062822 (SEQ ID NO:1118), CeresAnnot: 1440025 (SEQ ID NO:1120), GI No. 15238538 (SEQ ID NO:1123), GI No. 69111473 (SEQ ID NO:1129), GI No. 92873711 (SEQ ID NO:1132), GI No. 55734106 (SEQ ID NO:1133), GI No. 2346974 (SEQ ID NO:1134), CeresClone: 569852 (SEQ ID NO:1136), CeresClone: 1715326 (SEQ ID NO:1138), CeresClone: 1608104 (SEQ ID NO:1140), GI No. 115456237 (SEQ ID NO:1141), GI No. 68655289 (SEQ ID NO:1143), GI No. 81022807 (SEQ ID NO:1144), GI No. 75706704 (SEQ ID NO:1145), and CeresAnnot: 6016055 (SEQ ID NO:1147).

FIG. 38 is an alignment of ME13107 (SEQ ID NO:1159) with homologous and/or orthologous amino acid sequences CeresClone: 1371824 (SEQ ID NO:1161), GI No. 22585 (SEQ ID NO:1162), GI No. 22208482 (SEQ ID NO:1163), and GI No. 16073 (SEQ ID NO:1164).

FIG. 39 is an alignment of ME13108 (SEQ ID NO:1166) with homologous and/or orthologous amino acid sequences GI No. 99109436 (SEQ ID NO:1167), CeresClone: 1627939 (SEQ ID NO:1169), CeresClone: 1840433 (SEQ ID NO:1171), CeresAnnot: 1524198 (SEQ ID NO:1173), CeresClone: 1650 (SEQ ID NO:1175), CeresClone: 691979 (SEQ ID NO:1177), GI No. 92876897 (SEQ ID NO:1180), CeresClone: 1774130 (SEQ ID NO:1182), and GI No. 115450018 (SEQ ID NO:1183).

FIG. 40 is an alignment of ME13110 (SEQ ID NO:1185) with homologous and/or orthologous amino acid sequences CeresClone: 737317 (SEQ ID NO:1187), CeresClone: 1880853 (SEQ ID NO:1189), GI No. 125558381 (SEQ ID NO:1190), and GI No. 115472157 (SEQ ID NO:1191).

FIG. 41 is an alignment of ME13125 (SEQ ID NO:1194) with homologous and/or orthologous amino acid sequences CeresClone: 1938817 (SEQ ID NO:1196), CeresAnnot: 1457245 (SEQ ID NO:1200), CeresClone: 577910 (SEQ ID NO:1202), Public PUBLICCLONE ID no. 100736184 (SEQ ID NO:1203), GI No. 125553355 (SEQ ID NO:1204), and GI No. 5091600 (SEQ ID NO:1205).

FIG. 42 is an alignment of ME13149 (SEQ ID NO:1210) with homologous and/or orthologous amino acid sequences GI No. 1703374 (SEQ ID NO:1211), CeresClone: 1846330 (SEQ ID NO:1213), GI No. 29124979 (SEQ ID NO:1216), CeresAnnot: 1531725 (SEQ ID NO:1218), GI No. 3334321 (SEQ ID NO:1229), CeresClone: 571410 (SEQ ID NO:1232), GI No. 39653273 (SEQ ID NO:1233), GI No. 92875403 (SEQ ID NO:1234), GI No. 11131026 (SEQ ID NO:1235), GI No. 77812440 (SEQ ID NO:1236), GI No. 89475524 (SEQ ID NO:1238), GI No. 3182919 (SEQ ID NO:1239), GI No. 7643794 (SEQ ID NO:1240), GI No. 1710851 (SEQ ID NO:1241), GI No. 115501471 (SEQ ID NO:1242), GI No. 77999251 (SEQ ID NO:1243), GI No. 3450893 (SEQ ID NO:1249), CeresClone: 704589 (SEQ ID NO:1251), CeresClone: 1384151 (SEQ ID NO:1253), CeresClone: 1713894 (SEQ ID NO:1259), GI No. 125560752 (SEQ ID NO:1264), GI No. 115475543 (SEQ ID NO:1265), GI No. 3182922 (SEQ ID NO:1267), GI No. 145353078 (SEQ ID NO:1268), GI No. 11131023 (SEQ ID NO:1269), GI No. 47026845 (SEQ ID NO:1270), and GI No. 38353642 (SEQ ID NO:1272).

FIG. 43 is an alignment of ME13151 (SEQ ID NO:1274) with homologous and/or orthologous amino acid sequences CeresClone: 1884601 (SEQ ID NO:1276), CeresAnnot: 1445717 (SEQ ID NO:1280), CeresClone: 527903 (SEQ ID NO:1284), GI No. 92891722 (SEQ ID NO:1285), CeresClone: 790881 (SEQ ID NO:1287), CeresClone: 299417 (SEQ ID NO:1289), CeresClone: 1993894 (SEQ ID NO:1291), GI No. 125539547 (SEQ ID NO:1294), GI No. 48716424 (SEQ ID NO:1295), GI No. 84468278 (SEQ ID NO:1297), and CeresAnnot: 6036303 (SEQ ID NO:1300).

FIG. 44 is an alignment of ME13153 (SEQ ID NO:1302) with homologous and/or orthologous amino acid sequences GI No. 70609690 (SEQ ID NO:1303), CeresClone: 1927524 (SEQ ID NO:1305), CeresAnnot: 1467310 (SEQ ID NO:1311), GI No. 45935270 (SEQ ID NO:1313), CeresClone: 718446 (SEQ ID NO:1317), GI No. 92875133 (SEQ ID NO:1318), GI No. 1706318 (SEQ ID NO:1319), GI No. 3252856 (SEQ ID NO:1320), GI No. 1169238 (SEQ ID NO:1326), GI No. 31296711 (SEQ ID NO:1327), CeresClone: 1468893 (SEQ ID NO:1330), GI No. 51587340 (SEQ ID NO:1331), CeresClone: 1796201 (SEQ ID NO:1333), GI No. 125543034 (SEQ ID NO:1334), GI No. 115476804 (SEQ ID NO:1336), GI No. 75268060 (SEQ ID NO:1339), and GI No. 75268007 (SEQ ID NO:1340).

FIG. 45 is an alignment of ME13177 (SEQ ID NO:1342) with homologous and/or orthologous amino acid sequences CeresAnnot: 1443786 (SEQ ID NO:1346), GI No. 15239172 (SEQ ID NO:1355), GI No. 562190 (SEQ ID NO:1363), GI No. 83032266 (SEQ ID NO:1364), CeresClone: 602910 (SEQ ID NO:1366), GI No. 7242793 (SEQ ID NO:1370), GI No. 116167 (SEQ ID NO:1371), GI No. 2190259 (SEQ ID NO:1372), GI No. 5420278 (SEQ ID NO:1373), GI No. 1064931 (SEQ ID NO:1374), GI No. 6093215 (SEQ ID NO:1377), GI No. 461726 (SEQ ID NO:1378), GI No. 89111295 (SEQ ID NO:1379), GI No. 82949283 (SEQ ID NO:1380), GI No. 125537180 (SEQ ID NO:1381), GI No. 115489300 (SEQ ID NO:1382), and GI No. 55978000 (SEQ ID NO:1383).

FIG. 46 is an alignment of ME13200 (SEQ ID NO:1385) with homologous and/or orthologous amino acid sequences CeresAnnot: 1503394 (SEQ ID NO:1387), GI No. 4914437 (SEQ ID NO:1390), CeresClone: 638126 (SEQ ID NO:1393), GI No. 124360540 (SEQ ID NO:1394), GI No. 7981380 (SEQ ID NO:1395), GI No. 118137433 (SEQ ID NO:1396), CeresClone: 1723374 (SEQ ID NO:1398), CeresClone: 1785379 (SEQ ID NO:1400), GI No. 125553354 (SEQ ID NO:1401), GI No. 115471859 (SEQ ID NO:1404), and CeresAnnot: 6040771 (SEQ ID NO:1407).

FIG. 47 is an alignment of ME13204 (SEQ ID NO:1409) with homologous and/or orthologous amino acid sequences CeresClone: 1939206 (SEQ ID NO:1413), CeresAnnot: 1453316 (SEQ ID NO:1415), GI No. 79319075 (SEQ ID NO:1418), GI No. 124359953 (SEQ ID NO:1419), CeresClone: 891431 (SEQ ID NO:1421), GI No. 125536578 (SEQ ID NO:1424), and GI No. 20270065 (SEQ ID NO:1425).

FIG. 48 is an alignment of ME14649 (SEQ ID NO:1428) with homologous and/or orthologous amino acid sequences CeresClone: 1978733 (SEQ ID NO:1430), CeresAnnot: 1476165 (SEQ ID NO:1432), CeresClone: 871529 (SEQ ID NO:1436), CeresClone: 1043344 (SEQ ID NO:1439), CeresClone: 786542 (SEQ ID NO:1442), CeresClone: 346115 (SEQ ID NO:1444), CeresClone: 1821683 (SEQ ID NO:1452), GI No. 125533171 (SEQ ID NO:1453), and GI No. 77553492 (SEQ ID NO:1457)

FIG. 49 is an alignment of ME16546 (SEQ ID NO:1463) with homologous and/or orthologous amino acid sequences CeresAnnot: 1444102 (SEQ ID NO:1465), CeresClone: 582439 (SEQ ID NO:1471), CeresClone: 579953 (SEQ ID NO:1473), GI No. 125539335 (SEQ ID NO:1474), and GI No. 115445987 (SEQ ID NO:1476).

FIG. 50 is an alignment of ME17567 (SEQ ID NO:1491) with homologous and/or orthologous amino acid sequences CeresClone: 1895876 (SEQ ID NO:1493), CeresAnnot: 1464522 (SEQ ID NO:1495), CeresClone: 968434 (SEQ ID NO:1499), CeresClone: 686479 (SEQ ID NO:1501), CeresClone: 1564962 (SEQ ID NO:1503), GI No. 125549699 (SEQ ID NO:1504), GI No. 125591612 (SEQ ID NO:1505), and CeresAnnot: 6006969 (SEQ ID NO:1508).

FIG. 51 is an alignment of ME17932 (SEQ ID NO:1510) with homologous and/or orthologous amino acid sequences CeresClone: 1842178 (SEQ ID NO:1512), CeresAnnot: 1475265 (SEQ ID NO:1516) and CeresClone: 1044646 (SEQ ID NO:1520).

FIG. 52 is an alignment of ME17936 (SEQ ID NO:1525) with homologous and/or orthologous amino acid sequences CeresAnnot: 1454324 (SEQ ID NO:1527), CeresClone: 1652842 (SEQ ID NO:1534), and GI No. 75214620 (SEQ ID NO:1535).

FIG. 53 is an alignment of ME18275 (SEQ ID NO:1537) with homologous and/or orthologous amino acid sequences CeresAnnot: 1514086 (SEQ ID NO:1539), CeresClone: 1087909 (SEQ ID NO:1543), CeresClone: 1359070 (SEQ ID NO:1545), GI No. 92880913 (SEQ ID NO:1548), CeresClone: 932449 (SEQ ID NO:1550), and CeresClone: 1788695 (SEQ ID NO:1552).

FIG. 54 is an alignment of ME18924 (SEQ ID NO:1554) with homologous and/or orthologous amino acid sequences GI No. 82469976 (SEQ ID NO:1555), CeresAnnot: 1533704 (SEQ ID NO:1563), CeresClone: 524404 (SEQ ID NO:1565), CeresClone: 846541 (SEQ ID NO:1567), CeresClone: 1769321 (SEQ ID NO:1571), GI No. 125528559 (SEQ ID NO:1572), GI No. 125572823 (SEQ ID NO:1574), and GI No. 84453208 (SEQ ID NO:1575).

FIG. 55 is an alignment of ME19182 (SEQ ID NO:1577) with homologous and/or orthologous amino acid sequences GI No. 4033417 (SEQ ID NO:1040), GI No. 5669924 (SEQ ID NO:1041), GI No. 40642617 (SEQ ID NO:1440), GI No. 90399018 (SEQ ID NO:1485), GI No. 115464117 (SEQ ID NO:1487), GI No. 75164812 (SEQ ID NO:1578), CeresClone: 1794223 (SEQ ID NO:1580), CeresAnnot: 1471422 (SEQ ID NO:1590), CeresClone: 968096 (SEQ ID NO:1607), GI No. 6752884 (SEQ ID NO:1608), GI No. 47775656 (SEQ ID NO:1609), CeresClone: 1020799 (SEQ ID NO:1611), GI No. 87240865 (SEQ ID NO:1622), GI No. 2500047 (SEQ ID NO:1623), CeresClone: 705340 (SEQ ID NO:1627), CeresClone: 1430456 (SEQ ID NO:1637), GI No. 84619270 (SEQ ID NO:1648), and CeresClone: 1821143 (SEQ ID NO:1651).

FIG. 56 is an alignment of ME20628 (SEQ ID NO:1437) with homologous and/or orthologous amino acid sequences GI No. 113367236 (SEQ ID NO:173), GI No. 115477615 (SEQ ID NO:212), GI No. 125542223 (SEQ ID NO:361), GI No. 1838976 (SEQ ID NO:421), CeresClone: 1547185 (SEQ ID NO:443), CeresAnnot: 1450452 (SEQ ID NO:740), and GI No. 92870675 (SEQ ID NO:1461).

FIG. 57 is an alignment of ME01821 (SEQ ID NO:97) with homologous and/or orthologous amino acid sequences Public GI ID no. 167480754 (SEQ ID NO:2013) and Public GI ID no. 83830869 (SEQ ID NO:2015).

DETAILED DESCRIPTION

The invention provides methods and materials related to modulating low-nitrogen tolerance levels in plants. In some embodiments, the plants may also have modulated levels of low-nitrogen tolerance. The methods can include transforming a plant cell with a nucleic acid encoding a low nitrogen tolerance-modulating polypeptide, wherein expression of the polypeptide results in a modulated level of low-nitrogen tolerance. Plant cells produced using such methods can be grown to produce plants having an increased tolerance to conditions with limiting exogenous nitrogen sources. Such plants can be used for the production of higher yields and biomasses with existing fertilizer inputs, and/or enable existing yields and biomass of crops to be obtained with lower fertilizer input, or better yields and biomasses on soils of poorer quality.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Low Nitrogen Conditions" as used herein refers to nitrogen concentrations which lead to nitrogen deficiency symptoms such as pale green leaf color, chlorosis and reduced growth and vigor. Typically, low nitrogen conditions lead to a reduction of at least 20%, 25%, 30%, 35%, 40%, 45%, 50%, 60%, 70%, 80% or 90% in growth and/or vigor.

"Modulation" of the level of low-nitrogen tolerance refers to the change in the level of tolerance of a plant to limiting exogenous nitrogen sources that is observed as a result of expression of, or transcription from, an exogenous nucleic acid in a plant cell. The change in low-nitrogen tolerance level is measured by changes in plant size and greenness as well as greater photosynthesis efficiency, relative to the corresponding level in control plants in an environment with limiting nitrogen supply.

"Nucleic acid" and "polynucleotide" are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line.

Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al. (1989) *The Plant Cell*, 1:977-984.

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include low nitrogen tolerance-modulating polypeptides. Low nitrogen tolerance-modulating polypeptides can be effective to modulate low-nitrogen tolerance levels when expressed in a plant or plant cell. Such polypeptides typically contain at least one domain indicative of low nitrogen tolerance-modulating polypeptides, as described in more detail herein. Low nitrogen tolerance-modulating polypeptides typically have an HMM bit score that is greater than 20, as described in more detail herein. In some embodiments, low nitrogen tolerance-modulating polypeptides have greater than 80% identity to SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, or SEQ ID NO:1577, as described in more detail herein.

A. Domains Indicative of Low Nitrogen Tolerance-Modulating Polypeptides

A low nitrogen tolerance-modulating polypeptide can contain a P450 domain, which is characteristic of polypeptides belonging to the Cytochrome P450 superfamily. Cytochrome P450s are haem-thiolate proteins involved in the oxidative degradation of various compounds. They are particularly well known for their role in the degradation of environmental toxins and mutagens. In plants, these proteins are important for the biosynthesis of several compounds such as hormones, defensive compounds and fatty acids. Sequence conservation is relatively low within the family—there are only 3 absolutely conserved residues—but their general topography and structural fold are highly conserved. The conserved core is composed of a coil termed the 'meander', a four-helix bundle, helices J and K, and two sets of beta-sheets. These constitute the haem-binding loop, the proton-transfer groove and the conserved EXXR motif in helix K. While prokaryotic P450s are soluble proteins, most eukaryotic P450s are associated with microsomal membranes. Their general enzymatic function is to catalyse regiospecific and stereospecific oxidation of non-activated hydrocarbons at physiological temperatures. SEQ ID NO:3 and SEQ ID NO:332 set forth the amino acid sequence of *Arabidopsis* clones, identified herein as ME00919 (SEQ ID NO:3) and ME04587 (SEQ ID NO:332) respectively, that are predicted to encode polypeptides containing a Cytochrome P450 domain.

A low nitrogen tolerance-modulating polypeptide can contain a zf-Dof domain, which is conserved in several DNA-binding proteins of higher plants. Dof domain is a zinc finger DNA-binding domain that shows resemblance to the Cys2 zinc finger, although it has a longer putative loop where an extra Cys residue is typically conserved. The motif is also present in SEQ ID NO:49, which sets forth the amino acid sequence of an *Arabidopsis* clone, identified herein as Ceres ME01312 (SEQ ID NO:49), that is predicted to encode a polypeptide containing a zf-Dof domain.

A low nitrogen tolerance-modulating polypeptide can contain an Aminotran_3 domain characteristic of polypeptides belonging to the aminotransferase Class-III family. Aminotransferases share certain mechanistic features with other pyridoxalphosphate-dependent enzymes, such as the covalent binding of the pyridoxalphosphate group to a lysine residue. Class-III aminotransferases include acetylornithine aminotransferase, which catalyzes the transfer of an amino group from acetylornithine to alpha-ketoglutarate, yielding N-acetyl-glutamic-5-semi-aldehyde and glutamic acid; ornithine aminotransferase, which catalyzes the transfer of an amino group from ornithine to alpha-ketoglutarate, yielding glutamic-5-semi-aldehyde and glutamic acid; omega-amino acid—pyruvate aminotransferase, which catalyzes transamination between a variety of omega-amino acids, mono- and diamines, and pyruvate; 4-aminobutyrate aminotransferase; GABA transaminase, which catalyzes the transfer of an amino group from GABA to alpha-ketoglutarate, yielding succinate semialdehyde and glutamic acid; DAPA aminotransferase, a bacterial enzyme (bioA), which catalyzes an intermediate step in the biosynthesis of biotin, the transamination of 7-keto-8-aminopelargonic acid to form 7,8-diaminopelargonic acid; 2,2-dialkylglycine decarboxylase, a *Burkholderia cepacia* (*Pseudomonas cepacia*) enzyme (dgdA) that catalyzes the decarboxylating amino transfer of 2,2-dialkylglycine and pyruvate to dialkyl ketone, alanine and carbon dioxide; glutamate-1-semialdehyde aminotransferase (GSA); *Bacillus subtilis* aminotransferases yhxA and yodT; *Haemophilus influenzae* aminotransferase HI0949; and *Caenorhabditis elegans* aminotransferase. On the basis of sequence similarity, these various enzymes can be grouped into subfamilies. The aminotran_3 domain is also present in SEQ ID NO:77, which set forth the amino acid sequences of *Arabidopsis* clone, identified herein as Ceres ME01463 (SEQ ID NO:77), that is predicted to encode polypeptides containing an aminotran_3 domain.

A low nitrogen tolerance-modulating polypeptide can contain a linker histone domain characteristic of polypeptides belonging to the linker histone H1 and H5 family. Linker histone H1 is an essential component of chromatin structure. H1 links nucleosomes into higher order structures. Histone H5 performs the same function as histone H1, and replaces H1 in certain cells. The structure of GH5, the globular domain of the linker histone H5 fold is similar to the DNA-binding domain of the catabolite gene activator protein, CAP, thus providing a possible model for the binding of GH5 to DNA. The domain is also present in SEQ ID NO:100, which sets forth the amino acid sequence of an *Arabidopsis* clone, identified herein as Ceres ME01910 (SEQ ID NO:100), that is predicted to encode a polypeptide containing a linker histone domain.

A low nitrogen tolerance-modulating polypeptide can contain a zf-C3HC4 domain, which is predicted to be characteristic of proteins belonging to the C3HC4 type zinc-finger (RING finger) protein family. The C3HC4 type zinc-finger (RING finger) is a cysteine-rich domain of approximately 40 to 60 residues that coordinates two zinc ions, and is probably involved in mediating protein-protein interactions. Members of the C3HC4 type zinc-finger (RING finger) protein family contain the loosely conserved sequence: C-X2-C-X(9-39)-C-X(1-3)-H-X(2-3)-C-X2-C-X(4-48)-C-X2-C where X is any amino acid. The domain is also present in SEQ ID NOs:166, 746, 976, 1428, which set forth the amino acid sequences of *Arabidopsis* clones, identified herein as Ceres ME02603 (SEQ ID NO:166), ME05493 (SEQ ID NO:746), ME12954 (SEQ ID NO:976), ME14649 (SEQ ID NO:1428) respectively, that are predicted to encode polypeptides containing a zf-C3HC4 domain.

A low nitrogen tolerance-modulating polypeptide can contain a Gal_Lectin domain characteristic of a galactose binding lectin domain protein. SEQ ID NO:208 sets forth the amino acid sequence of an *Arabidopsis* clone, identified herein as Ceres ME02801 (SEQ ID NO:208), that is predicted to encode a polypeptide containing a galactose binding lectin domain.

A low nitrogen tolerance-modulating polypeptide can contain a TRP_1 domain characteristic of tetratricopeptide repeat (TPR) domain protein. The tetratricopeptide repeat is a structural motif present in a wide range of proteins identified in various different organisms, ranging from bacteria to humans. It mediates protein-protein interactions and the assembly of multiprotein complexes. Sequence alignment of the TPR domains reveals a consensus sequence defined by a pattern of small and large amino acids. Proteins containing TPRs are involved in a variety of biological processes, such as cell cycle regulation, transcriptional control, mitochondrial and peroxisomal protein transport, neurogenesis and protein folding. The X-ray structure of a domain containing three TPRs from protein phosphatase 5 revealed that TPR adopts a helixturnhelix arrangement, with adjacent TPR motifs packing in a parallel fashion, resulting in a spiral of repeating anti-parallel alpha-helices. The two helices are denoted helix A and helix B. The packing angle between helix A and helix B is −24° within a single TPR and generates a right-handed superhelical shape. Helix A interacts with helix B and with helix A' of the next TPR. Two protein surfaces are generated: the inner concave surface is contributed to mainly by residue on helices A, and the other surface presents residues from both helices A and B.

A low nitrogen tolerance-modulating polypeptide can contain a TRP_2 tetratricopeptide repeat domain, which is predicted to be characteristic of scaffold-proteins in multiprotein complexes. The TPR_2 domain consists of approximately 34-amino-acid motif with a loose consensus and is present, usually as multiple tandem repeats, in proteins with many cellular functions, including mitosis, transcription, protein transport, and development. Structural analysis of the TPR-2 domain demonstrates that it forms two α-helical regions separated by a turn, such that apposed bulky and small side chains form a "knob and hole" structure. In general, the hydrophobic surface of this structure mediates protein-protein interactions between TPR- and non-TPR-containing proteins.

SEQ ID NO:234 sets forth the amino acid sequence of *Arabidopsis* clone, identified herein as Ceres ME04204 (SEQ ID NO:234), that is predicted to encode a polypeptide containing a TRP_1 tetratricopeptide repeat domain and a TRP_2 tetratricopeptide repeat domain. SEQ ID NO:1510 sets forth the amino acid sequence of *Arabidopsis* clone, identified herein as Ceres ME17932 (SEQ ID NO:1510), that is predicted to encode a polypeptide containing a TRP_2 tetratricopeptide repeat domain.

A low nitrogen tolerance-modulating polypeptide can contain a zf-AN1 domain characteristic of polypeptides belonging to the AN1-like Zinc finger domain protein family. The AN1-like Zinc finger domain was first identified as a zinc finger at the C-terminus of An1 a ubiquitin-like protein in *Xenopus laevis*. The following pattern describes the zinc finger: C-X2-C-X(9-12)-C-X(1-2)-C-X4-C-X2-H-X5-H-X-C, where X can be any amino acid, and numbers in brackets indicate the number of residues.

A low nitrogen tolerance-modulating polypeptide can contain a zf-A20 domain, which is characteristic of A20- (an inhibitor of cell death)-like zinc fingers. In animals, A20-like zinc fingers are believed to mediate self-association in A20. These fingers also mediate IL-1-induced NF-kappa B activation. SEQ ID NO: 246 sets forth the amino acid sequence of Arabidopsis clone, identified herein as Ceres ME04477 (SEQ ID NO:246), that is predicted to encode a polypeptide containing an AN1-like Zinc finger domain and zf-A20 domain.

A low nitrogen tolerance-modulating polypeptide can contain an Aa_trans domain, or transmembrane amino acid transporter domain, which is predicted to be characteristic of amino acid transporters and amino acid permeases. The domain is also present in SEQ ID NO:300, which sets forth the amino acid sequence of an Arabidopsis clone, identified herein as Ceres ME04507 (SEQ ID NO:300), that is predicted to encode a polypeptide containing an transmembrane amino acid transporter domain.

A low nitrogen tolerance-modulating polypeptide can contain an RNA recognition motif (as known as RRM_1, RRM, RBD, or RNP domain), which is characteristic of polypeptides belonging to the single strand RNA-binding protein superfamily. RRM proteins have a variety of RNA binding preferences and functions, and include heterogeneous nuclear ribonucleoproteins (hnRNPs), proteins implicated in regulation of alternative splicing, protein components of small nuclear ribonucleoproteins, and proteins that regulate RNA stability and translation. The RRM in heterodimeric splicing factor U2 snRNP auxiliary factor (U2AF) appears to have two RRM-like domains with specialized features for protein recognition. The motif also appears in a few single stranded DNA binding proteins. The typical RRM consists of four anti-parallel beta-strands and two alpha-helices arranged in a beta-alpha-beta-beta-alpha-beta fold with side chains that stack with RNA bases. Specificity of RNA binding is determined by multiple contacts with surrounding amino acids. A third helix is present during RNA binding in some cases. The motif is also present in SEQ ID NO:368 and SEQ ID NO:1274, which set forth the amino acid sequences of Arabidopsis clones, identified herein as Ceres ME04753 (SEQ ID NO:368) and ME13151 (SEQ ID NO:1274) respectively, that are predicted to encode polypeptides containing an RNA recognition motif.

A low nitrogen tolerance-modulating polypeptide can contain an NTF2 domain characteristic of a nuclear transport factor 2 (NTF2) polypeptide. NTF2 is a homodimer of approximately 14 kDa subunits which stimulates efficient nuclear import of a cargo protein. NTF2 binds to both RanGDP and FxFG repeat-containing nucleoporins. NTF2 binds to RanGDP sufficiently strongly for the complex to remain intact during transport through nucleopore complexes (NPCs), but the interaction between NTF2 and FxFG nucleoporins is much more transient, which would enable NTF2 to move through the NPC by hopping from one repeat to another. NTF2 folds into a cone with a deep hydrophobic cavity, the opening of which is surrounded by several negatively charged residues. RanGDP binds to NTF2 by inserting a conserved phenylalanine residue into the hydrophobic pocket of NTF2 and making electrostatic interactions with the conserved negatively charged residues that surround the cavity. A structurally similar domain appears in other nuclear import proteins. SEQ ID NO:1274, which sets forth the amino acid sequence of an Arabidopsis clone, identified herein as Ceres ME13151 (SEQ ID NO:1274), that is predicted to encode a polypeptide containing a NTF2 domain.

A low nitrogen tolerance-modulating polypeptide can contain a DUF1218 domain. SEQ ID NO:1274, which sets forth the amino acid sequence of an Arabidopsis clone, identified herein as Ceres ME04772 (SEQ ID NO:510), that is predicted to encode a polypeptide containing a DUF1218 domain.

A low nitrogen tolerance-modulating polypeptide can contain a Myb-like DNA-binding domain characteristic of polypeptides belonging to a protein family whose members contain the DNA binding domains from Myb proteins, as well as the SANT domain family. SEQ ID NO:533, which sets forth the amino acid sequence of an Arabidopsis clone, identified herein as Ceres ME04909 (SEQ ID NO:533), that is predicted to encode a polypeptide containing a Myb-like DNA-binding domain.

A low nitrogen tolerance-modulating polypeptide can contain a FAD_binding_4 domain. This domain is predicted to be characteristic of polypeptides belonging to a family of enzymes that use FAD (flavin adenine dinucleotide) as a co-factor, most of the enzymes are similar to oxygen oxidoreductase, containing a covalently bound FAD group which is attached to a histidine via an 8-alpha-(N3-histidyl)-riboflavin linkage.

A low nitrogen tolerance-modulating polypeptide can contain a BBE domain, which is predicted to be characteristic of a berberine bridge and berberine bridge-like enzyme. BBE enzymes are typically involved in the biosynthesis of numerous isoquinoline alkaloids. They catalyse the transformation of the N-methyl group of (S)-reticuline into the C-8 berberine bridge carbon of (S)-scoulerine. SEQ ID NO:558 sets forth the amino acid sequence of an Arabidopsis clone, identified herein as Ceres ME05194 (SEQ ID NO:558), that is predicted to encode a polypeptide containing an FAD_binding_4 domain and a BBE domain.

A low nitrogen tolerance-modulating polypeptide can contain a prefoldin (PFD) domain characteristic of polypeptides belonging to the prefoldin subunit family. Prefoldin (PFD) is a chaperone that typically interacts with type II chaperonins, hetero-oligomers lacking an obligate co-chaperonin that are found in eukaryotes (chaperonin-containing T-complex polypeptide-1 (CCT)) and archaea. Eukaryotic PFD can typically bind both actin and tubulin co-translationally. The chaperone can then delivers the target protein to CCT, interacting with the chaperonin through the tips of the coiled coils. SEQ ID NO:593 sets forth the amino acid sequence of an Arabidopsis clone, identified herein as Ceres ME05267 (SEQ ID NO:593), that is predicted to encode a polypeptide containing a prefoldin domain.

A low nitrogen tolerance-modulating polypeptide can contain an HR-lesion domain characteristic of polypeptides belonging to a family of plant proteins can be associated with the hypersensitive response (HR) pathway of defense against plant pathogens. The domain is also present in SEQ ID NO: 646, which sets forth the amino acid sequence of an Arabidopsis clone, identified herein as Ceres ME05341 (SEQ ID NO: 646), that is predicted to encode a polypeptide containing an HR-lesion domain.

A low nitrogen tolerance-modulating polypeptide can contain a DUF538 domain. SEQ ID NO:687 sets forth the amino acid sequence of an Arabidopsis clone, identified herein as Ceres ME05392 (SEQ ID NO:687), that is predicted to encode a polypeptide containing a DUF538 domain.

A low nitrogen tolerance-modulating polypeptide can contain a zinc finger C-x8-C-x5-C-x3-H type domain (zf-CCCH), which is characteristic of polypeptides belonging to the zinc finger protein superfamily. Members of zinc finger domains proteins are thought to be involved in DNA-binding, and exist as different types. Proteins containing zinc finger domains of the C-x8-C-x5-C-x3-H type include zinc finger proteins from eukaryotes involved in cell cycle or growth phase-related regulation. It has been shown that different CCCH zinc finger proteins interact with the 3' untranslated region of various mRNA. SEQ ID NO:792 sets forth the amino acid sequence of an *Arabidopsis* clone, identified herein as Ceres ME07344 (SEQ ID NO:792), that is predicted to encode a polypeptide containing a zf-CCCH domain.

A low nitrogen tolerance-modulating polypeptide can contain a DUF246 domain. SEQ ID NO:828 sets forth the amino acid sequence of an *Arabidopsis* clone, identified herein as Ceres ME08464 (SEQ ID NO:828), that is predicted to encode a polypeptide containing a DUF246 domain.

A low nitrogen tolerance-modulating polypeptide can contain a C2 domain. The C2 domain is a Ca2+-dependent membrane-targeting module found in many cellular proteins involved in signal transduction or membrane trafficking. C2 domains are unique among membrane targeting domains in that they typically show wide range of lipid selectivity for the major components of cell membranes, including phosphatidylserine and phosphatidylcholine. SEQ ID NO:982 sets forth the amino acid sequence of an *Arabidopsis* clone, identified herein as Ceres ME12970 (SEQ ID NO:982), that is predicted to encode a polypeptide containing an C2 domain.

A low nitrogen tolerance-modulating polypeptide can contain a Cpn60_TCP1 domain characteristic of polypeptides belonging to the TCP-1/cpn60 chaperonin family. This family includes members from the HSP60 chaperone family and the TCP-1 (T-complex protein) family. Chaperonins, a subfamily of molecular chaperones, are typically essential for the correct folding and assembly of polypeptides into oligomeric structures. Chaperonins are typically found in abundance in prokaryotes, chloroplasts and mitochondria. They are typically required for normal cell growth, and are stress-induced, acting to stabilize or protect disassembled polypeptides under heat-shock conditions. SEQ ID NO: 1054 sets forth the amino acid sequence of an *Arabidopsis* clone, identified herein as Ceres ME13021 (SEQ ID NO: 1054), that is predicted to encode a polypeptide containing a Cpn60_TCP1 domain.

A low nitrogen tolerance-modulating polypeptide can contain a zf-C2H2 domain characteristic of a C2H2 zinc finger domain polypeptide. Zinc finger domains are nucleic acid-binding protein structures composed of 25 to 30 amino-acid residues including 2 conserved Cys and 2 conserved His residues in a C-2-C-12-H-3-H type motif. The 12 residues separating the second Cys and the first His are mainly polar and basic, implicating this region in particular in nucleic acid binding. They have the ability to bind to both RNA and DNA, and it has been suggested that the zinc finger may thus represent the original nucleic acid binding protein. It has also been suggested that a Zn-centered domain could be used in a protein interaction, e.g. in protein kinase C. Many classes of zinc fingers are characterized according to the number and positions of the histidine and cysteine residues involved in the zinc atom coordination. In C2H2 zinc finger class, the first pair of zinc coordinating residues are cysteines, while the second pair are histidines. The motif is also present in SEQ ID NO:1116, which sets forth the amino acid sequence of an *Arabidopsis* clone, identified herein as Ceres ME13087 (SEQ ID NO:1116), that is predicted to encode a polypeptide containing a zf-C2H2 domain.

A low nitrogen tolerance-modulating polypeptide can contain a zein domain characteristic of polypeptides belonging to the zein family of seed storage proteins. SEQ ID NO:1159, which sets forth the amino acid sequence of an *Arabidopsis* clone, identified herein as Ceres ME13107 (SEQ ID NO: 1159), that is predicted to encode a polypeptide containing a zein domain.

A low nitrogen tolerance-modulating polypeptide can contain a snf7 domain characteristic of polypeptides belonging to a family of eukaryotic proteins related to yeast SNF7. SEQ ID NO:1185 sets forth the amino acid sequence of an *Arabidopsis* clone, identified herein as Ceres ME13110 (SEQ ID NO:1185), that is predicted to encode a polypeptide containing a snf7 domain.

A low nitrogen tolerance-modulating polypeptide can contain an HhH-GPD domain characteristic of polypeptides belonging to the HhH-GPD base excision DNA repair protein superfamily. Members of the HhH-GPD base excision DNA repair protein superfamily contain helix-hairpin-helix and Gly/Pro rich loop followed by a conserved aspartate. This domain is found in a diverse range of structurally related DNA repair proteins. The domain is also present in SEQ ID NO:1194 sets forth the amino acid sequence of an *Arabidopsis* clone, identified herein as Ceres ME13125 (SEQ ID NO:1194), that is predicted to encode a polypeptide containing an HhH-GPD domain.

A low nitrogen tolerance-modulating polypeptide can contain an Arf domain characteristic of polypeptides belonging to the ADP-ribosylation factor family. The small ADP ribosylation factor (Arf) GTP-binding proteins are major regulators of vesicle biogenesis in intracellular traffic. They are the founding members of a growing family that includes Arl (Arf-like), Arp (Arf-related proteins) and the remotely related Sar (Secretion-associated and Ras-related) proteins. Arf proteins cycle between inactive GDP-bound and active GTP-bound forms that bind selectively to effectors. The classical structural GDP/GTP switch is characterized by conformational changes at the so-called switch 1 and switch 2 regions, which bind tightly to the gamma-phosphate of GTP but poorly or not at all to the GDP nucleotide. Structural studies of Arf1 and Arf6 have revealed that although these proteins feature the switch 1 and 2 conformational changes, they depart from other small GTP-binding proteins in that they use an additional, unique switch to propagate structural information from one side of the protein to the other. The GDP/GTP structural cycles of human Arf1 and Arf6 feature a unique conformational change that affects the beta2beta3 strands connecting switch 1 and switch 2 (inter-switch) and also the amphipathic helical N-terminus. SEQ ID NO: 1210 sets forth the amino acid sequence of an *Arabidopsis* clone, identified herein as Ceres ME13149 (SEQ ID NO:1210), that is predicted to encode a polypeptide containing an Arf domain.

A low nitrogen tolerance-modulating polypeptide can contain a Pyridoxal_deC domain characteristic of pyridoxal-dependent decarboxylase polypeptide. Pyridoxal-dependent decarboxylases typically share regions of sequence similarity, particularly in the vicinity of a conserved lysine residue, which provides the attachment site for the pyridoxalphosphate (PLP) group. Pyridoxal phosphate is the active form of vitamin B6 (pyridoxine or pyridoxal). PLP is a versatile catalyst, acting as a coenzyme in a multitude of reactions, including decarboxylation, deamination and transamination. PLP-dependent enzymes, including pyridoxal-dependent decarboxylases, are involved in the biosynthesis of amino acids and amino acid-derived metabolites, but they are also found in the biosynthetic pathways of amino sugars and in the synthesis or catabolism of neurotransmitter. SEQ ID NO:1302 sets forth the amino acid sequence of an *Arabidopsis* clone, identified herein as Ceres ME13153 (SEQ ID NO:1302), that is predicted to encode a polypeptide containing a Pyridoxal_deC domain.

A low nitrogen tolerance-modulating polypeptide can contain a Cyclin_C domain, which is characteristic to the C-terminal domain of polypeptides belonging to the Cyclin family. Cyclins are eukaryotic proteins that play an active role in controlling nuclear cell division cycles, and regulate cyclin dependent kinases (CDKs). Cyclins, together with the p34 (cdc2) or cdk2 kinases, form the Maturation Promoting Factor (MPF). There are two main groups of cyclins, G1/S cyclins, which play a role in the control of the cell cycle at the G1/S (start) transition, and G2/M cyclins, which play a role in the control of the cell cycle at the G2/M (mitosis) transition. G2/M cyclins accumulate steadily during G2 and are abruptly destroyed as cells exit from mitosis (at the end of the M-phase). Cyclins typically contain two domains of similar all-alpha fold, of which this family corresponds with the C-terminal domain.

A low nitrogen tolerance-modulating polypeptide can contain a Cyclin_N domain, which defines the N-terminal domain of polypeptides belonging to the Cyclin family. SEQ ID NO: 1342 sets forth the amino acid sequence of an *Arabidopsis* clone, identified herein as Ceres ME13177 (SEQ ID NO: 1342), that is predicted to encode a polypeptide containing a Cyclin_C domain and a Cyclin_N domain.

A low nitrogen tolerance-modulating polypeptide can contain a DUF1442 domain. SEQ ID NO:1463, which sets forth the amino acid sequence of an *Arabidopsis* clone, identified herein as Ceres ME16546 (SEQ ID NO:1463), that is predicted to encode a polypeptide containing a DUF1442 domain.

A low nitrogen tolerance-modulating polypeptide can contain an HLH domain characteristic of polypeptides belonging to the Helix-loop-helix DNA-binding domain superfamily. Basic helix-loop-helix proteins (bHLH) are a group of eukaryotic transcription factors that can exert a determinative influence in a variety of developmental pathways. These transcription factors are characterized by a conserved bHLH domain that mediates specific dimerization. They can facilitate the conversion of inactive monomers to trans-activating dimers at appropriate stages of development. Members of this superfamily can be classified into discrete categories according to dimerization, DNA binding and expression characteristics. SEQ ID NO:1537 sets forth the amino acid sequence of an *Arabidopsis* clone, identified herein as Ceres ME18275 (SEQ ID NO:1537), that is predicted to encode a polypeptide containing an HLH domain.

A low nitrogen tolerance-modulating polypeptide can contain a CRAL_TRIO domain characteristic of the C-terminal of retinaldehyde/retinal-binding protein family. In animals, retinaldehyde/retinal-binding proteins may be functional components of the visual cycle. Cellular retinaldehyde-binding protein (CRALBP) may function as a substrate carrier protein that modulates interaction of these retinoids with visual cycle enzymes. The multidomain protein Trio can bind the LAR transmembrane tyrosine phosphatase, contains a protein kinase domain, and has separate rac-specific and rho-specific guanine nucleotide exchange factor domains. Trio is a multifunctional protein that can integrate and amplify signals involved in coordinating actin remodeling, which is necessary for cell migration and growth. Other members of the family are transfer proteins that include, guanine nucleotide exchange factor that may function as an effector of RAC1, phosphatidylinositol/phosphatidylcholine transfer protein that is required for the transport of secretory proteins from the Golgi complex and alpha-tocopherol transfer protein that enhances the transfer of the ligand between separate membranes.

A low nitrogen tolerance-modulating polypeptide can contain a CRAL_TRIO_N which defines the N-terminal of retinaldehyde/retinal-binding protein family.

A low nitrogen tolerance-modulating polypeptide can contain an EMP24_GP25L domain characteristic of polypeptides belonging to the emp24/gp25L/p24 family/GOLD gene family. Members of this family are implicated in bringing cargo forward from the ER and binding to coat proteins by their cytoplasmic domains. This domain corresponds closely to the beta-strand rich GOLD domain. The GOLD domain is often found combined with lipid- or membrane-association domains. p24 proteins are major membrane components of COPI- and COPII-coated vesicles and are implicated in cargo selectivity of ER to Golgi transport. Multiple members of the p24 family are found in all eukaryotes, from yeast to mammals. Members of the p24 family are type I membrane proteins with a signal peptide at the amino terminus, a lumenal coiled-coil (extracytosolic) domain, a single transmembrane domain with conserved amino acids, and a short cytoplasmic tail. They may be grouped into at least three subfamilies based on primary sequence. One subfamily comprises yeast Emp24p and mammalian p24A. Another subfamily comprises yeast Erv25p and mammalian Tmp21, and the third subfamily comprises mammalian gp25L proteins. SEQ ID NO:1554 sets forth the amino acid sequence of an *Arabidopsis* clone, identified herein as Ceres ME18924 (SEQ ID NO:1554), that is predicted to encode a polypeptide containing a CRAL_TRIO domain, a CRAL_TRIO_N domain, and a EMP24_GP25L domain.

A low nitrogen tolerance-modulating polypeptide can contain a Pyrophosphatase domain, which is predicted to be characteristic of an inorganic pyrophosphatase (PPase). PPase is the enzyme responsible for the hydrolysis of pyrophosphate (PPi) which is formed principally as the product of the many biosynthetic reactions that utilize ATP. PPases may require the presence of divalent metal cations, with magnesium conferring the highest activity. Among other residues, a lysine has been postulated to be part of or close to the active site. The sequences of PPases share some regions of similarities, among which is a region that contains three conserved aspartates that are involved in the binding of cations. SEQ ID NO:1577 sets forth the amino acid sequence of an *Arabidopsis* clone, identified herein as Ceres ME19182 (SEQ ID NO:1577), that is predicted to encode a polypeptide containing a Pyrophosphatase domain.

A low nitrogen tolerance-modulating polypeptide can contain a bZIP_1 domain characteristic of polypeptides belonging to the superfamily of basic ZIP transcription factors. Members of the eukaryotic bZIP transcription factor superfamily contain a basic region mediating sequence-specific DNA-binding followed by a leucine zipper region required for dimerization. SEQ ID NO: 1437 sets forth the amino acid sequence of an *Arabidopsis* clone, identified herein as Ceres ME20628 (SEQ ID NO: 1437), that is predicted to encode a polypeptide containing a bZIP_1 domain.

B. Functional Homologs Identified by Reciprocal BLAST

In some embodiments, one or more functional homologs of a reference low nitrogen tolerance-modulating polypeptide defined by one or more of the Pfam descriptions indicated above are suitable for use as low nitrogen tolerance-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a low nitrogen tolerance-modulating polypeptide, or by combining domains from the coding sequences for different naturally-occurring low nitrogen tolerance-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of low nitrogen tolerance-modulating polypeptides. Sequence analysis can involve BLAST, Reciprocal BLAST, or PSI-BLAST analysis of nonredundant databases using a low nitrogen tolerance-modulating polypeptide amino acid sequence as the reference sequence Amino acid sequence is, in some instances, deduced from the nucleotide sequence. Those polypeptides in the database that have greater than 20% sequence identity are candidates for further evaluation for suitability as a low nitrogen tolerance-modulating polypeptide Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in low nitrogen tolerance-modulating polypeptides, e.g., conserved functional domains.

Conserved regions can be identified by locating a region within the primary amino acid sequence of a low nitrogen tolerance-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al. (1998) *Nucl. Acids Res.,* 26:320-322; Sonnhammer et al. (1997) *Proteins,* 28:405-420; and Bateman et al. (1999) *Nucl. Acids Res.,* 27:260-262. Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 20% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Examples of amino acid sequences of functional homologs of the polypeptide set forth in SEQ ID NO:3 are provided in FIG. 1 and in the Sequence Listing. Such functional homologs include SEQ ID NO:4, SEQ ID NO:6, SEQ ID NO:8, SEQ ID NO:10, SEQ ID NO:12, SEQ ID NO:14, SEQ ID NO:16, SEQ ID NO:17, SEQ ID NO:19, SEQ ID NO:20, SEQ ID NO:21, SEQ ID NO:22, SEQ ID NO:24, SEQ ID NO:25, SEQ ID NO:27, SEQ ID NO:29, SEQ ID NO:31, SEQ ID NO:33, SEQ ID NO:35, SEQ ID NO:36, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, and SEQ ID NO:47. In some cases, a functional homolog of SEQ ID NO:3 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:3.

Examples of amino acid sequences of functional homologs of the polypeptide set forth in SEQ ID NO:49 are provided in FIG. 2 and in the Sequence Listing. Such functional homologs include SEQ ID NO:51, SEQ ID NO:53, SEQ ID NO:55, SEQ ID NO:56, SEQ ID NO:58, SEQ ID NO:60, SEQ ID NO:62, SEQ ID NO:63, SEQ ID NO:64, SEQ ID NO:65, SEQ ID NO:67, SEQ ID NO:69, SEQ ID NO:70, SEQ ID NO:71, SEQ ID NO:72, SEQ ID NO:73, and SEQ ID NO:75. In some cases, a functional homolog of SEQ ID NO:49 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:49.

Examples of amino acid sequences of functional homologs of the polypeptide set forth in SEQ ID NO:77 are provided in FIG. 3 and in the Sequence Listing. Such functional homologs include SEQ ID NO:78, SEQ ID NO:80, SEQ ID NO:82, SEQ ID NO:84, SEQ ID NO:85, SEQ ID NO:87, SEQ ID NO:88, SEQ ID NO:90, SEQ ID NO:92, SEQ ID NO:93, SEQ ID NO:95, and CeresAnnot: 839064 (SEQ ID NO:1479). In some cases, a functional homolog of SEQ ID NO:77 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:77.

Examples of amino acid sequences of functional homologs of the polypeptide set forth in SEQ ID NO:100 are provided in FIG. 4 and in the Sequence Listing. Such functional homologs include SEQ ID NO:101, SEQ ID NO:102, SEQ ID NO:104, SEQ ID NO:106, SEQ ID NO:108, SEQ ID NO:110, SEQ ID NO:111, SEQ ID NO:113, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:125, SEQ ID NO:126, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:137, SEQ ID NO:139, SEQ ID NO:141, SEQ ID NO:142, SEQ ID NO:144, SEQ ID NO:145, SEQ ID NO:146, SEQ ID NO:147, SEQ ID NO:148, SEQ ID NO:149, and SEQ ID NO:150. In some cases, a functional homolog of SEQ ID NO:100 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:100.

Examples of amino acid sequences of functional homologs of the polypeptide set forth in SEQ ID NO:152 are provided in FIG. 5 and in the Sequence Listing. Such functional homologs include SEQ ID NO:154, SEQ ID NO:156, SEQ ID NO:158, SEQ ID NO:160, SEQ ID NO:162, and SEQ ID NO:164. In some cases, a functional homolog of SEQ ID NO:152 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:152.

Examples of amino acid sequences of functional homologs of the polypeptide set forth in SEQ ID NO:166 are provided in FIG. 6 and in the Sequence Listing. Such functional homologs include SEQ ID NO:168, SEQ ID NO:170, SEQ ID NO:172, SEQ ID NO:174, SEQ ID NO:177, SEQ ID NO:179, SEQ ID NO:181, SEQ ID NO:182, SEQ ID NO:183, and SEQ ID NO:184. In some cases, a functional homolog of SEQ ID NO:166 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:166.

Examples of amino acid sequences of functional homologs of the polypeptide set forth in SEQ ID NO:186 are provided in FIG. 7 and in the Sequence Listing. Such functional homologs include SEQ ID NO:188, SEQ ID NO:190, SEQ ID NO:191, SEQ ID NO:193, SEQ ID NO:194, SEQ ID NO:196, SEQ ID NO:197, SEQ ID NO:199, SEQ ID NO:201, SEQ ID NO:203, SEQ ID NO:204, SEQ ID NO:205, and SEQ ID NO:206. In some cases, a functional homolog of SEQ ID NO:186 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:186.

Examples of amino acid sequences of functional homologs of the polypeptide set forth in SEQ ID NO:208 are provided in FIG. 8 and in the Sequence Listing. Such functional homologs include SEQ ID NO:209, SEQ ID NO:210, SEQ ID NO:214, and SEQ ID NO:216. In some cases, a functional homolog of SEQ ID NO:208 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:208.

Examples of amino acid sequences of functional homologs of the polypeptide set forth in SEQ ID NO:218 are provided in FIG. 9 and in the Sequence Listing. Such functional homologs include SEQ ID NO:220, SEQ ID NO:222, SEQ ID NO:223, SEQ ID NO:225, SEQ ID NO:227, SEQ ID NO:229, SEQ ID NO:230, SEQ ID NO:231, SEQ ID NO:232, SEQ ID NO:1039, SEQ ID NO:1049, and SEQ ID NO:1052. In some cases, a functional homolog of SEQ ID NO:218 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:218.

Examples of amino acid sequences of functional homologs of the polypeptide set forth in SEQ ID NO:234 are provided in FIG. 10 and in the Sequence Listing. Such functional homologs include SEQ ID NO:236, SEQ ID NO:238, SEQ ID NO:239, SEQ ID NO:241, SEQ ID NO:242, SEQ ID NO:243, and SEQ ID NO:244. In some cases, a functional homolog of SEQ ID NO:234 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:234.

Examples of amino acid sequences of functional homologs of the polypeptide set forth in SEQ ID NO:246 are provided in FIG. 11 and in the Sequence Listing. Such functional homologs include SEQ ID NO:248, SEQ ID NO:249, SEQ ID NO:251, SEQ ID NO:253, SEQ ID NO:255, SEQ ID NO:257, SEQ ID NO:259, SEQ ID NO:260, SEQ ID NO:262, SEQ ID NO:264, SEQ ID NO:265, SEQ ID NO:267, SEQ ID NO:268, SEQ ID NO:270, SEQ ID NO:272, SEQ ID NO:274, SEQ ID NO:276, SEQ ID NO:277, SEQ ID NO:279, SEQ ID NO:281, SEQ ID NO:283, SEQ ID NO:285, SEQ ID NO:286, SEQ ID NO:287, SEQ ID NO:288, SEQ ID NO:290, SEQ ID NO:291, SEQ ID NO:292, SEQ ID NO:293, SEQ ID NO:296, and SEQ ID NO:298. In some cases, a functional homolog of SEQ ID NO:246 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:246.

Examples of amino acid sequences of functional homologs of the polypeptide set forth in SEQ ID NO:300 are provided in FIG. 12 and in the Sequence Listing. Such functional homologs include SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:319, SEQ ID NO:320, SEQ ID NO:321, SEQ ID NO:322, SEQ ID NO:323, SEQ ID NO:325, SEQ ID NO:327, and SEQ ID NO:329. In some cases, a functional homolog of SEQ ID NO:300 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:300.

Examples of amino acid sequences of functional homologs of the polypeptide set forth in SEQ ID NO:332 are provided in FIG. 13 and in the Sequence Listing. Such functional homologs include SEQ ID NO:332, SEQ ID NO:334, SEQ ID NO:335, SEQ ID NO:336, SEQ ID NO:338, SEQ ID NO:339, SEQ ID NO:341, SEQ ID NO:342, SEQ ID NO:343, SEQ ID NO:344, SEQ ID NO:345, SEQ ID NO:346, SEQ ID NO:347, SEQ ID NO:348, SEQ ID NO:349, SEQ ID NO:351, SEQ ID NO:352, SEQ ID NO:353, SEQ ID NO:354, SEQ ID NO:355, SEQ ID NO:356, SEQ ID NO:357, SEQ ID NO:358, SEQ ID NO:359, SEQ ID NO:360, SEQ ID NO:362, SEQ ID NO:363, SEQ ID NO:364, SEQ ID NO:365, SEQ ID NO:366, SEQ ID NO:2541, SEQ ID NO:2542, SEQ ID NO:2543, SEQ ID NO:2544, SEQ ID NO:2546, SEQ ID NO:2548, SEQ ID NO:2549, SEQ ID NO:2550, SEQ ID NO:2551, SEQ ID NO:2552, and SEQ ID NO:2553. In some cases, a functional homolog of SEQ ID NO:332 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:332.

Examples of amino acid sequences of functional homologs of the polypeptide set forth in SEQ ID NO:368 are provided in FIG. 14 and in the Sequence Listing. Such functional homologs include SEQ ID NO:369, SEQ ID NO:370, SEQ ID NO:371, SEQ ID NO:372, SEQ ID NO:373, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:399, SEQ ID NO:401, SEQ ID NO:403, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:419, SEQ ID NO:420, SEQ ID NO:422, SEQ ID NO:423, SEQ ID NO:425, SEQ ID NO:427, SEQ ID NO:428, SEQ ID NO:430, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:458, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:474, SEQ ID NO:475, SEQ ID NO:477, SEQ ID NO:479, SEQ ID NO:481, SEQ ID NO:483, SEQ ID NO:485, SEQ ID NO:487, SEQ ID NO:488, SEQ ID NO:489, SEQ ID NO:490, SEQ ID NO:491, SEQ ID NO:492, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:502, SEQ ID NO:504, SEQ ID NO:505, SEQ ID NO:506, SEQ ID NO:507, and SEQ ID NO:508. In some cases, a functional homolog of SEQ ID NO:368 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:368.

Examples of amino acid sequences of functional homologs of the polypeptide set forth in SEQ ID NO:510 are provided in FIG. 15 and in the Sequence Listing. Such functional homologs include SEQ ID NO:511, SEQ ID NO:513, SEQ ID NO:515, SEQ ID NO:517, SEQ ID NO:521, SEQ ID NO:523, SEQ ID NO:525, SEQ ID NO:527, SEQ ID NO:529, SEQ ID NO:530, and SEQ ID NO:531. In some cases, a functional homolog of SEQ ID NO:510 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:510.

Examples of amino acid sequences of functional homologs of the polypeptide set forth in SEQ ID NO:533 are provided in FIG. 16 and in the Sequence Listing. Such functional homologs include SEQ ID NO:535, SEQ ID NO:536, SEQ ID NO:538, SEQ ID NO:539, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:550, SEQ ID NO:552, SEQ ID NO:553, and SEQ ID NO:554. In some cases, a functional homolog of SEQ ID NO:533 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:533.

Examples of amino acid sequences of functional homologs of the polypeptide set forth in SEQ ID NO:558 are provided in FIG. 17 and in the Sequence Listing. Such functional homologs include SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:569, SEQ ID NO:571, SEQ ID NO:572, SEQ ID NO:573, SEQ ID NO:575, SEQ ID NO:576, SEQ ID NO:577, SEQ ID NO:578, SEQ ID NO:579, SEQ ID NO:581, SEQ ID NO:583, SEQ ID NO:584, SEQ ID NO:585, SEQ ID NO:586, SEQ ID NO:588, SEQ ID NO:589, SEQ ID NO:590, and SEQ ID NO:591. In some cases, a functional homolog of SEQ ID NO:558 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:558.

Examples of amino acid sequences of functional homologs of the polypeptide set forth in SEQ ID NO:593 are provided in FIG. 18 and in the Sequence Listing. Such functional homologs include SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:610, and SEQ ID NO:611. In some cases, a functional homolog of SEQ ID NO:593 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:593.

Examples of amino acid sequences of functional homologs of the polypeptide set forth in SEQ ID NO:613 are provided in FIG. 19 and in the Sequence Listing. Such functional homologs include SEQ ID NO:615, SEQ ID NO:617, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:643, and SEQ ID NO:644. In some cases, a functional homolog of SEQ ID NO:613 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:613.

Examples of amino acid sequences of functional homologs of the polypeptide set forth in SEQ ID NO:646 are provided in FIG. 20 and in the Sequence Listing. Such functional homologs include SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:679, SEQ ID NO:680, SEQ ID NO:681, SEQ ID NO:682, SEQ ID NO:683, and SEQ ID NO:685. In some cases, a functional homolog of SEQ ID NO:646 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:646.

Examples of amino acid sequences of functional homologs of the polypeptide set forth in SEQ ID NO:687 are provided in FIG. 21 and in the Sequence Listing. Such functional homologs include SEQ ID NO:689, SEQ ID NO:691, SEQ ID NO:693, SEQ ID NO:694, SEQ ID NO:696, SEQ ID NO:697, SEQ ID NO:699, SEQ ID NO:701, SEQ ID NO:703, SEQ ID NO:705, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:721, SEQ ID NO:722, SEQ ID NO:723, SEQ ID NO:724, SEQ ID NO:725, SEQ ID NO:726, SEQ ID NO:727, and SEQ ID NO:728. In some cases, a functional homolog of SEQ ID NO:687 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:687.

Examples of amino acid sequences of functional homologs of the polypeptide set forth in SEQ ID NO:730 are provided in FIG. 22 and in the Sequence Listing. Such functional homologs include SEQ ID NO:732, SEQ ID NO:733, SEQ ID NO:735, SEQ ID NO:737, SEQ ID NO:738, and SEQ ID NO:742. In some cases, a functional homolog of SEQ ID NO:730 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:730.

Examples of amino acid sequences of functional homologs of the polypeptide set forth in SEQ ID NO:746 are provided in FIG. 23 and in the Sequence Listing. Such functional homologs include SEQ ID NO:748, SEQ ID NO:750, SEQ ID NO:751, SEQ ID NO:753, SEQ ID NO:755, SEQ ID NO:757, SEQ ID NO:758, SEQ ID NO:760, SEQ ID NO:761, SEQ ID NO:762, SEQ ID NO:763, SEQ ID NO:765, and SEQ ID NO:767. In some cases, a functional homolog of SEQ ID NO:746 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:746.

Examples of amino acid sequences of functional homologs of the polypeptide set forth in SEQ ID NO:769 are provided in FIG. 24 and in the Sequence Listing. Such functional homologs include SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, and SEQ ID NO:790. In some cases, a functional homolog of SEQ ID NO:769 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:769.

Examples of amino acid sequences of functional homologs of the polypeptide set forth in SEQ ID NO:792 are provided in FIG. 25 and in the Sequence Listing. Such functional homologs include SEQ ID NO:794, SEQ ID NO:796, SEQ ID NO:798, SEQ ID NO:799, SEQ ID NO:801, SEQ ID NO:803, SEQ ID NO:805, SEQ ID NO:807, SEQ ID NO:808, SEQ ID NO:810, SEQ ID NO:812, SEQ ID NO:814, SEQ ID NO:816, SEQ ID NO:818, SEQ ID NO:819, SEQ ID NO:820, SEQ ID NO:821, and SEQ ID NO:822. In some cases, a functional homolog of SEQ ID NO:792 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:792.

Examples of amino acid sequences of functional homologs of the polypeptide set forth in SEQ ID NO:824 are provided in FIG. 26 and in the Sequence Listing. Such functional homologs include, but not limited to, SEQ ID NO:826, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710, SEQ ID NO:1711, SEQ ID NO:1713, SEQ ID NO:1714, SEQ ID NO:1715, and SEQ ID NO:1716. In some cases, a functional homolog of SEQ ID NO:824 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:824.

Examples of amino acid sequences of functional homologs of the polypeptide set forth in SEQ ID NO:828 are provided in FIG. 27 and in the Sequence Listing. Such functional homologs include SEQ ID NO:830, SEQ ID NO:832, SEQ ID NO:834, SEQ ID NO:836, SEQ ID NO:837, SEQ ID NO:838, SEQ ID NO:839, SEQ ID NO:840, SEQ ID NO:842, SEQ ID NO:844, SEQ ID NO:845, SEQ ID NO:846, SEQ ID NO:847, SEQ ID NO:848, SEQ ID NO:849, SEQ ID NO:850, and SEQ ID NO:851. In some cases, a functional homolog of SEQ ID NO:828 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:828.

Examples of amino acid sequences of functional homologs of the polypeptide set forth in SEQ ID NO:855 are provided in FIG. 28 and in the Sequence Listing. Such functional homologs include SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:885, SEQ ID NO:886, SEQ ID NO:887, SEQ ID NO:888, and SEQ ID NO:889. In some cases, a functional homolog of SEQ ID NO:855 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:855.

Examples of amino acid sequences of functional homologs of the polypeptide set forth in SEQ ID NO:891 are provided in FIG. 29 and in the Sequence Listing. Such functional homologs include SEQ ID NO:893, SEQ ID NO:894, SEQ ID NO:895, SEQ ID NO:896, SEQ ID NO:898, SEQ ID NO:900, SEQ ID NO:901, SEQ ID NO:902, SEQ ID NO:903, SEQ ID NO:904, SEQ ID NO:905, SEQ ID NO:907, SEQ ID NO:908, SEQ ID NO:909, SEQ ID NO:910, SEQ ID NO:911, SEQ ID NO:912, SEQ ID NO:913, SEQ ID NO:914, and SEQ ID NO:915. In some cases, a functional homolog of SEQ ID NO:891 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:891.

Examples of amino acid sequences of functional homologs of the polypeptide set forth in SEQ ID NO:917 are provided in FIG. 30 and in the Sequence Listing. Such functional homologs include SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, and SEQ ID NO:940. In some cases, a functional homolog of SEQ ID NO:917 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:917.

Examples of amino acid sequences of functional homologs of the polypeptide set forth in SEQ ID NO:944 are provided in FIG. 31 and in the Sequence Listing. Such functional homologs include SEQ ID NO:946, SEQ ID NO:947, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:967, SEQ ID NO:968, SEQ ID NO:969, SEQ ID NO:970, SEQ ID NO:972, and SEQ ID NO:974. In some cases, a functional homolog of SEQ ID NO:944 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:944.

Examples of amino acid sequences of functional homologs of the polypeptide set forth in SEQ ID NO:976 are provided in FIG. 32 and in the Sequence Listing. Such functional homologs include, but not limited to, SEQ ID NO:978 and SEQ ID NO:980. In some cases, a functional homolog of SEQ ID NO:976 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:976.

Examples of amino acid sequences of functional homologs of the polypeptide set forth in SEQ ID NO:982 are provided in FIG. 33 and in the Sequence Listing. Such functional homologs include SEQ ID NO:984, SEQ ID NO:985, SEQ ID NO:986, SEQ ID NO:987, SEQ ID NO:988, SEQ ID NO:989, SEQ ID NO:990, SEQ ID NO:991, SEQ ID NO:992, SEQ ID NO:993, SEQ ID NO:995, SEQ ID NO:996, SEQ ID NO:998, SEQ ID NO:1000, SEQ ID NO:1001, SEQ ID NO:1003, SEQ ID NO:1005, SEQ ID NO:1007, SEQ ID NO:1008, SEQ ID NO:1009, SEQ ID NO:1011, SEQ ID NO:1013, SEQ ID NO:1015, SEQ ID NO:1016, SEQ ID NO:1018, SEQ ID NO:1019, SEQ ID NO:1021, SEQ ID NO:1023, SEQ ID NO:1025, SEQ ID NO:1026, SEQ ID NO:1027, SEQ ID NO:1028, SEQ ID NO:1029, SEQ ID NO:1030, SEQ ID NO:1031, SEQ ID NO:1032, and SEQ ID NO:1033. In some cases, a functional homolog of SEQ ID NO:982 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:982.

Examples of amino acid sequences of functional homologs of the polypeptide set forth in SEQ ID NO:1054 are provided in FIG. 34 and in the Sequence Listing. Such functional homologs include SEQ ID NO:1055, SEQ ID NO:1057, SEQ ID NO:1058, SEQ ID NO:1059, SEQ ID NO:1061, SEQ ID NO:1063, SEQ ID NO:1065, SEQ ID NO:1067, SEQ ID NO:1068, SEQ ID NO:1070, SEQ ID NO:1071, SEQ ID NO:1072, SEQ ID NO:1074, SEQ ID NO:1075, SEQ ID NO:1076, SEQ ID NO:1077, SEQ ID NO:1078, SEQ ID NO:1080, SEQ ID NO:1082, SEQ ID NO:1083, SEQ ID NO:1085, SEQ ID NO:1086, SEQ ID NO:1087, SEQ ID NO:1088, SEQ ID NO:1089, SEQ ID NO:1090, SEQ ID NO:1091, SEQ ID NO:1092, SEQ ID NO:1093, SEQ ID NO:1094, SEQ ID NO:1095, and SEQ ID NO:1097. In some cases, a functional homolog of SEQ ID NO:1054 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1054.

Examples of amino acid sequences of functional homologs of the polypeptide set forth in SEQ ID NO:1099 are provided in FIG. 35 and in the Sequence Listing. Such functional homologs include SEQ ID NO:1101, SEQ ID NO:1103, SEQ ID NO:1104, SEQ ID NO:1105, SEQ ID NO:1106, SEQ ID NO:1108, SEQ ID NO:1109, and SEQ ID NO:1110. In some cases, a functional homolog of SEQ ID NO:1099 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1099.

Examples of amino acid sequences of functional homologs of the polypeptide set forth in SEQ ID NO:1112 are provided in FIG. 36 and in the Sequence Listing. Such functional homologs include SEQ ID NO:1113 and SEQ ID NO:1114. In some cases, a functional homolog of SEQ ID NO:1112 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1112.

Examples of amino acid sequences of functional homologs of the polypeptide set forth in SEQ ID NO:1116 are provided in FIG. 37 and in the Sequence Listing. Such functional homologs include SEQ ID NO:1118, SEQ ID NO:1120, SEQ ID NO:1122, SEQ ID NO:1123, SEQ ID NO:1125, SEQ ID NO:1126, SEQ ID NO:1128, SEQ ID NO:1129, SEQ ID NO:1131, SEQ ID NO:1132, SEQ ID NO:1133, SEQ ID NO:1134, SEQ ID NO:1136, SEQ ID NO:1138, SEQ ID NO:1140, SEQ ID NO:1141, SEQ ID NO:1142, SEQ ID NO:1143, SEQ ID NO:1144, SEQ ID NO:1145, SEQ ID NO:1147, SEQ ID NO:1149, SEQ ID NO:1151, SEQ ID NO:1153, and SEQ ID NO:1155. In some cases, a functional homolog of SEQ ID NO:1116 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1116.

Examples of amino acid sequences of functional homologs of the polypeptide set forth in SEQ ID NO:1159 are provided in FIG. 38 and in the Sequence Listing. Such functional homologs include SEQ ID NO:1161, SEQ ID NO:1162, SEQ ID NO:1163, and SEQ ID NO:1164. In some cases, a functional homolog of SEQ ID NO:1159 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1159.

Examples of amino acid sequences of functional homologs of the polypeptide set forth in SEQ ID NO:1166 are provided in FIG. 39 and in the Sequence Listing. Such functional homologs include SEQ ID NO:1167, SEQ ID NO:1169, SEQ ID NO:1171, SEQ ID NO:1173, SEQ ID NO:1175, SEQ ID NO:1177, SEQ ID NO:1179, SEQ ID NO:1180, SEQ ID NO:1182, and SEQ ID NO:1183. In some cases, a functional homolog of SEQ ID NO:1166 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1166.

Examples of amino acid sequences of functional homologs of the polypeptide set forth in SEQ ID NO:1185 are provided in FIG. 40 and in the Sequence Listing. Such functional homologs include SEQ ID NO:1187, SEQ ID NO:1189, SEQ ID NO:1190, SEQ ID NO:1191, and SEQ ID NO:1192. In some cases, a functional homolog of SEQ ID NO:1185 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1185.

Examples of amino acid sequences of functional homologs of the polypeptide set forth in SEQ ID NO:1194 are provided in FIG. 41 and in the Sequence Listing. Such functional homologs include SEQ ID NO:1196, SEQ ID NO:1198, SEQ ID NO:1200, SEQ ID NO:1202, SEQ ID NO:1203, SEQ ID NO:1204, SEQ ID NO:1205, SEQ ID NO:1206, SEQ ID NO:1207, and SEQ ID NO:1208. In some cases, a functional homolog of SEQ ID NO:1194 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1194.

Examples of amino acid sequences of functional homologs of the polypeptide set forth in SEQ ID NO:1210 are provided in FIG. 42 and in the Sequence Listing. Such functional homologs include SEQ ID NO:1211, SEQ ID NO:1213, SEQ ID NO:1215, SEQ ID NO:1216, SEQ ID NO:1218, SEQ ID NO:1220, SEQ ID NO:1222, SEQ ID NO:1224, SEQ ID NO:1226, SEQ ID NO:1228, SEQ ID NO:1229, SEQ ID NO:1230, SEQ ID NO:1232, SEQ ID NO:1233, SEQ ID NO:1234, SEQ ID NO:1235, SEQ ID NO:1236, SEQ ID NO:1237, SEQ ID NO:1238, SEQ ID NO:1239, SEQ ID NO:1240, SEQ ID NO:1241, SEQ ID NO:1242, SEQ ID NO:1243, SEQ ID NO:1244, SEQ ID NO:1245, SEQ ID NO:1246, SEQ ID NO:1247, SEQ ID NO:1248, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1264, SEQ ID NO:1265, SEQ ID NO:1266, SEQ ID NO:1267, SEQ ID NO:1268, SEQ ID NO:1269, SEQ ID NO:1270, SEQ ID NO:1271, and SEQ ID NO:1272. In some cases, a functional homolog of SEQ ID NO:1210 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1210.

Examples of amino acid sequences of functional homologs of the polypeptide set forth in SEQ ID NO:1274 are provided in FIG. 43 and in the Sequence Listing. Such functional homologs include SEQ ID NO:1276, SEQ ID NO:1278, SEQ ID NO:1280, SEQ ID NO:1281, SEQ ID NO:1282, SEQ ID NO:1284, SEQ ID NO:1285, SEQ ID NO:1287, SEQ ID NO:1289, SEQ ID NO:1291, SEQ ID NO:1293, SEQ ID NO:1294, SEQ ID NO:1295, SEQ ID NO:1296, SEQ ID NO:1297, SEQ ID NO:1298, and SEQ ID NO:1300. In some cases, a functional homolog of SEQ ID NO:1274 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1274.

Examples of amino acid sequences of functional homologs of the polypeptide set forth in SEQ ID NO:1302 are provided in FIG. 44 and in the Sequence Listing. Such functional homologs include SEQ ID NO:1303, SEQ ID NO:1305, SEQ ID NO:1307, SEQ ID NO:1309, SEQ ID NO:1311, SEQ ID NO:1312, SEQ ID NO:1313, SEQ ID NO:1314, SEQ ID NO:1315, SEQ ID NO:1317, SEQ ID NO:1318, SEQ ID NO:1319, SEQ ID NO:1320, SEQ ID NO:1321, SEQ ID NO:1322, SEQ ID NO:1323, SEQ ID NO:1324, SEQ ID NO:1325, SEQ ID NO:1326, SEQ ID NO:1327, SEQ ID NO:1328, SEQ ID NO:1330, SEQ ID NO:1331, SEQ ID NO:1333, SEQ ID NO:1334, SEQ ID NO:1335, SEQ ID NO:1336, SEQ ID NO:1337, SEQ ID NO:1338, SEQ ID NO:1339, and SEQ ID NO:1340. In some cases, a functional homolog of SEQ ID NO:1302 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1302.

Examples of amino acid sequences of functional homologs of the polypeptide set forth in SEQ ID NO:1342 are provided in FIG. 45 and in the Sequence Listing. Such functional homologs include SEQ ID NO:1344, SEQ ID NO:1346, SEQ ID NO:1348, SEQ ID NO:1350, SEQ ID NO:1352, SEQ ID NO:1354, SEQ ID NO:1355, SEQ ID NO:1357, SEQ ID NO:1358, SEQ ID NO:1360, SEQ ID NO:1361, SEQ ID NO:1362, SEQ ID NO:1363, SEQ ID NO:1364, SEQ ID NO:1366, SEQ ID NO:1367, SEQ ID NO:1369, SEQ ID NO:1370, SEQ ID NO:1371, SEQ ID NO:1372, SEQ ID NO:1373, SEQ ID NO:1374, SEQ ID NO:1375, SEQ ID NO:1376, SEQ ID NO:1377, SEQ ID NO:1378, SEQ ID NO:1379, SEQ ID NO:1380, SEQ ID NO:1381, SEQ ID NO:1382, and SEQ ID NO:1383. In some cases, a functional homolog of SEQ ID NO:1342 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1342.

Examples of amino acid sequences of functional homologs of the polypeptide set forth in SEQ ID NO:1385 are provided in FIG. 46 and in the Sequence Listing. Such functional homologs include SEQ ID NO:1387, SEQ ID NO:1389, SEQ ID NO:1390, SEQ ID NO:1391, SEQ ID NO:1393, SEQ ID NO:1394, SEQ ID NO:1395, SEQ ID NO:1396, SEQ ID NO:1398, SEQ ID NO:1400, SEQ ID NO:1401, SEQ ID NO:1402, SEQ ID NO:1403, SEQ ID NO:1404, SEQ ID NO:1405, and SEQ ID NO:1407. In some cases, a functional homolog of SEQ ID NO:1385 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1385.

Examples of amino acid sequences of functional homologs of the polypeptide set forth in SEQ ID NO:1409 are provided in FIG. 47 and in the Sequence Listing. Such functional homologs include SEQ ID NO:1411, SEQ ID NO:1413, SEQ ID NO:1415, SEQ ID NO:1417, SEQ ID NO:1418, SEQ ID NO:1419, SEQ ID NO:1421, SEQ ID NO:1423, SEQ ID NO:1424, SEQ ID NO:1425, and SEQ ID NO:1426. In some cases, a functional homolog of SEQ ID NO:1409 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1409.

Examples of amino acid sequences of functional homologs of the polypeptide set forth in SEQ ID NO:1428 are provided in FIG. 48 and in the Sequence Listing. Such functional homologs include SEQ ID NO:1430, SEQ ID NO:1432, SEQ ID NO:1434, SEQ ID NO:1436, SEQ ID NO:1439, SEQ ID NO:1442, SEQ ID NO:1444, SEQ ID NO:1446, SEQ ID NO:1448, SEQ ID NO:1450, SEQ ID NO:1452, SEQ ID NO:1453, SEQ ID NO:1454, SEQ ID NO:1455, SEQ ID NO:1456, SEQ ID NO:1457, SEQ ID NO:1458, and SEQ ID NO:1459. In some cases, a functional homolog of SEQ ID NO:1428 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1428.

Examples of amino acid sequences of functional homologs of the polypeptide set forth in SEQ ID NO:1463 are provided in FIG. 49 and in the Sequence Listing. Such functional homologs include SEQ ID NO:1465, SEQ ID NO:1467, SEQ ID NO:1469, SEQ ID NO:1471, SEQ ID NO:1473, SEQ ID NO:1474, SEQ ID NO:1475, SEQ ID NO:1476, and SEQ ID NO:1477. In some cases, a functional homolog of SEQ ID NO:1463 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1463.

Examples of amino acid sequences of functional homologs of the polypeptide set forth in SEQ ID NO:1491 are provided in FIG. 50 and in the Sequence Listing. Such functional homologs include SEQ ID NO:1493, SEQ ID NO:1495, SEQ ID NO:1497, SEQ ID NO:1499, SEQ ID NO:1501, SEQ ID NO:1503, SEQ ID NO:1504, SEQ ID NO:1505, SEQ ID NO:1506, and SEQ ID NO:1508. In some cases, a functional homolog of SEQ ID NO:1491 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1491.

Examples of amino acid sequences of functional homologs of the polypeptide set forth in SEQ ID NO:1510 are provided in FIG. 51 and in the Sequence Listing. Such functional homologs include SEQ ID NO:1512, SEQ ID NO:1514, SEQ ID NO:1516, SEQ ID NO:1518, SEQ ID NO:1520, SEQ ID NO:1522, and SEQ ID NO:1523. In some cases, a functional homolog of SEQ ID NO:1510 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1510.

Examples of amino acid sequences of functional homologs of the polypeptide set forth in SEQ ID NO:1525 are provided in FIG. 52 and in the Sequence Listing. Such functional homologs include SEQ ID NO:1527, SEQ ID NO:1529, SEQ ID NO:1530, SEQ ID NO:1532, SEQ ID NO:1534, and SEQ ID NO:1535. In some cases, a functional homolog of SEQ ID NO:1525 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1525.

Examples of amino acid sequences of functional homologs of the polypeptide set forth in SEQ ID NO:1537 are provided in FIG. 53 and in the Sequence Listing. Such functional homologs include SEQ ID NO:1539, SEQ ID NO:1540, SEQ ID NO:1541, SEQ ID NO:1543, SEQ ID NO:1545, SEQ ID NO:1547, SEQ ID NO:1548, SEQ ID NO:1550, SEQ ID NO:1552, SEQ ID NO:2386, SEQ ID NO:2388, SEQ ID NO:2390, SEQ ID NO:2391, and SEQ ID NO:2392. In some cases, a functional homolog of SEQ ID NO:1537 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1537.

Examples of amino acid sequences of functional homologs of the polypeptide set forth in SEQ ID NO:1554 are provided in FIG. 54 and in the Sequence Listing. Such functional homologs include SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1571, SEQ ID NO:1572, SEQ ID NO:1573, SEQ ID NO:1574, and SEQ ID NO:1575. In some cases, a functional homolog of SEQ ID NO:1554 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1554.

Examples of amino acid sequences of functional homologs of the polypeptide set forth in SEQ ID NO:1577 are provided in FIG. 55 and in the Sequence Listing. Such functional homologs include SEQ ID NO:1035, SEQ ID NO:1036, SEQ ID NO:1037, SEQ ID NO:1040, SEQ ID NO:1041, SEQ ID NO:1043, SEQ ID NO:1044, SEQ ID NO:1046, SEQ ID NO:1047, SEQ ID NO:1048, SEQ ID NO:1050, SEQ ID NO:1440, SEQ ID NO:1480, SEQ ID NO:1481, SEQ ID NO:1482, SEQ ID NO:1483, SEQ ID NO:1484, SEQ ID NO:1485, SEQ ID NO:1486, SEQ ID NO:1487, SEQ ID NO:1488, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1596, SEQ ID NO:1598, SEQ ID NO:1599, SEQ ID NO:1601, SEQ ID NO:1602, SEQ ID NO:1605, SEQ ID NO:1607, SEQ ID NO:1608, SEQ ID NO:1609, SEQ ID NO:1611, SEQ ID NO:1613, SEQ ID NO:1615, SEQ ID NO:1617, SEQ ID NO:1619, SEQ ID NO:1621, SEQ ID NO:1622, SEQ ID NO:1623, SEQ ID NO:1624, SEQ ID NO:1625, SEQ ID NO:1627, SEQ ID NO:1629, SEQ ID NO:1631, SEQ ID NO:1633, SEQ ID NO:1635, SEQ ID NO:1637, SEQ ID NO:1639, SEQ ID NO:1643, SEQ ID NO:1645, SEQ ID NO:1648, SEQ ID NO:1649, SEQ ID NO:1651, and SEQ ID NO:1653. In some cases, a functional homolog of SEQ ID NO:1577 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1577.

Examples of amino acid sequences of functional homologs of the polypeptide set forth in SEQ ID NO:1437 are provided in FIG. 56 and in the Sequence Listing. Such functional homologs include SEQ ID NO:173, SEQ ID NO:212, SEQ ID NO:361, SEQ ID NO:421, SEQ ID NO:443, SEQ ID NO:740, SEQ ID NO:744, SEQ ID NO:942, and SEQ ID NO:1461. In some cases, a functional homolog of SEQ ID NO:1437 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1437.

Examples of amino acid sequences of functional homologs of the polypeptide set forth in SEQ ID NO:97 are provided in FIG. 57 and in the Sequence Listing. Such functional homologs include SEQ ID NO:2010, SEQ ID NO:2011, SEQ ID NO:2013, SEQ ID NO:2015, SEQ ID NO:2017. In some cases, a functional homolog of SEQ ID NO:97 has an amino acid sequence with at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:97.

The identification of conserved regions in a low nitrogen tolerance-modulating polypeptide facilitates production of variants of low nitrogen tolerance-modulating polypeptides. Variants of low nitrogen tolerance-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIGS. 1-57 and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

C. Functional Homologs Identified by HMMER

In some embodiments, useful low nitrogen tolerance-modulating polypeptides include those that fit a Hidden Markov Model based on the polypeptides set forth in any one of FIGS. 1-57. A Hidden Markov Model (HMM) is a statistical model of a consensus sequence for a group of functional homologs. See, Durbin et al. (1998) *Biological Sequence Analysis: Probabilistic Models of Proteins and Nucleic Acids*, Cambridge University Press, Cambridge, UK. An HMM is generated by the program HMMER 2.3.2 with default program parameters, using the sequences of the group of functional homologs as input. The multiple sequence alignment is generated by ProbCons (Do et al. (2005) Genome Res., 15(2):330-40) version 1.11 using a set of default parameters: -c, —consistency REPS of 2; -ir, —iterative-refinement REPS of 100; -pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer janelia.org; hmmer wustl.edu; and fr.com/hmmer232/. Hmmbuild outputs the model as a text file.

The HMM for a group of functional homologs can be used to determine the likelihood that a candidate low nitrogen tolerance-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The low nitrogen tolerance-modulating polypeptides discussed below fit the indicated HMM with an HMM bit score greater than 20 (e.g., greater than 30, 40, 50, 60, 70, 80, 90, 100, 200, 300, 400, or 500). In some embodiments, the HMM bit score of a low nitrogen tolerance-modulating polypeptide discussed below is about 50%, 60%, 70%, 80%, 90%, or 95% of the HMM bit score of a functional homolog provided the Sequence Listing of this application. In some embodiments, a low nitrogen tolerance-modulating polypeptide discussed below fits the indicated HMM with an HMM bit score greater than 20, and has a domain indicative of a low nitrogen tolerance-modulating polypeptide. In some embodiments, a low nitrogen tolerance-modulating polypeptide discussed below fits the indicated HMM with an HMM bit score greater than 20, and has 70% or greater sequence identity (e.g., 75%, 80%, 85%, 90%, 95%, or 100% sequence identity) to an amino acid sequence shown in any one of FIGS. 1-57.

Examples of polypeptides are shown in the sequence listing that have HMM bit scores greater than 800 when fitted to an HMM generated from the amino acid sequences set forth in FIG. 1 are identified in the Sequence Listing of this application. Such polypeptides include SEQ ID NO:3, SEQ ID NO:4, SEQ ID NO:6, SEQ ID NO:8, SEQ ID NO:10, SEQ ID NO:12, SEQ ID NO:14, SEQ ID NO:16, SEQ ID NO:17, SEQ ID NO:19, SEQ ID NO:20, SEQ ID NO:21, SEQ ID NO:22, SEQ ID NO:24, SEQ ID NO:25, SEQ ID NO:27, SEQ ID NO:29, SEQ ID NO:31, SEQ ID NO:33, SEQ ID NO:35, SEQ ID NO:36, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, and SEQ ID NO:47.

Examples of polypeptides are shown in the sequence listing that have HMM bit scores greater than 150 when fitted to an HMM generated from the amino acid sequences set forth in FIG. 2 are identified in the Sequence Listing of this application. Such polypeptides include SEQ ID NO:49, SEQ ID NO:51, SEQ ID NO:53, SEQ ID NO:55, SEQ ID NO:56, SEQ ID NO:58, SEQ ID NO:60, SEQ ID NO:62, SEQ ID NO:63, SEQ ID NO:64, SEQ ID NO:65, SEQ ID NO:67, SEQ ID NO:69, SEQ ID NO:70, SEQ ID NO:71, SEQ ID NO:72, SEQ ID NO:73, and SEQ ID NO:75.

Examples of polypeptides are shown in the sequence listing that have HMM bit scores greater than 540 when fitted to an HMM generated from the amino acid sequences set forth in FIG. 3 are identified in the Sequence Listing of this application. Such polypeptides include SEQ ID NO:77, SEQ ID NO:78, SEQ ID NO:80, SEQ ID NO:82, SEQ ID NO:84, SEQ ID NO:85, SEQ ID NO:87, SEQ ID NO:88, SEQ ID NO:90, SEQ ID NO:92, SEQ ID NO:93, SEQ ID NO:95, and SEQ ID NO:1479.

Examples of polypeptides are shown in the sequence listing that have HMM bit scores greater than 210 when fitted to an HMM generated from the amino acid sequences set forth in FIG. 4 are identified in the Sequence Listing of this application. Such polypeptides include SEQ ID NO:100, SEQ ID NO:101, SEQ ID NO:102, SEQ ID NO:104, SEQ ID NO:106, SEQ ID NO:108, SEQ ID NO:110, SEQ ID NO:111, SEQ ID NO:113, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:125, SEQ ID NO:126, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:137, SEQ ID NO:139, SEQ ID NO:141, SEQ ID NO:142, SEQ ID NO:144, SEQ ID NO:145, SEQ ID NO:146, SEQ ID NO:147, SEQ ID NO:148, SEQ ID NO:149, and SEQ ID NO:150.

Examples of polypeptides are shown in the sequence listing that have HMM bit scores greater than 90 when fitted to an HMM generated from the amino acid sequences set forth in FIG. 5 are identified in the Sequence Listing of this application. Such polypeptides include SEQ ID NO:152, SEQ ID NO:154, SEQ ID NO:156, SEQ ID NO:158, SEQ ID NO:160, SEQ ID NO:162, and SEQ ID NO:164.

Examples of polypeptides are shown in the sequence listing that have HMM bit scores greater than 230 when fitted to an HMM generated from the amino acid sequences set forth in FIG. 6 are identified in the Sequence Listing of this application. Such polypeptides include SEQ ID NO:166, SEQ ID NO:168, SEQ ID NO:170, SEQ ID NO:172, SEQ ID NO:174, SEQ ID NO:177, SEQ ID NO:179, SEQ ID NO:181, SEQ ID NO:182, SEQ ID NO:183, and SEQ ID NO:184.

Examples of polypeptides are shown in the sequence listing that have HMM bit scores greater than 90 when fitted to an HMM generated from the amino acid sequences set forth in FIG. 7 are identified in the Sequence Listing of this application. Such polypeptides include SEQ ID NO:186, SEQ ID NO:188, SEQ ID NO:190, SEQ ID NO:191, SEQ ID NO:193, SEQ ID NO:194, SEQ ID NO:196, SEQ ID NO:197, SEQ ID NO:199, SEQ ID NO:201, SEQ ID NO:203, SEQ ID NO:204, SEQ ID NO:205, and SEQ ID NO:206.

Examples of polypeptides are shown in the sequence listing that have HMM bit scores greater than 380 when fitted to an HMM generated from the amino acid sequences set forth in FIG. 8 are identified in the Sequence Listing of this application. Such polypeptides include SEQ ID NO:208, SEQ ID NO:209, SEQ ID NO:210, SEQ ID NO:214, and SEQ ID NO:216.

Examples of polypeptides are shown in the sequence listing that have HMM bit scores greater than 110 when fitted to an HMM generated from the amino acid sequences set forth in FIG. 9 are identified in the Sequence Listing of this application. Such polypeptides include SEQ ID NO:218, SEQ ID NO:220, SEQ ID NO:222, SEQ ID NO:223, SEQ ID NO:225, SEQ ID NO:227, SEQ ID NO:229, SEQ ID NO:230, SEQ ID NO:231, SEQ ID NO:232, SEQ ID NO:1039, SEQ ID NO:1049, and SEQ ID NO:1052.

Examples of polypeptides are shown in the sequence listing that have HMM bit scores greater than 220 when fitted to an HMM generated from the amino acid sequences set forth in FIG. 10 are identified in the Sequence Listing of this application. Such polypeptides include SEQ ID NO:234, SEQ ID NO:236, SEQ ID NO:238, SEQ ID NO:239, SEQ ID NO:241, SEQ ID NO:242, SEQ ID NO:243, and SEQ ID NO:244.

Examples of polypeptides are shown in the sequence listing that have HMM bit scores greater than 150 when fitted to an HMM generated from the amino acid sequences set forth in FIG. 11 are identified in the Sequence Listing of this application. Such polypeptides include SEQ ID NO:246, SEQ ID NO:248, SEQ ID NO:249, SEQ ID NO:251, SEQ ID NO:253, SEQ ID NO:255, SEQ ID NO:257, SEQ ID NO:259, SEQ ID NO:260, SEQ ID NO:262, SEQ ID NO:264, SEQ ID NO:265, SEQ ID NO:267, SEQ ID NO:268, SEQ ID NO:270, SEQ ID NO:272, SEQ ID NO:274, SEQ ID NO:276, SEQ ID NO:277, SEQ ID NO:279, SEQ ID NO:281, SEQ ID NO:283, SEQ ID NO:285, SEQ ID NO:286, SEQ ID NO:287, SEQ ID NO:288, SEQ ID NO:290, SEQ ID NO:291, SEQ ID NO:292, SEQ ID NO:293, SEQ ID NO:296, and SEQ ID NO:298.

Examples of polypeptides are shown in the sequence listing that have HMM bit scores greater than 950 when fitted to an HMM generated from the amino acid sequences set forth in FIG. 12 are identified in the Sequence Listing of this application. Such polypeptides include SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:319, SEQ ID NO:320, SEQ ID NO:321, SEQ ID NO:322, SEQ ID NO:323, SEQ ID NO:325, SEQ ID NO:327, and SEQ ID NO:329.

Examples of polypeptides are shown in the sequence listing that have HMM bit scores greater than 460 when fitted to an HMM generated from the amino acid sequences set forth in FIG. 13 are identified in the Sequence Listing of this application. Such polypeptides include SEQ ID NO:332, SEQ ID NO:334, SEQ ID NO:335, SEQ ID NO:336, SEQ ID NO:338, SEQ ID NO:339, SEQ ID NO:341, SEQ ID NO:342, SEQ ID NO:343, SEQ ID NO:344, SEQ ID NO:345, SEQ ID NO:346, SEQ ID NO:347, SEQ ID NO:348, SEQ ID NO:349, SEQ ID NO:351, SEQ ID NO:352, SEQ ID NO:353, SEQ ID NO:354, SEQ ID NO:355, SEQ ID NO:356, SEQ ID NO:357, SEQ ID NO:358, SEQ ID NO:359, SEQ ID NO:360, SEQ ID NO:362, SEQ ID NO:363, SEQ ID NO:364, SEQ ID NO:365, SEQ ID NO:366, SEQ ID NO:2541, SEQ ID NO:2542, SEQ ID NO:2543, SEQ ID NO:2544, SEQ ID NO:2546, SEQ ID NO:2548, SEQ ID NO:2549, SEQ ID NO:2550, SEQ ID NO:2551, SEQ ID NO:2552, and SEQ ID NO:2553.

Examples of polypeptides are shown in the sequence listing that have HMM bit scores greater than 150 when fitted to an HMM generated from the amino acid sequences set forth in FIG. 14 are identified in the Sequence Listing of this application. Such polypeptides include SEQ ID NO:368, SEQ ID NO:369, SEQ ID NO:370, SEQ ID NO:371, SEQ ID NO:372, SEQ ID NO:373, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:399, SEQ ID NO:401, SEQ ID NO:403, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:419, SEQ ID NO:420, SEQ ID NO:422, SEQ ID NO:423, SEQ ID NO:425, SEQ ID NO:427, SEQ ID NO:428, SEQ ID NO:430, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:458, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:474, SEQ ID NO:475, SEQ ID NO:477, SEQ ID NO:479, SEQ ID NO:481, SEQ ID NO:483, SEQ ID NO:485, SEQ ID NO:487, SEQ ID NO:488, SEQ ID NO:489, SEQ ID NO:490, SEQ ID NO:491, SEQ ID NO:492, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:502, SEQ ID NO:504, SEQ ID NO:505, SEQ ID NO:506, SEQ ID NO:507, and SEQ ID NO:508.

Examples of polypeptides are shown in the sequence listing that have HMM bit scores greater than 410 when fitted to an HMM generated from the amino acid sequences set forth in FIG. 15 are identified in the Sequence Listing of this application. Such polypeptides include SEQ ID NO:510, SEQ ID NO:511, SEQ ID NO:513, SEQ ID NO:515, SEQ ID NO:517, SEQ ID NO:521, SEQ ID NO:523, SEQ ID NO:525, SEQ ID NO:527, SEQ ID NO:529, SEQ ID NO:530, and SEQ ID NO:531.

Examples of polypeptides are shown in the sequence listing that have HMM bit scores greater than 520 when fitted to an HMM generated from the amino acid sequences set forth in FIG. 16 are identified in the Sequence Listing of this application. Such polypeptides include SEQ ID NO:533, SEQ ID NO:535, SEQ ID NO:536, SEQ ID NO:538, SEQ ID NO:539, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:550, SEQ ID NO:552, SEQ ID NO:553, and SEQ ID NO:554.

Examples of polypeptides are shown in the sequence listing that have HMM bit scores greater than 1150 when fitted to an HMM generated from the amino acid sequences set forth in FIG. 17 are identified in the Sequence Listing of this application. Such polypeptides include SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:569, SEQ ID NO:571, SEQ ID NO:572, SEQ ID NO:573, SEQ ID NO:575, SEQ ID NO:576, SEQ ID NO:577, SEQ ID NO:578, SEQ ID NO:579, SEQ ID NO:581, SEQ ID NO:583, SEQ ID NO:584, SEQ ID NO:585, SEQ ID NO:586, SEQ ID NO:588, SEQ ID NO:589, SEQ ID NO:590, and SEQ ID NO:591.

Examples of polypeptides are shown in the sequence listing that have HMM bit scores greater than 340 when fitted to an HMM generated from the amino acid sequences set forth in FIG. 18 are identified in the Sequence Listing of this application. Such polypeptides include SEQ ID NO:593, SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:610, and SEQ ID NO:611.

Examples of polypeptides are shown in the sequence listing that have HMM bit scores greater than 140 when fitted to an HMM generated from the amino acid sequences set forth in FIG. 19 are identified in the Sequence Listing of this application. Such polypeptides include SEQ ID NO:613, SEQ ID NO:615, SEQ ID NO:617, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:643, and SEQ ID NO:644.

Examples of polypeptides are shown in the sequence listing that have HMM bit scores greater than 250 when fitted to an HMM generated from the amino acid sequences set forth in FIG. 20 are identified in the Sequence Listing of this application. Such polypeptides include SEQ ID NO:646, SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:679, SEQ ID NO:680, SEQ ID NO:681, SEQ ID NO:682, SEQ ID NO:683, and SEQ ID NO:685.

Examples of polypeptides are shown in the sequence listing that have HMM bit scores greater than 170 when fitted to an HMM generated from the amino acid sequences set forth in FIG. 21 are identified in the Sequence Listing of this application. Such polypeptides include SEQ ID NO:687, SEQ ID NO:689, SEQ ID NO:691, SEQ ID NO:693, SEQ ID NO:694, SEQ ID NO:696, SEQ ID NO:697, SEQ ID NO:699, SEQ ID NO:701, SEQ ID NO:703, SEQ ID NO:705, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:721, SEQ ID NO:722, SEQ ID NO:723, SEQ ID NO:724, SEQ ID NO:725, SEQ ID NO:726, SEQ ID NO:727, and SEQ ID NO:728.

Examples of polypeptides are shown in the sequence listing that have HMM bit scores greater than 210 when fitted to an HMM generated from the amino acid sequences set forth in FIG. 22 are identified in the Sequence Listing of this application. Such polypeptides include SEQ ID NO:730, SEQ ID NO:732, SEQ ID NO:733, SEQ ID NO:735, SEQ ID NO:737, SEQ ID NO:738, and SEQ ID NO:742.

Examples of polypeptides are shown in the sequence listing that have HMM bit scores greater than 230 when fitted to an HMM generated from the amino acid sequences set forth in FIG. 23 are identified in the Sequence Listing of this application. Such polypeptides include SEQ ID NO:746, SEQ ID NO:748, SEQ ID NO:750, SEQ ID NO:751, SEQ ID NO:753, SEQ ID NO:755, SEQ ID NO:757, SEQ ID NO:758, SEQ ID NO:760, SEQ ID NO:761, SEQ ID NO:762, SEQ ID NO:763, SEQ ID NO:765, and SEQ ID NO:767.

Examples of polypeptides are shown in the sequence listing that have HMM bit scores greater than 180 when fitted to an HMM generated from the amino acid sequences set forth in FIG. 24 are identified in the Sequence Listing of this application. Such polypeptides include SEQ ID NO:769, SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, and SEQ ID NO:790.

Examples of polypeptides are shown in the sequence listing that have HMM bit scores greater than 300 when fitted to an HMM generated from the amino acid sequences set forth in FIG. 25 are identified in the Sequence Listing of this application. Such polypeptides include SEQ ID NO:792, SEQ ID NO:794, SEQ ID NO:796, SEQ ID NO:798, SEQ ID NO:799, SEQ ID NO:801, SEQ ID NO:803, SEQ ID NO:805, SEQ ID NO:807, SEQ ID NO:808, SEQ ID NO:810, SEQ ID NO:812, SEQ ID NO:814, SEQ ID NO:816, SEQ ID NO:818, SEQ ID NO:819, SEQ ID NO:820, SEQ ID NO:821, and SEQ ID NO:822.

Examples of polypeptides are shown in the sequence listing that have HMM bit scores greater than 190 when fitted to an HMM generated from the amino acid sequences set forth in FIG. 26 are identified in the Sequence Listing of this application. Such polypeptides include SEQ ID NO:824, SEQ ID NO:826, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710, SEQ ID NO:1711, SEQ ID NO:1713, SEQ ID NO:1714, SEQ ID NO:1715, and SEQ ID NO:1716.

Examples of polypeptides are shown in the sequence listing that have HMM bit scores greater than 630 when fitted to an HMM generated from the amino acid sequences set forth in FIG. 27 are identified in the Sequence Listing of this application. Such polypeptides include SEQ ID NO:828, SEQ ID NO:830, SEQ ID NO:832, SEQ ID NO:834, SEQ ID NO:836, SEQ ID NO:837, SEQ ID NO:838, SEQ ID NO:839, SEQ ID NO:840, SEQ ID NO:842, SEQ ID NO:844, SEQ ID NO:845, SEQ ID NO:846, SEQ ID NO:847, SEQ ID NO:848, SEQ ID NO:849, SEQ ID NO:850, and SEQ ID NO:851.

Examples of polypeptides are shown in the sequence listing that have HMM bit scores greater than 95 when fitted to an HMM generated from the amino acid sequences set forth in FIG. 28 are identified in the Sequence Listing of this application. Such polypeptides include SEQ ID NO:855, SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:885, SEQ ID NO:886, SEQ ID NO:887, SEQ ID NO:888, and SEQ ID NO:889.

Examples of polypeptides are shown in the sequence listing that have HMM bit scores greater than 850 when fitted to an HMM generated from the amino acid sequences set forth in FIG. 29 are identified in the Sequence Listing of this application. Such polypeptides include SEQ ID NO:891, SEQ ID NO:893, SEQ ID NO:894, SEQ ID NO:895, SEQ ID NO:896, SEQ ID NO:898, SEQ ID NO:900, SEQ ID NO:901, SEQ ID NO:902, SEQ ID NO:903, SEQ ID NO:904, SEQ ID NO:905, SEQ ID NO:907, SEQ ID NO:908, SEQ ID NO:909, SEQ ID NO:910, SEQ ID NO:911, SEQ ID NO:912, SEQ ID NO:913, SEQ ID NO:914, and SEQ ID NO:915.

Examples of polypeptides are shown in the sequence listing that have HMM bit scores greater than 300 when fitted to an HMM generated from the amino acid sequences set forth in FIG. 30 are identified in the Sequence Listing of this application. Such polypeptides include SEQ ID NO:917, SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, and SEQ ID NO:940.

Examples of polypeptides are shown in the sequence listing that have HMM bit scores greater than 60 when fitted to an HMM generated from the amino acid sequences set forth in FIG. 31 are identified in the Sequence Listing of this application. Such polypeptides include SEQ ID NO:944, SEQ ID NO:946, SEQ ID NO:947, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:967, SEQ ID NO:968, SEQ ID NO:969, SEQ ID NO:970, SEQ ID NO:972, and SEQ ID NO:974.

Examples of polypeptides are shown in the sequence listing that have HMM bit scores greater than 340 when fitted to an HMM generated from the amino acid sequences set forth in FIG. 32 are identified in the Sequence Listing of this application. Such polypeptides include SEQ ID NO:976, SEQ ID NO:978, and SEQ ID NO:980.

Examples of polypeptides are shown in the sequence listing that have HMM bit scores greater than 180 when fitted to an HMM generated from the amino acid sequences set forth in FIG. 33 are identified in the Sequence Listing of this application. Such polypeptides include SEQ ID NO:982, SEQ ID NO:984, SEQ ID NO:985, SEQ ID NO:986, SEQ ID NO:987, SEQ ID NO:988, SEQ ID NO:989, SEQ ID NO:990, SEQ ID NO:991, SEQ ID NO:992, SEQ ID NO:993, SEQ ID NO:995, SEQ ID NO:996, SEQ ID NO:998, SEQ ID NO:1000, SEQ ID NO:1001, SEQ ID NO:1003, SEQ ID NO:1005, SEQ ID NO:1007, SEQ ID NO:1008, SEQ ID NO:1009, SEQ ID NO:1011, SEQ ID NO:1013, SEQ ID NO:1015, SEQ ID NO:1016, SEQ ID NO:1018, SEQ ID NO:1019, SEQ ID NO:1021, SEQ ID NO:1023, SEQ ID NO:1025, SEQ ID NO:1026, SEQ ID NO:1027, SEQ ID NO:1028, SEQ ID NO:1029, SEQ ID NO:1030, SEQ ID NO:1031, SEQ ID NO:1032, and SEQ ID NO:1033.

Examples of polypeptides are shown in the sequence listing that have HMM bit scores greater than 1060 when fitted to an HMM generated from the amino acid sequences set forth in FIG. 34 are identified in the Sequence Listing of this application. Such polypeptides include SEQ ID NO:1054, SEQ ID NO:1055, SEQ ID NO:1057, SEQ ID NO:1058, SEQ ID NO:1059, SEQ ID NO:1061, SEQ ID NO:1063, SEQ ID NO:1065, SEQ ID NO:1065, SEQ ID NO:1067, SEQ ID NO:1068, SEQ ID NO:1070, SEQ ID NO:1071, SEQ ID NO:1072, SEQ ID NO:1074, SEQ ID NO:1075, SEQ ID NO:1076, SEQ ID NO:1077, SEQ ID NO:1078, SEQ ID NO:1080, SEQ ID NO:1082, SEQ ID NO:1083, SEQ ID NO:1085, SEQ ID NO:1086, SEQ ID NO:1087, SEQ ID NO:1088, SEQ ID NO:1089, SEQ ID NO:1089, SEQ ID NO:1090, SEQ ID NO:1091, SEQ ID NO:1092, SEQ ID NO:1093, SEQ ID NO:1094, SEQ ID NO:1095, and SEQ ID NO:1097.

Examples of polypeptides are shown in the sequence listing that have HMM bit scores greater than 260 when fitted to an HMM generated from the amino acid sequences set forth in FIG. 35 are identified in the Sequence Listing of this application. Such polypeptides include SEQ ID NO:1099, SEQ ID NO:1101, SEQ ID NO:1103, SEQ ID NO:1104, SEQ ID NO:1105, SEQ ID NO:1106, SEQ ID NO:1108, SEQ ID NO:1109, and SEQ ID NO:1110.

Examples of polypeptides are shown in the sequence listing that have HMM bit scores greater than 150 when fitted to an HMM generated from the amino acid sequences set forth in FIG. 36 are identified in the Sequence Listing of this application. Such polypeptides include SEQ ID NO:1112, SEQ ID NO:1113, and SEQ ID NO:1114.

Examples of polypeptides are shown in the sequence listing that have HMM bit scores greater than 40 when fitted to an HMM generated from the amino acid sequences set forth in FIG. 37 are identified in the Sequence Listing of this application. Such polypeptides include SEQ ID NO:1116, SEQ ID NO:1118, SEQ ID NO:1120, SEQ ID NO:1122, SEQ ID NO:1123, SEQ ID NO:1125, SEQ ID NO:1126, SEQ ID NO:1128, SEQ ID NO:1129, SEQ ID NO:1131, SEQ ID NO:1132, SEQ ID NO:1133, SEQ ID NO:1134, SEQ ID NO:1136, SEQ ID NO:1138, SEQ ID NO:1140, SEQ ID NO:1141, SEQ ID NO:1142, SEQ ID NO:1143, SEQ ID NO:1144, SEQ ID NO:1145, SEQ ID NO:1147, SEQ ID NO:1149, SEQ ID NO:1151, SEQ ID NO:1153, and SEQ ID NO:1155.

Examples of polypeptides are shown in the sequence listing that have HMM bit scores greater than 450 when fitted to an HMM generated from the amino acid sequences set forth in FIG. 38 are identified in the Sequence Listing of this application. Such polypeptides include SEQ ID NO:1159, SEQ ID NO:1161, SEQ ID NO:1162, SEQ ID NO:1163, and SEQ ID NO:1164.

Examples of polypeptides are shown in the sequence listing that have HMM bit scores greater than 160 when fitted to an HMM generated from the amino acid sequences set forth in FIG. 39 are identified in the Sequence Listing of this application. Such polypeptides include SEQ ID NO:1166, SEQ ID NO:1167, SEQ ID NO:1169, SEQ ID NO:1171, SEQ ID NO:1173, SEQ ID NO:1175, SEQ ID NO:1177, SEQ ID NO:1179, SEQ ID NO:1180, SEQ ID NO:1182, and SEQ ID NO:1183.

Examples of polypeptides are shown in the sequence listing that have HMM bit scores greater than 180 when fitted to an HMM generated from the amino acid sequences set forth in FIG. 40 are identified in the Sequence Listing of this application. Such polypeptides include SEQ ID NO:1185, SEQ ID NO:1187, SEQ ID NO:1189, SEQ ID NO:1190, SEQ ID NO:1191, and SEQ ID NO:1192.

Examples of polypeptides are shown in the sequence listing that have HMM bit scores greater than 670 when fitted to an HMM generated from the amino acid sequences set forth in FIG. 41 are identified in the Sequence Listing of this application. Such polypeptides include SEQ ID NO:1194, SEQ ID NO:1196, SEQ ID NO:1198, SEQ ID NO:1200, SEQ ID NO:1202, SEQ ID NO:1203, SEQ ID NO:1204, SEQ ID NO:1205, SEQ ID NO:1206, SEQ ID NO:1207, and SEQ ID NO:1208.

Examples of polypeptides are shown in the sequence listing that have HMM bit scores greater than 280 when fitted to an HMM generated from the amino acid sequences set forth in FIG. 42 are identified in the Sequence Listing of this application. Such polypeptides include SEQ ID NO:1210, SEQ ID NO:1211, SEQ ID NO:1213, SEQ ID NO:1215, SEQ ID NO:1216, SEQ ID NO:1218, SEQ ID NO:1220, SEQ ID NO:1222, SEQ ID NO:1224, SEQ ID NO:1226, SEQ ID NO:1228, SEQ ID NO:1229, SEQ ID NO:1230, SEQ ID NO:1232, SEQ ID NO:1233, SEQ ID NO:1234, SEQ ID NO:1235, SEQ ID NO:1236, SEQ ID NO:1237, SEQ ID NO:1238, SEQ ID NO:1239, SEQ ID NO:1240, SEQ ID NO:1241, SEQ ID NO:1242, SEQ ID NO:1243, SEQ ID NO:1244, SEQ ID NO:1245, SEQ ID NO:1246, SEQ ID NO:1247, SEQ ID NO:1248, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1264, SEQ ID NO:1265, SEQ ID NO:1266, SEQ ID NO:1267, SEQ ID NO:1268, SEQ ID NO:1269, SEQ ID NO:1270, SEQ ID NO:1271, and SEQ ID NO:1272.

Examples of polypeptides are shown in the sequence listing that have HMM bit scores greater than 700 when fitted to an HMM generated from the amino acid sequences set forth in FIG. 43 are identified in the Sequence Listing of this application. Such polypeptides include SEQ ID NO:1274, SEQ ID NO:1276, SEQ ID NO:1278, SEQ ID NO:1280, SEQ ID NO:1281, SEQ ID NO:1282, SEQ ID NO:1284, SEQ ID NO:1285, SEQ ID NO:1287, SEQ ID NO:1289, SEQ ID NO:1291, SEQ ID NO:1293, SEQ ID NO:1294, SEQ ID NO:1295, SEQ ID NO:1296, SEQ ID NO:1297, SEQ ID NO:1298, and SEQ ID NO:1300.

Examples of polypeptides are shown in the sequence listing that have HMM bit scores greater than 920 when fitted to an HMM generated from the amino acid sequences set forth in FIG. 44 are identified in the Sequence Listing of this application. Such polypeptides include SEQ ID NO:1302, SEQ ID NO:1303, SEQ ID NO:1305, SEQ ID NO:1307, SEQ ID NO:1309, SEQ ID NO:1311, SEQ ID NO:1312, SEQ ID NO:1313, SEQ ID NO:1314, SEQ ID NO:1315, SEQ ID NO:1317, SEQ ID NO:1318, SEQ ID NO:1319, SEQ ID NO:1320, SEQ ID NO:1321, SEQ ID NO:1322, SEQ ID NO:1323, SEQ ID NO:1324, SEQ ID NO:1325, SEQ ID NO:1326, SEQ ID NO:1327, SEQ ID NO:1328, SEQ ID NO:1330, SEQ ID NO:1331, SEQ ID NO:1333, SEQ ID NO:1334, SEQ ID NO:1335, SEQ ID NO:1336, SEQ ID NO:1337, SEQ ID NO:1338, SEQ ID NO:1339, and SEQ ID NO:1340.

Examples of polypeptides are shown in the sequence listing that have HMM bit scores greater than 510 when fitted to an HMM generated from the amino acid sequences set forth in FIG. 45 are identified in the Sequence Listing of this application. Such polypeptides include SEQ ID NO:1342, SEQ ID NO:1344, SEQ ID NO:1346, SEQ ID NO:1348, SEQ ID NO:1350, SEQ ID NO:1352, SEQ ID NO:1354, SEQ ID NO:1355, SEQ ID NO:1357, SEQ ID NO:1358, SEQ ID NO:1360, SEQ ID NO:1361, SEQ ID NO:1362, SEQ ID NO:1363, SEQ ID NO:1364, SEQ ID NO:1366, SEQ ID NO:1367, SEQ ID NO:1369, SEQ ID NO:1370, SEQ ID NO:1371, SEQ ID NO:1372, SEQ ID NO:1373, SEQ ID NO:1374, SEQ ID NO:1375, SEQ ID NO:1376, SEQ ID NO:1377, SEQ ID NO:1378, SEQ ID NO:1379, SEQ ID NO:1380, SEQ ID NO:1381, SEQ ID NO:1382, and SEQ ID NO:1383.

Examples of polypeptides are shown in the sequence listing that have HMM bit scores greater than 140 when fitted to an HMM generated from the amino acid sequences set forth in FIG. 46 are identified in the Sequence Listing of this application. Such polypeptides include SEQ ID NO:1385, SEQ ID NO:1387, SEQ ID NO:1389, SEQ ID NO:1390, SEQ ID NO:1391, SEQ ID NO:1393, SEQ ID NO:1394, SEQ ID NO:1395, SEQ ID NO:1396, SEQ ID NO:1398, SEQ ID NO:1400, SEQ ID NO:1401, SEQ ID NO:1402, SEQ ID NO:1403, SEQ ID NO:1404, SEQ ID NO:1405, and SEQ ID NO:1407.

Examples of polypeptides are shown in the sequence listing that have HMM bit scores greater than 150 when fitted to an HMM generated from the amino acid sequences set forth in FIG. 47 are identified in the Sequence Listing of this application. Such polypeptides include SEQ ID NO:1409, SEQ ID NO:1411, SEQ ID NO:1413, SEQ ID NO:1415, SEQ ID NO:1417, SEQ ID NO:1418, SEQ ID NO:1419, SEQ ID NO:1421, SEQ ID NO:1423, SEQ ID NO:1424, SEQ ID NO:1425, SEQ ID NO:1426.

Examples of polypeptides are shown in the sequence listing that have HMM bit scores greater than 190 when fitted to an HMM generated from the amino acid sequences set forth in FIG. 48 are identified in the Sequence Listing of this application. Such polypeptides include SEQ ID NO:1428, SEQ ID NO:1430, SEQ ID NO:1432, SEQ ID NO:1434, SEQ ID NO:1436, SEQ ID NO:1439, SEQ ID NO:1442, SEQ ID NO:1444, SEQ ID NO:1446, SEQ ID NO:1448, SEQ ID NO:1450, SEQ ID NO:1452, SEQ ID NO:1453, SEQ ID NO:1454, SEQ ID NO:1455, SEQ ID NO:1456, SEQ ID NO:1457, SEQ ID NO:1458, and SEQ ID NO:1459.

Examples of polypeptides are shown in the sequence listing that have HMM bit scores greater than 450 when fitted to an HMM generated from the amino acid sequences set forth in FIG. 49 are identified in the Sequence Listing of this application. Such polypeptides include SEQ ID NO:1463, SEQ ID NO:1465, SEQ ID NO:1467, SEQ ID NO:1469, SEQ ID NO:1471, SEQ ID NO:1473, SEQ ID NO:1474, SEQ ID NO:1475, SEQ ID NO:1476, and SEQ ID NO:1477.

Examples of polypeptides are shown in the sequence listing that have HMM bit scores greater than 580 when fitted to an HMM generated from the amino acid sequences set forth in FIG. 50 are identified in the Sequence Listing of this application. Such polypeptides include SEQ ID NO:1491, SEQ ID NO:1493, SEQ ID NO:1495, SEQ ID NO:1497, SEQ ID NO:1499, SEQ ID NO:1501, SEQ ID NO:1503, SEQ ID NO:1504, SEQ ID NO:1505, SEQ ID NO:1506, and SEQ ID NO:1508.

Examples of polypeptides are shown in the sequence listing that have HMM bit scores greater than 100 when fitted to an HMM generated from the amino acid sequences set forth in FIG. 51 are identified in the Sequence Listing of this application. Such polypeptides include SEQ ID NO:1510, SEQ ID NO:1512, SEQ ID NO:1514, SEQ ID NO:1516, SEQ ID NO:1518, SEQ ID NO:1520, SEQ ID NO:1522, and SEQ ID NO:1523.

Examples of polypeptides are shown in the sequence listing that have HMM bit scores greater than 800 when fitted to an HMM generated from the amino acid sequences set forth in FIG. 52 are identified in the Sequence Listing of this application. Such polypeptides include SEQ ID NO:1525, SEQ ID NO:1527, SEQ ID NO:1529, SEQ ID NO:1530, SEQ ID NO:1532, SEQ ID NO:1534, and SEQ ID NO:1535.

Examples of polypeptides are shown in the sequence listing that have HMM bit scores greater than 490 when fitted to an HMM generated from the amino acid sequences set forth in FIG. 53 are identified in the Sequence Listing of this application. Such polypeptides include SEQ ID NO:1537, SEQ ID NO:1539, SEQ ID NO:1540, SEQ ID NO:1541, SEQ ID NO:1543, SEQ ID NO:1545, SEQ ID NO:1547, SEQ ID NO:1548, SEQ ID NO:1550, SEQ ID NO:1552, SEQ ID NO:2386, SEQ ID NO:2388, SEQ ID NO:2390, SEQ ID NO:2391, and SEQ ID NO:2392.

Examples of polypeptides are shown in the sequence listing that have HMM bit scores greater than 690 when fitted to an HMM generated from the amino acid sequences set forth in FIG. 54 are identified in the Sequence Listing of this application. Such polypeptides include SEQ ID NO:1554, SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1571, SEQ ID NO:1572, SEQ ID NO:1573, SEQ ID NO:1574, and SEQ ID NO:1575.

Examples of polypeptides are shown in the sequence listing that have HMM bit scores greater than 380 when fitted to an HMM generated from the amino acid sequences set forth in FIG. 55 are identified in the Sequence Listing of this application. Such polypeptides include SEQ ID NO:1035, SEQ ID NO:1036, SEQ ID NO:1037, SEQ ID NO:1040, SEQ ID NO:1041, SEQ ID NO:1043, SEQ ID NO:1044, SEQ ID NO:1046, SEQ ID NO:1047, SEQ ID NO:1048, SEQ ID NO:1050, SEQ ID NO:1440, SEQ ID NO:1480, SEQ ID NO:1481, SEQ ID NO:1482, SEQ ID NO:1483, SEQ ID NO:1484, SEQ ID NO:1485, SEQ ID NO:1486, SEQ ID NO:1487, SEQ ID NO:1488, SEQ ID NO:1577, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1596, SEQ ID NO:1598, SEQ ID NO:1599, SEQ ID NO:1601, SEQ ID NO:1602, SEQ ID NO:1605, SEQ ID NO:1607, SEQ ID NO:1608, SEQ ID NO:1609, SEQ ID NO:1611, SEQ ID NO:1613, SEQ ID NO:1615, SEQ ID NO:1617, SEQ ID NO:1619, SEQ ID NO:1621, SEQ ID NO:1622, SEQ ID NO:1623, SEQ ID NO:1624, SEQ ID NO:1625, SEQ ID NO:1627, SEQ ID NO:1629, SEQ ID NO:1631, SEQ ID NO:1633, SEQ ID NO:1635, SEQ ID NO:1637, SEQ ID NO:1639, SEQ ID NO:1643, SEQ ID NO:1645, SEQ ID NO:1648, SEQ ID NO:1649, SEQ ID NO:1651, and SEQ ID NO:1653.

Examples of polypeptides are shown in the sequence listing that have HMM bit scores greater than 870 when fitted to an HMM generated from the amino acid sequences set forth in FIG. 56 are identified in the Sequence Listing of this application. Such polypeptides include SEQ ID NO:173, SEQ ID NO:212, SEQ ID NO:361, SEQ ID NO:421, SEQ ID NO:443, SEQ ID NO:740, SEQ ID NO:744, SEQ ID NO:942, SEQ ID NO:1437, and SEQ ID NO:1461.

Examples of polypeptides are shown in the sequence listing that have HMM bit scores greater than 140 when fitted to an HMM generated from the amino acid sequences set forth in FIG. 57 are identified in the Sequence Listing of this application. Such polypeptides include SEQ ID NO:97, SEQ ID NO:2010, SEQ ID NO:2011, SEQ ID NO:2013, SEQ ID NO:2015, and SEQ ID NO:2017.

D. Percent Identity

In some embodiments, a low nitrogen tolerance-modulating polypeptide has an amino acid sequence with at least 20% sequence identity, e.g., at least 50%, 52%, 56%, 59%, 61%, 65%, 70%, 75%, 80%, 85%, 90%, 95%, 97%, 98%, or 99% sequence identity, to one of the amino acid sequences set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, and SEQ ID NO:1577. Polypeptides having such a percent sequence identity often have a domain indicative of a low nitrogen tolerance-modulating polypeptide and/or have an HMM bit score that is greater than 20, as discussed above. Amino acid sequences of low nitrogen tolerance-modulating polypeptides having at least 20% sequence identity to one of the amino acid sequences set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, and SEQ ID NO:1577 are provided in FIGS. 1-57 and in the Sequence Listing.

"Percent sequence identity" refers to the degree of sequence identity between any given reference sequence, e.g., SEQ ID NO:3, and a candidate low nitrogen tolerance-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al. (2003) *Nucleic Acids Res.*, 31(13): 3497-500.

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a low nitrogen tolerance-modulating polypeptide has an amino acid sequence with sequence similarity to the amino acid sequence set forth in SEQ ID NO:3, and preferably has at least 20% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 3 Amino acid sequences of polypeptides having greater than 20% sequence identity to the polypeptide set forth in SEQ ID NO:3 are provided in FIG. 1 and in the Sequence Listing. Examples of such polypeptides include SEQ ID NO:4, SEQ ID NO:6, SEQ ID NO:8, SEQ ID NO:10, SEQ ID NO:12, SEQ ID NO:14, SEQ ID NO:16, SEQ ID NO:17, SEQ ID NO:19, SEQ ID NO:20, SEQ ID NO:21, SEQ ID NO:22, SEQ ID NO:24, SEQ ID NO:25, SEQ ID NO:27, SEQ ID NO:29, SEQ ID NO:31, SEQ ID NO:33, SEQ ID NO:35, SEQ ID NO:36, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, and SEQ ID NO:47.

In some cases, a low nitrogen tolerance-modulating polypeptide has an amino acid sequence with sequence similarity to the amino acid sequence set forth in SEQ ID NO:49, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:49 Amino acid sequences of polypeptides having greater than 45% sequence identity to the polypeptide set forth in SEQ ID NO:49 are provided in FIG. 2 and in the Sequence Listing. Examples of such polypeptides include SEQ ID NO:51, SEQ ID NO:53, SEQ ID NO:55, SEQ ID NO:56, SEQ ID NO:58, SEQ ID NO:60, SEQ ID NO:62, SEQ ID NO:63, SEQ ID NO:64, SEQ ID NO:65, SEQ ID NO:67, SEQ ID NO:69, SEQ ID NO:70, SEQ ID NO:71, SEQ ID NO:72, SEQ ID NO:73, and SEQ ID NO:75.

In some cases, a low nitrogen tolerance-modulating polypeptide has an amino acid sequence with sequence similarity to the amino acid sequence set forth in SEQ ID NO:77, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:77 Amino acid sequences of polypeptides having greater than 45% sequence identity to the polypeptide set forth in SEQ ID NO:77 are provided in FIG. 3 and in the Sequence Listing. Examples of such polypeptides include SEQ ID NO:78, SEQ ID NO:80, SEQ ID NO:82, SEQ ID NO:84, SEQ ID NO:85, SEQ ID NO:87, SEQ ID NO:88, SEQ ID NO:90, SEQ ID NO:92, SEQ ID NO:93, SEQ ID NO:95, SEQ ID NO:1479.

In some cases, a low nitrogen tolerance-modulating polypeptide has an amino acid sequence with sequence similarity to the amino acid sequence set forth in SEQ ID NO:100, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:100. Amino acid sequences of polypeptides having greater than 45% sequence identity to the polypeptide set forth in SEQ ID NO: 100 are provided in FIG. 4 and in the Sequence Listing. Examples of such polypeptides include SEQ ID NO:101, SEQ ID NO:102, SEQ ID NO:104, SEQ ID NO:106, SEQ ID NO:108, SEQ ID NO:110, SEQ ID NO:111, SEQ ID NO:113, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:125, SEQ ID NO:126, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:137, SEQ ID NO:139, SEQ ID NO:141, SEQ ID NO:142, SEQ ID NO:144, SEQ ID NO:145, SEQ ID NO:146, SEQ ID NO:147, SEQ ID NO:148, SEQ ID NO:149, and SEQ ID NO:150.

In some cases, a low nitrogen tolerance-modulating polypeptide has an amino acid sequence with sequence similarity to the amino acid sequence set forth in SEQ ID NO:152, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:152. Amino acid sequences of polypeptides having greater than 45% sequence identity to the polypeptide set forth in SEQ ID NO:152 are provided in FIG. 5 and in the Sequence Listing. Examples of such polypeptides include SEQ ID NO:154, SEQ ID NO:156, SEQ ID NO:158, SEQ ID NO:160, SEQ ID NO:162, and SEQ ID NO:164.

In some cases, a low nitrogen tolerance-modulating polypeptide has an amino acid sequence with sequence similarity to the amino acid sequence set forth in SEQ ID NO:166, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:166. Amino acid sequences of polypeptides having greater than 45% sequence identity to the polypeptide set forth in SEQ ID NO:166 are provided in FIG. 6 and in the Sequence Listing. Examples of such polypeptides include SEQ ID NO:166, SEQ ID NO:168, SEQ ID NO:170, SEQ ID NO:172, SEQ ID NO:174, SEQ ID NO:177, SEQ ID NO:179, SEQ ID NO:181, SEQ ID NO:182, SEQ ID NO:183, SEQ ID NO:184.

In some cases, a low nitrogen tolerance-modulating polypeptide has an amino acid sequence with sequence similarity to the amino acid sequence set forth in SEQ ID NO:186, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:186. Amino acid sequences of polypeptides having greater than 45% sequence identity to the polypeptide set forth in SEQ ID NO:186 are provided in FIG. 7 and in the Sequence Listing. Examples of such polypeptides include SEQ ID NO:188, SEQ ID NO:190, SEQ ID NO:191, SEQ ID NO:193, SEQ ID NO:194, SEQ ID NO:196, SEQ ID NO:197, SEQ ID NO:199, SEQ ID NO:201, SEQ ID NO:203, SEQ ID NO:204, SEQ ID NO:205, and SEQ ID NO:206.

In some cases, a low nitrogen tolerance-modulating polypeptide has an amino acid sequence with sequence similarity to the amino acid sequence set forth in SEQ ID NO:208, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:208. Amino acid sequences of polypeptides having greater than 45% sequence identity to the polypeptide set forth in SEQ ID NO:208 are provided in FIG. 8 and in the Sequence Listing. Examples of such polypeptides include SEQ ID NO:209, SEQ ID NO:210, SEQ ID NO:214, and SEQ ID NO:216.

In some cases, a low nitrogen tolerance-modulating polypeptide has an amino acid sequence with sequence similarity to the amino acid sequence set forth in SEQ ID NO:218, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:218. Amino acid sequences of polypeptides having greater than 45% sequence identity to the polypeptide set forth in SEQ ID NO:218 are provided in FIG. 9 and in the Sequence Listing. Examples of such polypeptides include SEQ ID NO:218, SEQ ID NO:220, SEQ ID NO:222, SEQ ID NO:223, SEQ ID NO:225, SEQ ID NO:227, SEQ ID NO:229, SEQ ID NO:230, SEQ ID NO:231, SEQ ID NO:232, SEQ ID NO:1039, SEQ ID NO:1049, and SEQ ID NO:1052.

In some cases, a low nitrogen tolerance-modulating polypeptide has an amino acid sequence with sequence similarity to the amino acid sequence set forth in SEQ ID NO:234, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:234. Amino acid sequences of polypeptides having greater than 45% sequence identity to the polypeptide set forth in SEQ ID NO:234 are provided in FIG. 10 and in the Sequence Listing. Examples of such polypeptides include SEQ ID NO:236, SEQ ID NO:238, SEQ ID NO:239, SEQ ID NO:241, SEQ ID NO:242, SEQ ID NO:243, and SEQ ID NO:244.

In some cases, a low nitrogen tolerance-modulating polypeptide has an amino acid sequence with sequence similarity to the amino acid sequence set forth in SEQ ID NO:246, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:246. Amino acid sequences of polypeptides having greater than 45% sequence identity to the polypeptide set forth in SEQ ID NO:246 are provided in FIG. 11 and in the Sequence Listing. Examples of such polypeptides include SEQ ID NO:248, SEQ ID NO:249, SEQ ID NO:251, SEQ ID NO:253, SEQ ID NO:255, SEQ ID NO:257, SEQ ID NO:259, SEQ ID NO:260, SEQ ID NO:262, SEQ ID NO:264, SEQ ID NO:265, SEQ ID NO:267, SEQ ID NO:268, SEQ ID NO:270, SEQ ID NO:272, SEQ ID NO:274, SEQ ID NO:276, SEQ ID NO:277, SEQ ID NO:279, SEQ ID NO:281, SEQ ID NO:283, SEQ ID NO:285, SEQ ID NO:286, SEQ ID NO:287, SEQ ID NO:288, SEQ ID NO:290, SEQ ID NO:291, SEQ ID NO:292, SEQ ID NO:293, SEQ ID NO:296, and SEQ ID NO:298.

In some cases, a low nitrogen tolerance-modulating polypeptide has an amino acid sequence with sequence similarity to the amino acid sequence set forth in SEQ ID NO:300, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:300. Amino acid sequences of polypeptides having greater than 45% sequence identity to the polypeptide set forth in SEQ ID NO:300 are provided in FIG. 12 and in the Sequence Listing. Examples of such polypeptides include SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:319, SEQ ID NO:320, SEQ ID NO:321, SEQ ID NO:322, SEQ ID NO:323, SEQ ID NO:325, SEQ ID NO:327, and SEQ ID NO:329.

In some cases, a low nitrogen tolerance-modulating polypeptide has an amino acid sequence with sequence similarity to the amino acid sequence set forth in SEQ ID NO:332, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:332. Amino acid sequences of polypeptides having greater than 45% sequence identity to the polypeptide set forth in SEQ ID NO:332 are provided in FIG. 13 and in the Sequence Listing. Examples of such polypeptides include SEQ ID NO:332, SEQ ID NO:334, SEQ ID NO:335, SEQ ID NO:336, SEQ ID NO:338, SEQ ID NO:339, SEQ ID NO:341, SEQ ID NO:342, SEQ ID NO:343, SEQ ID NO:344, SEQ ID NO:345, SEQ ID NO:346, SEQ ID NO:347, SEQ ID NO:348, SEQ ID NO:349, SEQ ID NO:351, SEQ ID NO:352, SEQ ID NO:353, SEQ ID NO:354, SEQ ID NO:355, SEQ ID NO:356, SEQ ID NO:357, SEQ ID NO:358, SEQ ID NO:359, SEQ ID NO:360, SEQ ID NO:362, SEQ ID NO:363, SEQ ID NO:364, SEQ ID NO:365, SEQ ID NO:366, SEQ ID NO:2541, SEQ ID NO:2542, SEQ ID NO:2543, SEQ ID NO:2544, SEQ ID NO:2546, SEQ ID NO:2548, SEQ ID NO:2549, SEQ ID NO:2550, SEQ ID NO:2551, SEQ ID NO:2552, and SEQ ID NO:2553.

In some cases, a low nitrogen tolerance-modulating polypeptide has an amino acid sequence with sequence similarity to the amino acid sequence set forth in SEQ ID NO:368, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:368. Amino acid sequences of polypeptides having greater than 45% sequence identity to the polypeptide set forth in SEQ ID NO:368 are provided in FIG. 14 and in the Sequence Listing. Examples of such polypeptides include SEQ ID NO:369, SEQ ID NO:370, SEQ ID NO:371, SEQ ID NO:372, SEQ ID NO:373, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:399, SEQ ID NO:401, SEQ ID NO:403, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:419, SEQ ID NO:420, SEQ ID NO:422, SEQ ID NO:423, SEQ ID NO:425, SEQ ID NO:427, SEQ ID NO:428, SEQ ID NO:430, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:458, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:474, SEQ ID NO:475, SEQ ID NO:477, SEQ ID NO:479, SEQ ID NO:481, SEQ ID NO:483, SEQ ID NO:485, SEQ ID NO:487, SEQ ID NO:488, SEQ ID NO:489, SEQ ID NO:490, SEQ ID NO:491, SEQ ID NO:492, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:502, SEQ ID NO:504, SEQ ID NO:505, SEQ ID NO:506, SEQ ID NO:507, and SEQ ID NO:508.

In some cases, a low nitrogen tolerance-modulating polypeptide has an amino acid sequence with sequence similarity to the amino acid sequence set forth in SEQ ID NO:510, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:510. Amino acid sequences of polypeptides having greater than 45% sequence identity to the polypeptide set forth in SEQ ID NO:510 are provided in FIG. 15 and in the Sequence Listing. Examples of such polypeptides include SEQ ID NO:511, SEQ ID NO:513, SEQ ID NO:515, SEQ ID NO:517, SEQ ID NO:521, SEQ ID NO:523, SEQ ID NO:525, SEQ ID NO:527, SEQ ID NO:529, SEQ ID NO:530, and SEQ ID NO:531.

In some cases, a low nitrogen tolerance-modulating polypeptide has an amino acid sequence with sequence similarity to the amino acid sequence set forth in SEQ ID NO:533, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:533. Amino acid sequences of polypeptides having greater than 45% sequence identity to the polypeptide set forth in SEQ ID NO:533 are provided in FIG. 16 and in the Sequence Listing. Examples of such polypeptides include SEQ ID NO:535, SEQ ID NO:536, SEQ ID NO:538, SEQ ID NO:539, SEQ ID NO:541, SEQ ID NO:542, SEQ ID NO:543, SEQ ID NO:544, SEQ ID NO:545, SEQ ID NO:546, SEQ ID NO:547, SEQ ID NO:548, SEQ ID NO:550, SEQ ID NO:552, SEQ ID NO:553, and SEQ ID NO:554.

In some cases, a low nitrogen tolerance-modulating polypeptide has an amino acid sequence with sequence similarity to the amino acid sequence set forth in SEQ ID NO:558, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:558. Amino acid sequences of polypeptides having greater than 45% sequence identity to the polypeptide set forth in SEQ ID NO:558 are provided in FIG. 17 and in the Sequence Listing. Examples of such polypeptides include SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:569, SEQ ID NO:571, SEQ ID NO:572, SEQ ID NO:573, SEQ ID NO:575, SEQ ID NO:576, SEQ ID NO:577, SEQ ID NO:578, SEQ ID NO:579, SEQ ID NO:581, SEQ ID NO:583, SEQ ID NO:584, SEQ ID NO:585, SEQ ID NO:586, SEQ ID NO:588, SEQ ID NO:589, SEQ ID NO:590, and SEQ ID NO:591.

In some cases, a low nitrogen tolerance-modulating polypeptide has an amino acid sequence with sequence similarity to the amino acid sequence set forth in SEQ ID NO:593, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:593. Amino acid sequences of polypeptides having greater than 45% sequence identity to the polypeptide set forth in SEQ ID NO:593 are provided in FIG. 18 and in the Sequence Listing. Examples of such polypeptides include SEQ ID NO:595, SEQ ID NO:597, SEQ ID NO:599, SEQ ID NO:601, SEQ ID NO:603, SEQ ID NO:605, SEQ ID NO:607, SEQ ID NO:609, SEQ ID NO:610, and SEQ ID NO:611.

In some cases, a low nitrogen tolerance-modulating polypeptide has an amino acid sequence with sequence similarity to the amino acid sequence set forth in SEQ ID NO:613, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:613. Amino acid sequences of polypeptides having greater than 45% sequence identity to the polypeptide set forth in SEQ ID NO:613 are provided in FIG. 19 and in the Sequence Listing. Examples of such polypeptides include SEQ ID NO:615, SEQ ID NO:617, SEQ ID NO:618, SEQ ID NO:620, SEQ ID NO:622, SEQ ID NO:624, SEQ ID NO:626, SEQ ID NO:628, SEQ ID NO:630, SEQ ID NO:632, SEQ ID NO:634, SEQ ID NO:636, SEQ ID NO:638, SEQ ID NO:640, SEQ ID NO:642, SEQ ID NO:643, and SEQ ID NO:644.

In some cases, a low nitrogen tolerance-modulating polypeptide has an amino acid sequence with sequence similarity to the amino acid sequence set forth in SEQ ID NO:646, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:646. Amino acid sequences of polypeptides having greater than 45% sequence identity to the polypeptide set forth in SEQ ID NO:646 are provided in FIG. 20 and in the Sequence Listing. Examples of such polypeptides include SEQ ID NO:648, SEQ ID NO:650, SEQ ID NO:652, SEQ ID NO:654, SEQ ID NO:656, SEQ ID NO:658, SEQ ID NO:660, SEQ ID NO:662, SEQ ID NO:664, SEQ ID NO:666, SEQ ID NO:668, SEQ ID NO:670, SEQ ID NO:672, SEQ ID NO:674, SEQ ID NO:676, SEQ ID NO:678, SEQ ID NO:679, SEQ ID NO:680, SEQ ID NO:681, SEQ ID NO:682, SEQ ID NO:683, and SEQ ID NO:685.

In some cases, a low nitrogen tolerance-modulating polypeptide has an amino acid sequence with sequence similarity to the amino acid sequence set forth in SEQ ID NO:687, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:687. Amino acid sequences of polypeptides having greater than 45% sequence identity to the polypeptide set forth in SEQ ID NO:687 are provided in FIG. 21 and in the Sequence Listing. Examples of such polypeptides include SEQ ID NO:689, SEQ ID NO:691, SEQ ID NO:693, SEQ ID NO:694, SEQ ID NO:696, SEQ ID NO:697, SEQ ID NO:699, SEQ ID NO:701, SEQ ID NO:703, SEQ ID NO:705, SEQ ID NO:706, SEQ ID NO:708, SEQ ID NO:710, SEQ ID NO:712, SEQ ID NO:714, SEQ ID NO:716, SEQ ID NO:718, SEQ ID NO:720, SEQ ID NO:721, SEQ ID NO:722, SEQ ID NO:723, SEQ ID NO:724, SEQ ID NO:725, SEQ ID NO:726, SEQ ID NO:727, and SEQ ID NO:728.

In some cases, a low nitrogen tolerance-modulating polypeptide has an amino acid sequence with sequence similarity to the amino acid sequence set forth in SEQ ID NO:730, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:730. Amino acid sequences of polypeptides having greater than 45% sequence identity to the polypeptide set forth in SEQ ID NO:730 are provided in FIG. 22 and in the Sequence Listing. Examples of such polypeptides include SEQ ID NO:732, SEQ ID NO:733, SEQ ID NO:735, SEQ ID NO:737, SEQ ID NO:738, and SEQ ID NO:742.

In some cases, a low nitrogen tolerance-modulating polypeptide has an amino acid sequence with sequence similarity to the amino acid sequence set forth in SEQ ID NO:746, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:746. Amino acid sequences of polypeptides having greater than 45% sequence identity to the polypeptide set forth in SEQ ID NO:746 are provided in FIG. 23 and in the Sequence Listing. Examples of such polypeptides include SEQ ID NO:748, SEQ ID NO:750, SEQ ID NO:751, SEQ ID NO:753, SEQ ID NO:755, SEQ ID NO:757, SEQ ID NO:758, SEQ ID NO:760, SEQ ID NO:761, SEQ ID NO:762, SEQ ID NO:763, SEQ ID NO:765, and SEQ ID NO:767.

In some cases, a low nitrogen tolerance-modulating polypeptide has an amino acid sequence with sequence similarity to the amino acid sequence set forth in SEQ ID NO:769, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:769. Amino acid sequences of polypeptides having greater than 45% sequence identity to the polypeptide set forth in SEQ ID NO:769 are provided in FIG. 24 and in the Sequence Listing. Examples of such polypeptides include SEQ ID NO:771, SEQ ID NO:773, SEQ ID NO:775, SEQ ID NO:777, SEQ ID NO:779, SEQ ID NO:781, SEQ ID NO:783, SEQ ID NO:785, SEQ ID NO:787, SEQ ID NO:789, and SEQ ID NO:790.

In some cases, a low nitrogen tolerance-modulating polypeptide has an amino acid sequence with sequence similarity to the amino acid sequence set forth in SEQ ID NO:792, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:792. Amino acid sequences of polypeptides having greater than 20% sequence identity to the polypeptide set forth in SEQ ID NO:792 are provided in FIG. 25 and in the Sequence Listing. Examples of such polypeptides include SEQ ID NO:794, SEQ ID NO:796, SEQ ID NO:798, SEQ ID NO:799, SEQ ID NO:801, SEQ ID NO:803, SEQ ID NO:805, SEQ ID NO:807, SEQ ID NO:808, SEQ ID NO:810, SEQ ID NO:812, SEQ ID NO:814, SEQ ID NO:816, SEQ ID NO:818, SEQ ID NO:819, SEQ ID NO:820, SEQ ID NO:821, and SEQ ID NO:822.

In some cases, a low nitrogen tolerance-modulating polypeptide has an amino acid sequence with sequence similarity to the amino acid sequence set forth in SEQ ID NO:824, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:824. Amino acid sequences of polypeptides having greater than 45% sequence identity to the polypeptide set forth in SEQ ID NO:824 are provided in FIG. 26 and in the Sequence Listing. Such polypeptides include, but not limited to, SEQ ID NO:826, SEQ ID NO:1696, SEQ ID NO:1698, SEQ ID NO:1700, SEQ ID NO:1702, SEQ ID NO:1704, SEQ ID NO:1706, SEQ ID NO:1708, SEQ ID NO:1710, SEQ ID NO:1711, SEQ ID NO:1713, SEQ ID NO:1714, SEQ ID NO:1715, and SEQ ID NO:1716.

In some cases, a low nitrogen tolerance-modulating polypeptide has an amino acid sequence with sequence similarity to the amino acid sequence set forth in SEQ ID NO:828, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:828. Amino acid sequences of polypeptides having greater than 20% sequence identity to the polypeptide set forth in SEQ ID NO:828 are provided in FIG. 27 and in the Sequence Listing. Examples of such polypeptides include SEQ ID NO:830, SEQ ID NO:832, SEQ ID NO:834, SEQ ID NO:836, SEQ ID NO:837, SEQ ID NO:838, SEQ ID NO:839, SEQ ID NO:840, SEQ ID NO:842, SEQ ID NO:844, SEQ ID NO:845, SEQ ID NO:846, SEQ ID NO:847, SEQ ID NO:848, SEQ ID NO:849, SEQ ID NO:850, and SEQ ID NO:851.

In some cases, a low nitrogen tolerance-modulating polypeptide has an amino acid sequence with sequence similarity to the amino acid sequence set forth in SEQ ID NO:855, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:855. Amino acid sequences of polypeptides having greater than 20% sequence identity to the polypeptide set forth in SEQ ID NO:855 are provided in FIG. 28 and in the Sequence Listing. Examples of such polypeptides include SEQ ID NO:856, SEQ ID NO:858, SEQ ID NO:860, SEQ ID NO:862, SEQ ID NO:864, SEQ ID NO:866, SEQ ID NO:868, SEQ ID NO:870, SEQ ID NO:872, SEQ ID NO:874, SEQ ID NO:876, SEQ ID NO:878, SEQ ID NO:880, SEQ ID NO:882, SEQ ID NO:884, SEQ ID NO:885, SEQ ID NO:886, SEQ ID NO:887, SEQ ID NO:888, and SEQ ID NO:889.

In some cases, a low nitrogen tolerance-modulating polypeptide has an amino acid sequence with sequence similarity to the amino acid sequence set forth in SEQ ID NO:891, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:891. Amino acid sequences of polypeptides having greater than 20% sequence identity to the polypeptide set forth in SEQ ID NO:891 are provided in FIG. 29 and in the Sequence Listing. Examples of such polypeptides include SEQ ID NO:893, SEQ ID NO:894, SEQ ID NO:895, SEQ ID NO:896, SEQ ID NO:898, SEQ ID NO:900, SEQ ID NO:901, SEQ ID NO:902, SEQ ID NO:903, SEQ ID NO:904, SEQ ID NO:905, SEQ ID NO:907, SEQ ID NO:908, SEQ ID NO:909, SEQ ID NO:910, SEQ ID NO:911, SEQ ID NO:912, SEQ ID NO:913, SEQ ID NO:914, and SEQ ID NO:915.

In some cases, a low nitrogen tolerance-modulating polypeptide has an amino acid sequence with sequence similarity to the amino acid sequence set forth in SEQ ID NO:917, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:917. Amino acid sequences of polypeptides having greater than 20% sequence identity to the polypeptide set forth in SEQ ID NO:917 are provided in FIG. 30 and in the Sequence Listing. Examples of such polypeptides include SEQ ID NO:919, SEQ ID NO:921, SEQ ID NO:923, SEQ ID NO:925, SEQ ID NO:927, SEQ ID NO:929, SEQ ID NO:931, SEQ ID NO:933, SEQ ID NO:935, SEQ ID NO:937, SEQ ID NO:939, and SEQ ID NO:940.

In some cases, a low nitrogen tolerance-modulating polypeptide has an amino acid sequence with sequence similarity to the amino acid sequence set forth in SEQ ID NO:944, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:944. Amino acid sequences of polypeptides having greater than 20% sequence identity to the polypeptide set forth in SEQ ID NO:944 are provided in FIG. 31 and in the Sequence Listing. Examples of such polypeptides include SEQ ID NO:946, SEQ ID NO:947, SEQ ID NO:948, SEQ ID NO:950, SEQ ID NO:952, SEQ ID NO:954, SEQ ID NO:956, SEQ ID NO:958, SEQ ID NO:960, SEQ ID NO:962, SEQ ID NO:964, SEQ ID NO:966, SEQ ID NO:967, SEQ ID NO:968, SEQ ID NO:969, SEQ ID NO:970, SEQ ID NO:972, and SEQ ID NO:974.

In some cases, a low nitrogen tolerance-modulating polypeptide has an amino acid sequence with sequence similarity to the amino acid sequence set forth in SEQ ID NO:976, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:976. Amino acid sequences of polypeptides having greater than 45% sequence identity to the polypeptide set forth in SEQ ID NO:976 are provided in FIG. 32 and in the Sequence Listing. Examples of such polypeptides include SEQ ID NO:978 and SEQ ID NO:980.

In some cases, a low nitrogen tolerance-modulating polypeptide has an amino acid sequence with sequence similarity to the amino acid sequence set forth in SEQ ID NO:982, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:982. Amino acid sequences of polypeptides having greater than 20% sequence identity to the polypeptide set forth in SEQ ID NO:982 are provided in FIG. 33 and in the Sequence Listing. Examples of such polypeptides include SEQ ID NO:984, SEQ ID NO:985, SEQ ID NO:986, SEQ ID NO:987, SEQ ID NO:988, SEQ ID NO:989, SEQ ID NO:990, SEQ ID NO:991, SEQ ID NO:992, SEQ ID NO:993, SEQ ID NO:995, SEQ ID NO:996, SEQ ID NO:998, SEQ ID NO:1000, SEQ ID NO:1001, SEQ ID NO:1003, SEQ ID NO:1005, SEQ ID NO:1007, SEQ ID NO:1008, SEQ ID NO:1009, SEQ ID NO:1011, SEQ ID NO:1013, SEQ ID NO:1015, SEQ ID NO:1016, SEQ ID NO:1018, SEQ ID NO:1019, SEQ ID NO:1021, SEQ ID NO:1023, SEQ ID NO:1025, SEQ ID NO:1026, SEQ ID NO:1027, SEQ ID NO:1028, SEQ ID NO:1029, SEQ ID NO:1030, SEQ ID NO:1031, SEQ ID NO:1032, and SEQ ID NO:1033.

In some cases, a low nitrogen tolerance-modulating polypeptide has an amino acid sequence with sequence similarity to the amino acid sequence set forth in SEQ ID NO:1054, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1054 Amino acid sequences of polypeptides having greater than 20% sequence identity to the polypeptide set forth in SEQ ID NO:1054 are provided in FIG. 34 and in the Sequence Listing. Examples of such polypeptides include SEQ ID NO:1055, SEQ ID NO:1057, SEQ ID NO:1058, SEQ ID NO:1059, SEQ ID NO:1061, SEQ ID NO:1063, SEQ ID NO:1065, SEQ ID NO:1065, SEQ ID NO:1067, SEQ ID NO:1068, SEQ ID NO:1070, SEQ ID NO:1071, SEQ ID NO:1072, SEQ ID NO:1074, SEQ ID NO:1075, SEQ ID NO:1076, SEQ ID NO:1077, SEQ ID NO:1078, SEQ ID NO:1080, SEQ ID NO:1082, SEQ ID NO:1083, SEQ ID NO:1085, SEQ ID NO:1086, SEQ ID NO:1087, SEQ ID NO:1088, SEQ ID NO:1089, SEQ ID NO:1089, SEQ ID NO:1090, SEQ ID NO:1091, SEQ ID NO:1092, SEQ ID NO:1093, SEQ ID NO:1094, SEQ ID NO:1095, and SEQ ID NO:1097.

In some cases, a low nitrogen tolerance-modulating polypeptide has an amino acid sequence with sequence similarity to the amino acid sequence set forth in SEQ ID NO:1099, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1099 Amino acid sequences of polypeptides having greater than 20% sequence identity to the polypeptide set forth in SEQ ID NO:1099 are provided in FIG. 35 and in the Sequence Listing. Examples of such polypeptides include SEQ ID NO:1101, SEQ ID NO:1103, SEQ ID NO:1104, SEQ ID NO:1105, SEQ ID NO:1106, SEQ ID NO:1108, SEQ ID NO:1109, and SEQ ID NO:1110.

In some cases, a low nitrogen tolerance-modulating polypeptide has an amino acid sequence with sequence similarity to the amino acid sequence set forth in SEQ ID NO:1112, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1112 Amino acid sequences of polypeptides having greater than 20% sequence identity to the polypeptide set forth in SEQ ID NO:1112 are provided in FIG. 36 and in the Sequence Listing. Examples of such polypeptides include SEQ ID NO:1113 and SEQ ID NO:1114.

In some cases, a low nitrogen tolerance-modulating polypeptide has an amino acid sequence with sequence similarity to the amino acid sequence set forth in SEQ ID NO:1116, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1116 Amino acid sequences of polypeptides having greater than 20% sequence identity to the polypeptide set forth in SEQ ID NO:1116 are provided in FIG. 37 and in the Sequence Listing. Examples of such polypeptides include SEQ ID NO:1118, SEQ ID NO:1120, SEQ ID NO:1122, SEQ ID NO:1123, SEQ ID NO:1125, SEQ ID NO:1126, SEQ ID NO:1128, SEQ ID NO:1129, SEQ ID NO:1131, SEQ ID NO:1132, SEQ ID NO:1133, SEQ ID NO:1134, SEQ ID NO:1136, SEQ ID NO:1138, SEQ ID NO:1140, SEQ ID NO:1141, SEQ ID NO:1142, SEQ ID NO:1143, SEQ ID NO:1144, SEQ ID NO:1145, SEQ ID NO:1147, SEQ ID NO:1149, SEQ ID NO:1151, SEQ ID NO:1153, and SEQ ID NO:1155.

In some cases, a low nitrogen tolerance-modulating polypeptide has an amino acid sequence with sequence similarity to the amino acid sequence set forth in SEQ ID NO:1159, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1159 Amino acid sequences of polypeptides having greater than 20% sequence identity to the polypeptide set forth in SEQ ID NO:1159 are provided in FIG. 38 and in the Sequence Listing. Examples of such polypeptides include SEQ ID NO:1161, SEQ ID NO:1162, SEQ ID NO:1163, and SEQ ID NO:1164.

In some cases, a low nitrogen tolerance-modulating polypeptide has an amino acid sequence with sequence similarity to the amino acid sequence set forth in SEQ ID NO:1166, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1166 Amino acid sequences of polypeptides having greater than 20% sequence identity to the polypeptide set forth in SEQ ID NO:1166 are provided in FIG. 39 and in the Sequence Listing. Examples of such polypeptides include SEQ ID NO:1167, SEQ ID NO:1169, SEQ ID NO:1171, SEQ ID NO:1173, SEQ ID NO:1175, SEQ ID NO:1177, SEQ ID NO:1179, SEQ ID NO:1180, SEQ ID NO:1182, and SEQ ID NO:1183.

In some cases, a low nitrogen tolerance-modulating polypeptide has an amino acid sequence with sequence similarity to the amino acid sequence set forth in SEQ ID NO:1185, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1185 Amino acid sequences of polypeptides having greater than 20% sequence identity to the polypeptide set forth in SEQ ID NO:1185 are provided in FIG. 40 and in the Sequence Listing. Examples of such polypeptides include SEQ ID NO:1187, SEQ ID NO:1189, SEQ ID NO:1190, SEQ ID NO:1191, and SEQ ID NO:1192.

In some cases, a low nitrogen tolerance-modulating polypeptide has an amino acid sequence with sequence similarity to the amino acid sequence set forth in SEQ ID NO:1194, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1194 Amino acid sequences of polypeptides having greater than 20% sequence identity to the polypeptide set forth in SEQ ID NO:1194 are provided in FIG. 41 and in the Sequence Listing. Examples of such polypeptides include SEQ ID NO:1196, SEQ ID NO:1198, SEQ ID NO:1200, SEQ ID NO:1202, SEQ ID NO:1203, SEQ ID NO:1204, SEQ ID NO:1205, SEQ ID NO:1206, SEQ ID NO:1207, and SEQ ID NO:1208.

In some cases, a low nitrogen tolerance-modulating polypeptide has an amino acid sequence with sequence similarity to the amino acid sequence set forth in SEQ ID NO:1210, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1210 Amino acid sequences of polypeptides having greater than 20% sequence identity to the polypeptide set forth in SEQ ID NO:1210 are provided in FIG. 42 and in the Sequence Listing. Examples of such polypeptides include SEQ ID NO:1211, SEQ ID NO:1213, SEQ ID NO:1215, SEQ ID NO:1216, SEQ ID NO:1218, SEQ ID NO:1220, SEQ ID NO:1222, SEQ ID NO:1224, SEQ ID NO:1226, SEQ ID NO:1228, SEQ ID NO:1229, SEQ ID NO:1230, SEQ ID NO:1232, SEQ ID NO:1233, SEQ ID NO:1234, SEQ ID NO:1235, SEQ ID NO:1236, SEQ ID NO:1237, SEQ ID NO:1238, SEQ ID NO:1239, SEQ ID NO:1240, SEQ ID NO:1241, SEQ ID NO:1242, SEQ ID NO:1243, SEQ ID NO:1244, SEQ ID NO:1245, SEQ ID NO:1246, SEQ ID NO:1247, SEQ ID NO:1248, SEQ ID NO:1249, SEQ ID NO:1251, SEQ ID NO:1253, SEQ ID NO:1255, SEQ ID NO:1257, SEQ ID NO:1259, SEQ ID NO:1261, SEQ ID NO:1263, SEQ ID NO:1264, SEQ ID NO:1265, SEQ ID NO:1266, SEQ ID NO:1267, SEQ ID NO:1268, SEQ ID NO:1269, SEQ ID NO:1270, SEQ ID NO:1271, and SEQ ID NO:1272.

In some cases, a low nitrogen tolerance-modulating polypeptide has an amino acid sequence with sequence similarity to the amino acid sequence set forth in SEQ ID NO:1274, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1274 Amino acid sequences of polypeptides having greater than 20% sequence identity to the polypeptide set forth in SEQ ID NO:1274 are provided in FIG. 43 and in the Sequence Listing. Examples of such polypeptides include SEQ ID NO:1276, SEQ ID NO:1278, SEQ ID NO:1280, SEQ ID NO:1281, SEQ ID NO:1282, SEQ ID NO:1284, SEQ ID NO:1285, SEQ ID NO:1287, SEQ ID NO:1289, SEQ ID NO:1291, SEQ ID NO:1293, SEQ ID NO:1294, SEQ ID NO:1295, SEQ ID NO:1296, SEQ ID NO:1297, SEQ ID NO:1298, and SEQ ID NO:1300.

In some cases, a low nitrogen tolerance-modulating polypeptide has an amino acid sequence with sequence similarity to the amino acid sequence set forth in SEQ ID NO:1302, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1302 Amino acid sequences of polypeptides having greater than 20% sequence identity to the polypeptide set forth in SEQ ID NO:1302 are provided in FIG. 44 and in the Sequence Listing. Examples of such polypeptides include SEQ ID NO:1303, SEQ ID NO:1305, SEQ ID NO:1307, SEQ ID NO:1309, SEQ ID NO:1311, SEQ ID NO:1312, SEQ ID NO:1313, SEQ ID NO:1314, SEQ ID NO:1315, SEQ ID NO:1317, SEQ ID NO:1318, SEQ ID NO:1319, SEQ ID NO:1320, SEQ ID NO:1321, SEQ ID NO:1322, SEQ ID NO:1323, SEQ ID NO:1324, SEQ ID NO:1325, SEQ ID NO:1326, SEQ ID NO:1327, SEQ ID NO:1328, SEQ ID NO:1330, SEQ ID NO:1331, SEQ ID NO:1333, SEQ ID NO:1334, SEQ ID NO:1335, SEQ ID NO:1336, SEQ ID NO:1337, SEQ ID NO:1338, SEQ ID NO:1339, and SEQ ID NO:1340.

In some cases, a low nitrogen tolerance-modulating polypeptide has an amino acid sequence with sequence similarity to the amino acid sequence set forth in SEQ ID NO:1342, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1342 Amino acid sequences of polypeptides having greater than 20% sequence identity to the polypeptide set forth in SEQ ID NO:1342 are provided in FIG. 45 and in the Sequence Listing. Examples of such polypeptides include SEQ ID NO:1344, SEQ ID NO:1346, SEQ ID NO:1348, SEQ ID NO:1350, SEQ ID NO:1352, SEQ ID NO:1354, SEQ ID NO:1355, SEQ ID NO:1357, SEQ ID NO:1358, SEQ ID NO:1360, SEQ ID NO:1361, SEQ ID NO:1362, SEQ ID NO:1363, SEQ ID NO:1364, SEQ ID NO:1366, SEQ ID NO:1367, SEQ ID NO:1369, SEQ ID NO:1370, SEQ ID NO:1371, SEQ ID NO:1372, SEQ ID NO:1373, SEQ ID NO:1374, SEQ ID NO:1375, SEQ ID NO:1376, SEQ ID NO:1377, SEQ ID NO:1378, SEQ ID NO:1379, SEQ ID NO:1380, SEQ ID NO:1381, SEQ ID NO:1382, and SEQ ID NO:1383.

In some cases, a low nitrogen tolerance-modulating polypeptide has an amino acid sequence with sequence similarity to the amino acid sequence set forth in SEQ ID NO:1385, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1385 Amino acid sequences of polypeptides having greater than 20% sequence identity to the polypeptide set forth in SEQ ID NO:1385 are provided in FIG. 46 and in the Sequence Listing. Examples of such polypeptides include SEQ ID NO:1387, SEQ ID NO:1389, SEQ ID NO:1390, SEQ ID NO:1391, SEQ ID NO:1393, SEQ ID NO:1394, SEQ ID NO:1395, SEQ ID NO:1396, SEQ ID NO:1398, SEQ ID NO:1400, SEQ ID NO:1401, SEQ ID NO:1402, SEQ ID NO:1403, SEQ ID NO:1404, SEQ ID NO:1405, and SEQ ID NO:1407.

In some cases, a low nitrogen tolerance-modulating polypeptide has an amino acid sequence with sequence similarity to the amino acid sequence set forth in SEQ ID NO:1409, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1409 Amino acid sequences of polypeptides having greater than 20% sequence identity to the polypeptide set forth in SEQ ID NO:1409 are provided in FIG. 47 and in the Sequence Listing. Examples of such polypeptides include SEQ ID NO:1411, SEQ ID NO:1413, SEQ ID NO:1415, SEQ ID NO:1417, SEQ ID NO:1418, SEQ ID NO:1419, SEQ ID NO:1421, SEQ ID NO:1423, SEQ ID NO:1424, SEQ ID NO:1425, and SEQ ID NO:1426.

In some cases, a low nitrogen tolerance-modulating polypeptide has an amino acid sequence with sequence similarity to the amino acid sequence set forth in SEQ ID NO:1428, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1428 Amino acid sequences of polypeptides having greater than 20% sequence identity to the polypeptide set forth in SEQ ID NO:1428 are provided in FIG. 48 and in the Sequence Listing. Examples of such polypeptides include SEQ ID NO:1430, SEQ ID NO:1432, SEQ ID NO:1434, SEQ ID NO:1436, SEQ ID NO:1439, SEQ ID NO:1442, SEQ ID NO:1444, SEQ ID NO:1446, SEQ ID NO:1448, SEQ ID NO:1450, SEQ ID NO:1452, SEQ ID NO:1453, SEQ ID NO:1454, SEQ ID NO:1455, SEQ ID NO:1456, SEQ ID NO:1457, SEQ ID NO:1458, and SEQ ID NO:1459.

In some cases, a low nitrogen tolerance-modulating polypeptide has an amino acid sequence with sequence similarity to the amino acid sequence set forth in SEQ ID NO:1463, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1463 Amino acid sequences of polypeptides having greater than 20% sequence identity to the polypeptide set forth in SEQ ID NO:1463 are provided in FIG. 49 and in the Sequence Listing. Examples of such polypeptides include SEQ ID NO:1465, SEQ ID NO:1467, SEQ ID NO:1469, SEQ ID NO:1471, SEQ ID NO:1473, SEQ ID NO:1474, SEQ ID NO:1475, SEQ ID NO:1476, and SEQ ID NO:1477.

In some cases, a low nitrogen tolerance-modulating polypeptide has an amino acid sequence with sequence similarity to the amino acid sequence set forth in SEQ ID NO:1491, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1491 Amino acid sequences of polypeptides having greater than 20% sequence identity to the polypeptide set forth in SEQ ID NO:1491 are provided in FIG. 50 and in the Sequence Listing. Examples of such polypeptides include SEQ ID NO:1493, SEQ ID NO:1495, SEQ ID NO:1497, SEQ ID NO:1499, SEQ ID NO:1501, SEQ ID NO:1503, SEQ ID NO:1504, SEQ ID NO:1505, SEQ ID NO:1506, and SEQ ID NO:1508.

In some cases, a low nitrogen tolerance-modulating polypeptide has an amino acid sequence with sequence similarity to the amino acid sequence set forth in SEQ ID NO:1510, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1510 Amino acid sequences of polypeptides having greater than 20% sequence identity to the polypeptide set forth in SEQ ID NO:1510 are provided in FIG. 51 and in the Sequence Listing. Examples of such polypeptides include SEQ ID NO:1512, SEQ ID NO:1514, SEQ ID NO:1516, SEQ ID NO:1518, SEQ ID NO:1520, SEQ ID NO:1522, and SEQ ID NO:1523.

In some cases, a low nitrogen tolerance-modulating polypeptide has an amino acid sequence with sequence similarity to the amino acid sequence set forth in SEQ ID NO:1525, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1525 Amino acid sequences of polypeptides having greater than 20% sequence identity to the polypeptide set forth in SEQ ID NO:1525 are provided in FIG. 52 and in the Sequence Listing. Examples of such polypeptides include SEQ ID NO:1527, SEQ ID NO:1529, SEQ ID NO:1530, SEQ ID NO:1532, SEQ ID NO:1534, and SEQ ID NO:1535.

In some cases, a low nitrogen tolerance-modulating polypeptide has an amino acid sequence with sequence similarity to the amino acid sequence set forth in SEQ ID NO:1537, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1537 Amino acid sequences of polypeptides having greater than 20% sequence identity to the polypeptide set forth in SEQ ID NO:1537 are provided in FIG. 53 and in the Sequence Listing. Examples of such polypeptides include SEQ ID NO:1539, SEQ ID NO:1540, SEQ ID NO:1541, SEQ ID NO:1543, SEQ ID NO:1545, SEQ ID NO:1547, SEQ ID NO:1548, SEQ ID NO:1550, SEQ ID NO:1552, SEQ ID NO:2386, SEQ ID NO:2388, SEQ ID NO:2390, SEQ ID NO:2391, and SEQ ID NO:2392.

In some cases, a low nitrogen tolerance-modulating polypeptide has an amino acid sequence with sequence similarity to the amino acid sequence set forth in SEQ ID NO:1554, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1554 Amino acid sequences of polypeptides having greater than 20% sequence identity to the polypeptide set forth in SEQ ID NO:1554 are provided in FIG. 54 and in the Sequence Listing. Examples of such polypeptides include SEQ ID NO:1555, SEQ ID NO:1557, SEQ ID NO:1559, SEQ ID NO:1561, SEQ ID NO:1563, SEQ ID NO:1565, SEQ ID NO:1567, SEQ ID NO:1569, SEQ ID NO:1571, SEQ ID NO:1572, SEQ ID NO:1573, SEQ ID NO:1574, and SEQ ID NO:1575.

In some cases, a low nitrogen tolerance-modulating polypeptide has an amino acid sequence with sequence similarity to the amino acid sequence set forth in SEQ ID NO:1577, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1577 Amino acid sequences of polypeptides having greater than 20% sequence identity to the polypeptide set forth in SEQ ID NO:1577 are provided in FIG. 55 and in the Sequence Listing. Examples of such polypeptides include SEQ ID NO:1035, SEQ ID NO:1036, SEQ ID NO:1037, SEQ ID NO:1040, SEQ ID NO:1041, SEQ ID NO:1043, SEQ ID NO:1044, SEQ ID NO:1046, SEQ ID NO:1047, SEQ ID NO:1048, SEQ ID NO:1050, SEQ ID NO:1440, SEQ ID NO:1480, SEQ ID NO:1481, SEQ ID NO:1482, SEQ ID NO:1483, SEQ ID NO:1484, SEQ ID NO:1485, SEQ ID NO:1486, SEQ ID NO:1487, SEQ ID NO:1488, SEQ ID NO:1578, SEQ ID NO:1580, SEQ ID NO:1582, SEQ ID NO:1584, SEQ ID NO:1586, SEQ ID NO:1588, SEQ ID NO:1590, SEQ ID NO:1592, SEQ ID NO:1594, SEQ ID NO:1596, SEQ ID NO:1598, SEQ ID NO:1599, SEQ ID NO:1601, SEQ ID NO:1602, SEQ ID NO:1605, SEQ ID NO:1607, SEQ ID NO:1608, SEQ ID NO:1609, SEQ ID NO:1611, SEQ ID NO:1613, SEQ ID NO:1615, SEQ ID NO:1617, SEQ ID NO:1619, SEQ ID NO:1621, SEQ ID NO:1622, SEQ ID NO:1623, SEQ ID NO:1624, SEQ ID NO:1625, SEQ ID NO:1627, SEQ ID NO:1629, SEQ ID NO:1631, SEQ ID NO:1633, SEQ ID NO:1635, SEQ ID NO:1637, SEQ ID NO:1639, SEQ ID NO:1643, SEQ ID NO:1645, SEQ ID NO:1648, SEQ ID NO:1649, SEQ ID NO:1651, SEQ ID NO:1653.

In some cases, a low nitrogen tolerance-modulating polypeptide has an amino acid sequence with sequence similarity to the amino acid sequence set forth in SEQ ID NO:1437, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1437 Amino acid sequences of polypeptides having greater than 20% sequence identity to the polypeptide set forth in SEQ ID NO:1437 are provided in FIG. 56 and in the Sequence Listing. Examples of such polypeptides include SEQ ID NO:173, SEQ ID NO:212, SEQ ID NO:361, SEQ ID NO:421, SEQ ID NO:443, SEQ ID NO:740, SEQ ID NO:744, SEQ ID NO:942, SEQ ID NO:1461.

In some cases, a low nitrogen tolerance-modulating polypeptide has an amino acid sequence with sequence similarity to the amino acid sequence set forth in SEQ ID NO:97, and preferably has at least 20%, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:97 Amino acid sequences of polypeptides having greater than 20% sequence identity to the polypeptide set forth in SEQ ID NO:1437 are provided in FIG. 57 and in the Sequence Listing. Examples of such polypeptides include SEQ ID NO:2010, SEQ ID NO:2011, SEQ ID NO:2013, SEQ ID NO:2015, and SEQ ID NO:2017

E. Other Sequences

It should be appreciated that a low nitrogen tolerance-modulating polypeptide can include additional amino acids that are not involved in low nitrogen tolerance-modulation, and thus such a polypeptide can be longer than would otherwise be the case. For example, a low nitrogen tolerance-modulating polypeptide can include a purification tag, a chloroplast transit peptide, a mitochondrial transit peptide, an amyloplast peptide, or a leader sequence added to the amino or carboxy terminus. In some embodiments, a low nitrogen tolerance-modulating polypeptide includes an amino acid sequence that functions as a reporter, e.g., a green fluorescent protein or yellow fluorescent protein.

III. Nucleic Acids

Nucleic acids described herein include nucleic acids that are effective to modulate low-nitrogen tolerance levels when transcribed in a plant or plant cell. Such nucleic acids include, without limitation, those that encode a low nitrogen tolerance-modulating polypeptide and those that can be used to inhibit expression of low nitrogen tolerance-modulating polypeptide via a nucleic acid based method.

A. Nucleic Acids Encoding Low Nitrogen Tolerance-Modulating Polypeptides

Nucleic acids encoding low nitrogen tolerance-modulating polypeptides are described herein. Examples of such nucleic acids include SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, and SEQ ID NO:1576, as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, and SEQ ID NO:1576.

A low nitrogen tolerance-modulating nucleic acid can comprise the nucleotide sequence set forth in SEQ ID NO:1. Alternatively, a low nitrogen tolerance-modulating nucleic acid can be a variant of the nucleic acid having the nucleotide sequence set forth in SEQ ID NO:2. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:2.

A low nitrogen tolerance-modulating nucleic acid can comprise the nucleotide sequence set forth in SEQ ID NO: 48. Alternatively, a low nitrogen tolerance-modulating nucleic acid can be a variant of the nucleic acid having the nucleotide sequence set forth in SEQ ID NO: 48. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 48.

A low nitrogen tolerance-modulating nucleic acid can comprise the nucleotide sequence set forth in SEQ ID NO:76. Alternatively, a low nitrogen tolerance-modulating nucleic acid can be a variant of the nucleic acid having the nucleotide sequence set forth in SEQ ID NO:76. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:76.

A low nitrogen tolerance-modulating nucleic acid can comprise the nucleotide sequence set forth in SEQ ID NO:96. Alternatively, a low nitrogen tolerance-modulating nucleic acid can be a variant of the nucleic acid having the nucleotide sequence set forth in SEQ ID NO:96. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:96.

A low nitrogen tolerance-modulating nucleic acid can comprise the nucleotide sequence set forth in SEQ ID NO:99. Alternatively, a low nitrogen tolerance-modulating nucleic acid can be a variant of the nucleic acid having the nucleotide sequence set forth in SEQ ID NO:99. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:99.

A low nitrogen tolerance-modulating nucleic acid can comprise the nucleotide sequence set forth in SEQ ID NO:151. Alternatively, a low nitrogen tolerance-modulating nucleic acid can be a variant of the nucleic acid having the nucleotide sequence set forth in SEQ ID NO:151. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:151.

A low nitrogen tolerance-modulating nucleic acid can comprise the nucleotide sequence set forth in SEQ ID NO:165. Alternatively, a low nitrogen tolerance-modulating nucleic acid can be a variant of the nucleic acid having the nucleotide sequence set forth in SEQ ID NO:165. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:165.

A low nitrogen tolerance-modulating nucleic acid can comprise the nucleotide sequence set forth in SEQ ID NO:175. Alternatively, a low nitrogen tolerance-modulating nucleic acid can be a variant of the nucleic acid having the nucleotide sequence set forth in SEQ ID NO:175. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:175.

A low nitrogen tolerance-modulating nucleic acid can comprise the nucleotide sequence set forth in SEQ ID NO:185. Alternatively, a low nitrogen tolerance-modulating nucleic acid can be a variant of the nucleic acid having the nucleotide sequence set forth in SEQ ID NO:185. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:185.

A low nitrogen tolerance-modulating nucleic acid can comprise the nucleotide sequence set forth in SEQ ID NO:207. Alternatively, a low nitrogen tolerance-modulating nucleic acid can be a variant of the nucleic acid having the nucleotide sequence set forth in SEQ ID NO:207. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:207.

A low nitrogen tolerance-modulating nucleic acid can comprise the nucleotide sequence set forth in SEQ ID NO:217. Alternatively, a low nitrogen tolerance-modulating nucleic acid can be a variant of the nucleic acid having the nucleotide sequence set forth in SEQ ID NO:217. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:217.

A low nitrogen tolerance-modulating nucleic acid can comprise the nucleotide sequence set forth in SEQ ID NO:233. Alternatively, a low nitrogen tolerance-modulating nucleic acid can be a variant of the nucleic acid having the nucleotide sequence set forth in SEQ ID NO:233. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:233.

A low nitrogen tolerance-modulating nucleic acid can comprise the nucleotide sequence set forth in SEQ ID NO:245. Alternatively, a low nitrogen tolerance-modulating nucleic acid can be a variant of the nucleic acid having the nucleotide sequence set forth in SEQ ID NO:245. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:245.

A low nitrogen tolerance-modulating nucleic acid can comprise the nucleotide sequence set forth in SEQ ID NO:299. Alternatively, a low nitrogen tolerance-modulating nucleic acid can be a variant of the nucleic acid having the nucleotide sequence set forth in SEQ ID NO:299. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:299.

A low nitrogen tolerance-modulating nucleic acid can comprise the nucleotide sequence set forth in SEQ ID NO:331. Alternatively, a low nitrogen tolerance-modulating nucleic acid can be a variant of the nucleic acid having the nucleotide sequence set forth in SEQ ID NO:331. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:331.

A low nitrogen tolerance-modulating nucleic acid can comprise the nucleotide sequence set forth in SEQ ID NO:367. Alternatively, a low nitrogen tolerance-modulating nucleic acid can be a variant of the nucleic acid having the nucleotide sequence set forth in SEQ ID NO:367. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:367.

A low nitrogen tolerance-modulating nucleic acid can comprise the nucleotide sequence set forth in SEQ ID NO:509. Alternatively, a low nitrogen tolerance-modulating nucleic acid can be a variant of the nucleic acid having the nucleotide sequence set forth in SEQ ID NO:509. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:509.

A low nitrogen tolerance-modulating nucleic acid can comprise the nucleotide sequence set forth in SEQ ID NO:532. Alternatively, a low nitrogen tolerance-modulating nucleic acid can be a variant of the nucleic acid having the nucleotide sequence set forth in SEQ ID NO:532. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:532.

A low nitrogen tolerance-modulating nucleic acid can comprise the nucleotide sequence set forth in SEQ ID NO:555. Alternatively, a low nitrogen tolerance-modulating nucleic acid can be a variant of the nucleic acid having the nucleotide sequence set forth in SEQ ID NO:555. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:555.

A low nitrogen tolerance-modulating nucleic acid can comprise the nucleotide sequence set forth in SEQ ID NO:557. Alternatively, a low nitrogen tolerance-modulating nucleic acid can be a variant of the nucleic acid having the nucleotide sequence set forth in SEQ ID NO:557. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:557.

A low nitrogen tolerance-modulating nucleic acid can comprise the nucleotide sequence set forth in SEQ ID NO:592. Alternatively, a low nitrogen tolerance-modulating nucleic acid can be a variant of the nucleic acid having the nucleotide sequence set forth in SEQ ID NO:592. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:592.

A low nitrogen tolerance-modulating nucleic acid can comprise the nucleotide sequence set forth in SEQ ID NO:612. Alternatively, a low nitrogen tolerance-modulating nucleic acid can be a variant of the nucleic acid having the nucleotide sequence set forth in SEQ ID NO:612. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:612.

A low nitrogen tolerance-modulating nucleic acid can comprise the nucleotide sequence set forth in SEQ ID NO:645. Alternatively, a low nitrogen tolerance-modulating nucleic acid can be a variant of the nucleic acid having the nucleotide sequence set forth in SEQ ID NO:645. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:645.

A low nitrogen tolerance-modulating nucleic acid can comprise the nucleotide sequence set forth in SEQ ID NO:686. Alternatively, a low nitrogen tolerance-modulating nucleic acid can be a variant of the nucleic acid having the nucleotide sequence set forth in SEQ ID NO:686. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:686.

A low nitrogen tolerance-modulating nucleic acid can comprise the nucleotide sequence set forth in SEQ ID NO:729. Alternatively, a low nitrogen tolerance-modulating nucleic acid can be a variant of the nucleic acid having the nucleotide sequence set forth in SEQ ID NO:729. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:729.

A low nitrogen tolerance-modulating nucleic acid can comprise the nucleotide sequence set forth in SEQ ID NO:745. Alternatively, a low nitrogen tolerance-modulating nucleic acid can be a variant of the nucleic acid having the nucleotide sequence set forth in SEQ ID NO:745. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:745.

A low nitrogen tolerance-modulating nucleic acid can comprise the nucleotide sequence set forth in SEQ ID NO:768. Alternatively, a low nitrogen tolerance-modulating nucleic acid can be a variant of the nucleic acid having the nucleotide sequence set forth in SEQ ID NO:768. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:768.

A low nitrogen tolerance-modulating nucleic acid can comprise the nucleotide sequence set forth in SEQ ID NO:791. Alternatively, a low nitrogen tolerance-modulating nucleic acid can be a variant of the nucleic acid having the nucleotide sequence set forth in SEQ ID NO:791. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:791.

A low nitrogen tolerance-modulating nucleic acid can comprise the nucleotide sequence set forth in SEQ ID NO:823. Alternatively, a low nitrogen tolerance-modulating nucleic acid can be a variant of the nucleic acid having the nucleotide sequence set forth in SEQ ID NO:823. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:823.

A low nitrogen tolerance-modulating nucleic acid can comprise the nucleotide sequence set forth in SEQ ID NO:827. Alternatively, a low nitrogen tolerance-modulating nucleic acid can be a variant of the nucleic acid having the nucleotide sequence set forth in SEQ ID NO:827. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:827.

A low nitrogen tolerance-modulating nucleic acid can comprise the nucleotide sequence set forth in SEQ ID NO:852. Alternatively, a low nitrogen tolerance-modulating nucleic acid can be a variant of the nucleic acid having the nucleotide sequence set forth in SEQ ID NO:852. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:852.

A low nitrogen tolerance-modulating nucleic acid can comprise the nucleotide sequence set forth in SEQ ID NO:854. Alternatively, a low nitrogen tolerance-modulating nucleic acid can be a variant of the nucleic acid having the nucleotide sequence set forth in SEQ ID NO:854. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:854.

A low nitrogen tolerance-modulating nucleic acid can comprise the nucleotide sequence set forth in SEQ ID NO:890. Alternatively, a low nitrogen tolerance-modulating nucleic acid can be a variant of the nucleic acid having the nucleotide sequence set forth in SEQ ID NO:890. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:890.

A low nitrogen tolerance-modulating nucleic acid can comprise the nucleotide sequence set forth in SEQ ID NO:916. Alternatively, a low nitrogen tolerance-modulating nucleic acid can be a variant of the nucleic acid having the nucleotide sequence set forth in SEQ ID NO:916. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:916.

A low nitrogen tolerance-modulating nucleic acid can comprise the nucleotide sequence set forth in SEQ ID NO:943. Alternatively, a low nitrogen tolerance-modulating nucleic acid can be a variant of the nucleic acid having the nucleotide sequence set forth in SEQ ID NO:943. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:943.

A low nitrogen tolerance-modulating nucleic acid can comprise the nucleotide sequence set forth in SEQ ID NO:975. Alternatively, a low nitrogen tolerance-modulating nucleic acid can be a variant of the nucleic acid having the nucleotide sequence set forth in SEQ ID NO:975. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:975.

A low nitrogen tolerance-modulating nucleic acid can comprise the nucleotide sequence set forth in SEQ ID NO:981. Alternatively, a low nitrogen tolerance-modulating nucleic acid can be a variant of the nucleic acid having the nucleotide sequence set forth in SEQ ID NO:981. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:981.

A low nitrogen tolerance-modulating nucleic acid can comprise the nucleotide sequence set forth in SEQ ID NO: 1034. Alternatively, a low nitrogen tolerance-modulating nucleic acid can be a variant of the nucleic acid having the nucleotide sequence set forth in SEQ ID NO: 1034. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1034.

A low nitrogen tolerance-modulating nucleic acid can comprise the nucleotide sequence set forth in SEQ ID NO:1053. Alternatively, a low nitrogen tolerance-modulating nucleic acid can be a variant of the nucleic acid having the nucleotide sequence set forth in SEQ ID NO:1053. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1053.

A low nitrogen tolerance-modulating nucleic acid can comprise the nucleotide sequence set forth in SEQ ID NO:1098. Alternatively, a low nitrogen tolerance-modulating nucleic acid can be a variant of the nucleic acid having the nucleotide sequence set forth in SEQ ID NO:1098. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1098.

A low nitrogen tolerance-modulating nucleic acid can comprise the nucleotide sequence set forth in SEQ ID NO:1111. Alternatively, a low nitrogen tolerance-modulating nucleic acid can be a variant of the nucleic acid having the nucleotide sequence set forth in SEQ ID NO:1111. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1111.

A low nitrogen tolerance-modulating nucleic acid can comprise the nucleotide sequence set forth in SEQ ID NO:1115. Alternatively, a low nitrogen tolerance-modulating nucleic acid can be a variant of the nucleic acid having the nucleotide sequence set forth in SEQ ID NO:1115. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1115.

A low nitrogen tolerance-modulating nucleic acid can comprise the nucleotide sequence set forth in SEQ ID NO:1156. Alternatively, a low nitrogen tolerance-modulating nucleic acid can be a variant of the nucleic acid having the nucleotide sequence set forth in SEQ ID NO:1156. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1156.

A low nitrogen tolerance-modulating nucleic acid can comprise the nucleotide sequence set forth in SEQ ID NO:1158. Alternatively, a low nitrogen tolerance-modulating nucleic acid can be a variant of the nucleic acid having the nucleotide sequence set forth in SEQ ID NO:1158. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1158.

A low nitrogen tolerance-modulating nucleic acid can comprise the nucleotide sequence set forth in SEQ ID NO:1165. Alternatively, a low nitrogen tolerance-modulating nucleic acid can be a variant of the nucleic acid having the nucleotide sequence set forth in SEQ ID NO:1165. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1165.

A low nitrogen tolerance-modulating nucleic acid can comprise the nucleotide sequence set forth in SEQ ID NO:1184. Alternatively, a low nitrogen tolerance-modulating nucleic acid can be a variant of the nucleic acid having the nucleotide sequence set forth in SEQ ID NO:1184. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1184.

A low nitrogen tolerance-modulating nucleic acid can comprise the nucleotide sequence set forth in SEQ ID NO:1193. Alternatively, a low nitrogen tolerance-modulating nucleic acid can be a variant of the nucleic acid having the nucleotide sequence set forth in SEQ ID NO:1193. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1193.

A low nitrogen tolerance-modulating nucleic acid can comprise the nucleotide sequence set forth in SEQ ID NO: 1209. Alternatively, a low nitrogen tolerance-modulating nucleic acid can be a variant of the nucleic acid having the nucleotide sequence set forth in SEQ ID NO: 1209. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1209.

A low nitrogen tolerance-modulating nucleic acid can comprise the nucleotide sequence set forth in SEQ ID NO:1273. Alternatively, a low nitrogen tolerance-modulating nucleic acid can be a variant of the nucleic acid having the nucleotide sequence set forth in SEQ ID NO:1273. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1273.

A low nitrogen tolerance-modulating nucleic acid can comprise the nucleotide sequence set forth in SEQ ID NO:1301. Alternatively, a low nitrogen tolerance-modulating nucleic acid can be a variant of the nucleic acid having the nucleotide sequence set forth in SEQ ID NO:1301. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1301.

A low nitrogen tolerance-modulating nucleic acid can comprise the nucleotide sequence set forth in SEQ ID NO:1341. Alternatively, a low nitrogen tolerance-modulating nucleic acid can be a variant of the nucleic acid having the nucleotide sequence set forth in SEQ ID NO:1341. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1341.

A low nitrogen tolerance-modulating nucleic acid can comprise the nucleotide sequence set forth in SEQ ID NO:1384. Alternatively, a low nitrogen tolerance-modulating nucleic acid can be a variant of the nucleic acid having the nucleotide sequence set forth in SEQ ID NO:1384. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1384.

A low nitrogen tolerance-modulating nucleic acid can comprise the nucleotide sequence set forth in SEQ ID NO:1408. Alternatively, a low nitrogen tolerance-modulating nucleic acid can be a variant of the nucleic acid having the nucleotide sequence set forth in SEQ ID NO:1408. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1408.

A low nitrogen tolerance-modulating nucleic acid can comprise the nucleotide sequence set forth in SEQ ID NO:1427. Alternatively, a low nitrogen tolerance-modulating nucleic acid can be a variant of the nucleic acid having the nucleotide sequence set forth in SEQ ID NO:1427. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1427.

A low nitrogen tolerance-modulating nucleic acid can comprise the nucleotide sequence set forth in SEQ ID NO:1462. Alternatively, a low nitrogen tolerance-modulating nucleic acid can be a variant of the nucleic acid having the nucleotide sequence set forth in SEQ ID NO:1462. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1462.

A low nitrogen tolerance-modulating nucleic acid can comprise the nucleotide sequence set forth in SEQ ID NO:1490. Alternatively, a low nitrogen tolerance-modulating nucleic acid can be a variant of the nucleic acid having the nucleotide sequence set forth in SEQ ID NO:1490. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1490.

A low nitrogen tolerance-modulating nucleic acid can comprise the nucleotide sequence set forth in SEQ ID NO:1509. Alternatively, a low nitrogen tolerance-modulating nucleic acid can be a variant of the nucleic acid having the nucleotide sequence set forth in SEQ ID NO:1509. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1509.

A low nitrogen tolerance-modulating nucleic acid can comprise the nucleotide sequence set forth in SEQ ID NO:1524. Alternatively, a low nitrogen tolerance-modulating nucleic acid can be a variant of the nucleic acid having the nucleotide sequence set forth in SEQ ID NO:1524. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1524.

A low nitrogen tolerance-modulating nucleic acid can comprise the nucleotide sequence set forth in SEQ ID NO:1536. Alternatively, a low nitrogen tolerance-modulating nucleic acid can be a variant of the nucleic acid having the nucleotide sequence set forth in SEQ ID NO:1536. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1536.

A low nitrogen tolerance-modulating nucleic acid can comprise the nucleotide sequence set forth in SEQ ID NO:1553. Alternatively, a low nitrogen tolerance-modulating nucleic acid can be a variant of the nucleic acid having the nucleotide sequence set forth in SEQ ID NO:1553. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1553.

A low nitrogen tolerance-modulating nucleic acid can comprise the nucleotide sequence set forth in SEQ ID NO:1576. Alternatively, a low nitrogen tolerance-modulating nucleic acid can be a variant of the nucleic acid having the nucleotide sequence set forth in SEQ ID NO:1576. For example, a low nitrogen tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1576.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Low Nitrogen Tolerance-Modulating Polypeptide A nucleic acid encoding one of the low nitrogen tolerance-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular low nitrogen tolerance-modulating polypeptide; i.e., for many amino acids, there is more than one nucleotide triplet that serves as the codon for the amino acid. Thus, codons in the coding sequence for a given low nitrogen tolerance-modulating polypeptide can be modified such that optimal expression in a particular plant species is obtained, using appropriate codon bias tables for that species.

In some cases, expression of a low nitrogen tolerance-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Low Nitrogen Tolerance-Modulating Polypeptide Polynucleotides and recombinant constructs described herein can be used to inhibit expression of a low nitrogen tolerance-modulating polypeptide in a plant species of interest. See, e.g., Matzke and Birchler, *Nature Reviews Genetics* 6:24-35 (2005); Akashi et al., *Nature Reviews Mol. Cell Biology* 6:413-422 (2005); Mittal, *Nature Reviews Genetics* 5:355-365 (2004); Dorsett and Tuschl, *Nature Reviews Drug Discovery* 3: 318-329 (2004); and *Nature Reviews RNA interference collection*, October 2005 at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding low nitrogen tolerance-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254, 678 and WO 02/46449 and references cited therein. Hammerhead ribozyme sequences can be embedded in a stable RNA such as a transfer RNA (tRNA) to increase cleavage efficiency in vivo. Perriman et al. (1995) *Proc. Natl. Acad. Sci. USA*, 92(13):6175-6179; de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a low nitrogen tolerance-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the low nitrogen tolerance-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a low nitrogen tolerance-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the low nitrogen tolerance-modulating polypeptide. In other embodiments, one strand of the stem portion of a double stranded RNA comprises a sequence that is similar or identical to the sequence of an intron, or a fragment thereof, in the premRNA encoding a low nitrogen tolerance-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a low nitrogen tolerance-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a low nitrogen tolerance-modulating polypeptide, or a fragment of such sequences. In some embodiments, the sense or antisense sequence is identical or complementary to a sequence of the regulatory region that drives transcription of the gene encoding a low nitrogen tolerance-modulating polypeptide. In each case, the sense sequence is the sequence that is complementary to the antisense sequence.

The sense and antisense sequences can be any length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a low nitrogen tolerance-modulating polypeptide described herein. The sense sequence complementary to the antisense sequence can be a sequence present within the mRNA of the low nitrogen tolerance-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences, or the left and right border-like sequences of the P-DNA, flank or are on either side of the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller (1997) *Antisense Nucleic Acid Drug Dev.*, 7:187-195; Hyrup et al. (1996) *Bioorgan. Med. Chem.*, 4:5-23. In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate low-nitrogen tolerance levels. A recombinant nucleic acid construct can comprise a nucleic acid encoding a low nitrogen tolerance-modulating polypeptide as described herein, operably linked to a regulatory region suitable for expressing the low nitrogen tolerance-modulating polypeptide in the plant or cell. Thus, a nucleic acid can comprise a coding sequence that encodes any of the low nitrogen tolerance-modulating polypeptides as set forth in SEQ ID NO:3, SEQ ID NO:49, SEQ ID NO:77, SEQ ID NO:97, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:556, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:853, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1157, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1437, SEQ ID NO:1463, SEQ ID NO:1491, SEQ ID NO:1510, SEQ ID NO:1525, SEQ ID NO:1537, SEQ ID NO:1554, and SEQ ID NO:1577. Examples of nucleic acids encoding low nitrogen tolerance-modulating polypeptides are set forth in SEQ ID NO:1, SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, and SEQ ID NO:1576. The low nitrogen tolerance-modulating polypeptide encoded by a recombinant nucleic acid can be a native low nitrogen tolerance-modulating polypeptide, or can be heterologous to the cell. In some cases, the recombinant construct contains a nucleic acid that inhibits expression of a low nitrogen tolerance-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, CA), Stratagene (La Jolla, CA), and Invitrogen/Life Technologies (Carlsbad, CA).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, 3-glucuronidase (GUS), green fluorescent protein (GFP), glutathione S-transferase (GST), polyhistidine, c-myc, hemagglutinin, or Flag™ tag (Kodak, New Haven, CT) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al. (1989) *Plant Cell*, 1:855-866; Bustos et al. (1989) *Plant Cell*, 1:839-854; Green et al. (1988) *EMBO J.*, 7:4035-4044; Meier et al. (1991) *Plant Cell*, 3:309-316; and Zhang et al. (1996) *Plant Physiology*, 110:1069-1079.

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/

011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al. (1989) *Proc. Natl. Acad. Sci. USA*, 86:7890-7894), root cell specific promoters reported by Conkling et al. (1990) *Plant Physiol.*, 93:1203-1211, and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al. (1989) *Plant Cell*, 1(9):839-853), the soybean trypsin inhibitor promoter (Riggs et al. (1989) *Plant Cell*, 1(6):609-621), the ACP promoter (Baerson et al. (1993) *Plant Mol. Biol.*, 22(2):255-267), the stearoyl-ACP desaturase promoter (Slocombe et al. (1994) *Plant Physiol.*, 104(4):167-176), the soybean α' subunit of β-conglycinin promoter (Chen et al. (1986) *Proc. Natl. Acad. Sci. USA*, 83:8560-8564), the oleosin promoter (Hong et al. (1997) *Plant Mol. Biol.*, 34(3):549-555), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al. (1993) *Mol. Cell Biol.*, 13:5829-5842), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.,* 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOs-FIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp 1) promoter (*Plant Cell Rep* (2001) 20:647-654), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al. (1994) *Plant Cell Physiol.,* 35:773-778), the Cab-1 promoter from wheat (Fejes et al. (1990) *Plant Mol. Biol.,* 15:921-932), the CAB-1 promoter from spinach (Lubberstedt et al. (1994) *Plant Physiol.,* 104:997-1006), the cab1R promoter from rice (Luan et al. (1992) *Plant Cell,* 4:971-981), the pyruvate orthophosphate dikinase (PPDK) promoter from corn (Matsuoka et al. (1993) *Proc. Natl. Acad. Sci. USA,* 90:9586-9590), the tobacco Lhcb1*2 promoter (Cerdan et al. (1997) *Plant Mol. Biol.,* 33:245-255), the *Arabidopsis thaliana* SUC2 sucrose-H+ symporter promoter (Truernit et al. (1995) *Planta,* 196:564-570), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner (1991) *Plant Cell,* 3(10):1051-1061), the *Commelina* yellow mottle virus (CoYMV) promoter (Medberry et al. (1992) *Plant Cell,* 4(2):185-192), and the rice tungro bacilliform virus (RTBV) promoter (Dai et al. (2004) *Proc. Natl. Acad. Sci. USA,* 101(2):687-692).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) *Nature Biotech* 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al. 2003, *Journal of New Seeds* 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a low nitrogen tolerance-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous low nitrogen tolerance-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a low nitrogen tolerance-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of low-nitrogen tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in low nitrogen tolerance level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp. or hybrid thereof, *Sorghum* spp. or hybrid thereof, sudangrass, *Miscanthus* spp. or hybrid thereof, *Saccharum* spp. or hybrid thereof, *Erianthus* spp., *Populus* spp., *Andropogon gerardii* (big bluestem), *Pennisetum purpureum* (elephant grass)) or hybrid thereof (e.g., *Pennisetum purpureum* x *Pennisetum typhoidum*), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed) or hybrid thereof, *Secale cereale* (rye), *Salix* spp. (willow), *Eucalyptus* spp. (*eucalyptus*), Triticosecale (*triticum*-wheat X rye), *Tripsicum dactyloides* (Eastern gammagrass), *Leymus cinereus* (basin wildrye), *Leymus condensatus* (giant wildrye) and bamboo.

In some embodiments, a suitable species can be a wild, weedy, or cultivated sorghum species such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare*, or hybrids such as *Sorghum* x *almum, Sorghum* x sudangrass or *Sorghum* x *drummondii*.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava).

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii*, and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (*petunia*) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledenous plants and plant cell systems, wherein such plants are hybrids of different species or varieties of a specific species (e.g., *Saccharum* sp. X *Miscanthus* sp., *Panicum virgatum* x *Panicum amarum, Panicum virgatum* x *Panicum amarulum*, and *Pennisetum purpureum* x *Pennisetum typhoidum*).

D. Transgenic Plant Phenotypes

In some embodiments, a plant in which expression of a low nitrogen tolerance-modulating polypeptide is modulated can have increased levels of photosynthetic efficiency in seedlings. For example, a low nitrogen tolerance-modulating polypeptide described herein can be expressed in a transgenic plant, resulting in increased levels of photosynthetic efficiency in growth conditions with low nitrogen sources. The level of photosynthetic efficiency can be increased by at least 0.25 percent, e.g., 0.25, 1, 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of photosynthetic efficiency in a corresponding control plant that does not express the transgene. In some embodiments, a plant in which expression of a low nitrogen tolerance-modulating polypeptide is modulated can have decreased levels of photosynthetic efficiency. The level of photosynthetic efficiency can be decreased by at least 0.25 percent, e.g., 0.25, 1, 2, 3, 4, 5, 10, 15, 20, 25, 30, 35, or more than 35 percent, as compared to the level of photosynthetic in a corresponding control plant that does not express the transgene.

In some embodiments, a plant in which expression of a low nitrogen tolerance-modulating polypeptide is modulated can have increased or decreased levels of photosynthetic efficiency in one or more green tissues, e.g., leaves, stems, bulbs, flowers, fruits, young seeds. For example, the level of photosynthetic efficiency can be increased by at least 0.25 percent, e.g., 0.25, 1, 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of photosynthetic efficiency in a corresponding control plant that does not express the transgene. In some embodiments, a plant in which expression of a low nitrogen tolerance-modulating polypeptide is modulated can have decreased levels of photosynthetic efficiency in one or more green tissues. The level of photosynthetic efficiency can be decreased by at least 0.25 percent, e.g., 0.25, 1, 2, 3, 4, 5, 10, 15, 20, 25, 30, 35, or more than 35 percent, as compared to the level of photosynthetic efficiency in a corresponding control plant that does not express the transgene.

Increases in photosynthetic efficiency in low-nitrogen growth conditions in such plants can provide improved plant growth in geographic locales where plant's intake of nitrogenous fertilizers is often insufficient. Decreases in photosynthetic efficiency, and hence less tolerance to low-nitrogen growth conditions in such plants can be useful for removing weeds and such from the environment, by applying to weeds and such. For example, a plant capable of inducing the decrease in photosynthetic efficiency can be prepared to apply for land improvements and such.

Typically, a difference in the level of photosynthetic efficiency in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the level of photosynthetic is statistically significant at $p<0.01$, $p<0.005$, or $p<0.001$. A statistically significant difference in, for example, the level of photosynthetic efficiency in a transgenic plant compared to the amount in cells of a control plant indicates that the recombinant nucleic acid present in the transgenic plant results in altered levels of photosynthetic efficiency.

In some embodiments, a plant in which expression of a low nitrogen tolerance-modulating polypeptide is modulated can have increased growth rates in seedlings. For example, a low nitrogen tolerance-modulating polypeptide described herein can be expressed in a transgenic plant, resulting in increased growth rate in growth conditions of limiting nitrogen sources. The growth rate can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the growth rate in a corresponding control plant that does not express the transgene. In some embodiments, a plant in which expression of a low nitrogen tolerance-modulating polypeptide is modulated can have decreased growth rates. The growth rate can be decreased by at least 2 percent, e.g., 2, 3, 4, 5, 10, 15, 20, 25, 30, 35, or more than 35 percent, as compared to the growth rate in a corresponding control plant that does not express the transgene. Growth rate can be measured in seedlings, developing, or mature plants and measured for periods of time such as about 1 hour, 3 hours, 6 hours, 12 hours, 1 day, 3 days, 5 days, 10 days, 1 month, 3 months, 6 months, 12 months, or the entire lifespan of a plant.

In some embodiments, a plant in which expression of a low nitrogen tolerance-modulating polypeptide is modulated can have increased or decreased growth rates in one or more vegetative and reproductive tissues, e.g., leaves, stems, flowers, bulbs, fruits, young seeds. For example, the growth rate can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the growth rate in a corresponding control plant that does not express the transgene. In some embodiments, a plant in which expression of a low nitrogen tolerance-modulating polypeptide is modulated can have decreased levels of growth rate in one or more vegetative tissues. The growth rate can be decreased by at least 2 percent, e.g., 2, 3, 4, 5, 10, 15, 20, 25, 30, 35, or more than 35 percent, as compared to the growth rate in a corresponding control plant that does not express the transgene.

Increases in growth rate in low-nitrogen conditions in such plants can provide improved plant growth and initial establishment in geographic locales where plant's intake of nitrogenous fertilizers is often insufficient. Decreases in growth rate, and hence less tolerance to low-nitrogen growth conditions in such plants can be useful for engineering slow-growing plants, by applying to ornamentals and such. For example, a plant capable of inducing the decrease in growth rate can be prepared to apply for land improvements and such.

Typically, a difference in the growth rate of a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the growth rate is statistically significant at $p<0.01$, $p<0.005$, or $p<0.001$. A statistically significant difference in, for example, the growth rate of a transgenic plant compared to the growth rate of a control plant indicates that the recombinant nucleic acid present in the transgenic plant results in altered growth rates.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, Si RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Plant Breeding

Genetic polymorphisms are discrete allelic sequence differences in a population. Typically, an allele that is present at 1% or greater is considered to be a genetic polymorphism. The discovery that polypeptides disclosed herein can modulate photosynthetic efficiency and/or nitrogen content is useful in plant breeding, because genetic polymorphisms exhibiting a degree of linkage with loci for such polypeptides are more likely to be correlated with variation in a low-nitrogen tolerance trait. For example, genetic polymorphisms linked to the loci for such polypeptides are more likely to be useful in marker-assisted breeding programs to create lines having a desired modulation in the low-nitrogen tolerance trait.

Thus, one aspect of the invention includes methods of identifying whether one or more genetic polymorphisms are associated with variation in a low-nitrogen tolerance trait. Such methods involve determining whether genetic polymorphisms in a given population exhibit linkage with the locus for one of the polypeptides depicted in FIGS. 1-57, SEQ ID NO:556, SEQ ID NO:853, SEQ ID NO:1157 and/or a functional homolog thereof, such as, but not limited to those identified in the Sequence Listing of this application. The correlation is measured between variation in the low-nitrogen tolerance trait in plants of the population and the presence of the genetic polymorphism(s) in plants of the population, thereby identifying whether or not the genetic polymorphism(s) are associated with variation for the trait. If the presence of a particular allele is statistically significantly correlated with a desired modulation in the low-nitrogen tolerance trait, the allele is associated with variation for the trait and is useful as a marker for the trait. If, on the other hand, the presence of a particular allele is not significantly correlated with the desired modulation, the allele is not associated with variation for the trait and is not useful as a marker.

Such methods are applicable to populations containing the naturally occurring endogenous polypeptide rather than an exogenous nucleic acid encoding the polypeptide, i.e., populations that are not transgenic for the exogenous nucleic acid. It will be appreciated, however, that populations suitable for use in the methods may contain a transgene for another, different trait, e.g., herbicide resistance.

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. If the probes flank an SSR in the population, PCR products of different sizes will be produced. See, e.g., U.S. Pat. No. 5,766,847. Alternatively, SSR polymorphisms can be identified by using PCR product(s) as a probe against Southern blots from different individuals in the population. See, U. H. Refseth et al. (1997) *Electrophoresis* 18: 1519. The identification of RFLPs is discussed, for example, in Alonso-Blanco et al. (Methods in Molecular Biology, vol. 82, "*Arabidopsis* Protocols", pp. 137-146, J. M. Martinez-Zapater and J. Salinas, eds., c. 1998 by Humana Press, Totowa, NJ); Burr ("Mapping Genes with Recombinant Inbreds", pp. 249-254, in Freeling, M. and V. Walbot (Ed.), The Maize Handbook, c. 1994 by Springer-Verlag New York, Inc.: New York, NY, USA; Berlin Germany; Burr et al. (1998) *Genetics* 118: 519; and Gardiner, J. et al. (1993) *Genetics* 134: 917). The identification of AFLPs is discussed, for example, in EP 0 534 858 and U.S. Pat. No. 5,878,215.

In some embodiments, the methods are directed to breeding a plant line. Such methods use genetic polymorphisms identified as described above in a marker assisted breeding program to facilitate the development of lines that have a desired alteration in the low-nitrogen tolerance trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VI. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought or limiting nitrogen sources. In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the nitrogenous composition of the plant material. By providing higher yields at an equivalent or even decreased cost of production, the transgenic plants described herein improve profitability for farmers and processors as well as decrease costs to consumers$_{[RCL1]}$.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VII. Examples

Example 1—Transgenic *Arabidopsis* Plants

The following symbols are used in the Examples with respect to *Arabidopsis* transformation: $T_1$: first generation transformant; $T_2$: second generation, progeny of self-pollinated $T_1$ plants; $T_3$: third generation, progeny of self-pollinated $T_2$ plants; $T_4$: fourth generation, progeny of self-pollinated $T_3$ plants. Independent transformations are referred to as events.

The following is a list of nucleic acids that were isolated from *Arabidopsis thaliana* plants, CeresClone: 29661 (SEQ ID NO:1), CeresClone: 251343 (SEQ ID NO:48), Ceres- Clone: 19586 (SEQ ID NO:76), CeresClone: 25136 (SEQ ID NO:96), CeresClone: 1820 (SEQ ID NO:99), CeresClone: 13102 (SEQ ID NO:151), CeresClone: 15457 (SEQ ID NO:165), Ceres Annot: 859276 (SEQ ID NO:175), CeresClone: 17883 (SEQ ID NO:185), CeresClone: 251590 (SEQ ID NO:207), CeresClone: 4898 (SEQ ID NO:217), CeresClone: 148977 (SEQ ID NO:233), CeresClone: 24255 (SEQ ID NO:245), CeresClone: 38432 (SEQ ID NO:299), Ceres Annot: 553243 (SEQ ID NO:331), CeresClone: 1011900 (SEQ ID NO:367), CeresClone: 5232 (SEQ ID NO:509), CeresClone: 29302 (SEQ ID NO:532), CeresClone: 93971 (SEQ ID NO:555), Ceres Annot: 12669619_cDNA (SEQ ID NO:557), CeresClone: 21608 (SEQ ID NO:592), CeresClone: 2031 (SEQ ID NO:612), CeresClone: 94503 (SEQ ID NO:645), CeresClone: 21740 (SEQ ID NO:686), CeresClone: 5609 (SEQ ID NO:729), CeresClone: 3137 (SEQ ID NO:745), CeresClone: 32430 (SEQ ID NO:768), CeresClone: 101255 (SEQ ID NO:791), Ceres Annot: 573161 (SEQ ID NO:854), Ceres Annot: 552727 (SEQ ID NO:890), CeresClone: 732 (SEQ ID NO:1193), CeresClone: 2267 (SEQ ID NO:1209), CeresClone: 39358 (SEQ ID NO:1273), CeresClone: 115046 (SEQ ID NO:1301), Ceres Annot: 850581 (SEQ ID NO:1427), Ceres Annot: 862321 (SEQ ID NO:1462), Ceres Annot: 839064 (SEQ ID NO:1478), Ceres Annot: 864666 (SEQ ID NO:1490), Ceres Annot: 875012 (SEQ ID NO:1509), Ceres Annot: 874016 (SEQ ID NO:1524), Ceres Annot: 827304 (SEQ ID NO:1536), Ceres Annot: 869192 (SEQ ID NO:1553), and Ceres Annot: 876419 (SEQ ID NO:1576). The nucleic acid designated Ceres Clone: 968180 (SEQ ID NO:1115) was isolated from the species *Brassica napus*. The nucleic acid designated Ceres Clone: 1017441 (SEQ ID NO:224) was isolated from the species *Triticum aesticum*. The following is a list of nucleic acids that were isolated from *Zea mays* plants, CeresClone: 1387146 (SEQ ID NO:981), CeresClone: 1408950 (SEQ ID NO:1098, CeresClone: 208453 (SEQ ID NO:1111), CeresClone: 208995 (SEQ ID NO:943), CeresClone: 225681 (SEQ ID NO:975), CeresClone: 239806 (SEQ ID NO:916), CeresClone: 244306 (SEQ ID NO:1053), CeresClone: 276809 (SEQ ID NO:823), CeresClone: 324216 (SEQ ID NO:852), CeresClone: 339439 (SEQ ID NO:1341), CeresClone: 424522 (SEQ ID NO:827), CeresClone: 896483 (SEQ ID NO:1384), CeresClone: 986438 (SEQ ID NO:1156), CeresClone: 988083 (SEQ ID NO:1184), CeresClone: 995409 (SEQ ID NO:1408), CeresClone: 996227 (SEQ ID NO:1158), and CeresClone: 996263 (SEQ ID NO:1165).

With the exception of Ceres Clone: 29661 (SEQ ID NO:1), each isolated nucleic acid described above was cloned into a Ti plasmid vector, CRS338, containing a phosphinothricin acetyltransferase gene which confers FINALE™ resistance to transformed plants. Constructs were made using CRS338 that contained SEQ ID NO:48, SEQ ID NO:76, SEQ ID NO:96, SEQ ID NO:99, SEQ ID NO:151, SEQ ID NO:165, SEQ ID NO:175, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1490, SEQ ID NO:1509, SEQ ID NO:1524, SEQ ID NO:1536, SEQ ID NO:1553, or SEQ ID NO:1576, each operably linked to a 35S promoter. Ceres Clone: 29661 (SEQ ID NO:1) was cloned into a Ti plasmid vector, CRS 311, containing a phosphinothricin acetyltransferase gene, which confers FINALE™ resistance to transformed plants. SEQ ID NO:1 was operably linked to a p32449 promoter in the constructs made using the CRS 331 vector. Wild-type *Arabidopsis thaliana* ecotype Wassilewskija (Ws) plants were transformed separately with each construct. The transformations were performed essentially as described in Bechtold et al. (1993) *C.R. Acad. Sci. Paris*, 316:1194-1199.

Transgenic *Arabidopsis* lines containing SEQ ID NO:1, SEQ ID NO:48, SEQ ID NO:76, SEQ ID NO:96, SEQ ID NO:99, SEQ ID NO:151, SEQ ID NO:165, SEQ ID NO:185, SEQ ID NO:207, SEQ ID NO:217, SEQ ID NO:233, SEQ ID NO:245, SEQ ID NO:299, SEQ ID NO:331, SEQ ID NO:367, SEQ ID NO:509, SEQ ID NO:532, SEQ ID NO:555, SEQ ID NO:557, SEQ ID NO:592, SEQ ID NO:612, SEQ ID NO:645, SEQ ID NO:686, SEQ ID NO:729, SEQ ID NO:745, SEQ ID NO:768, SEQ ID NO:791, SEQ ID NO:823, SEQ ID NO:827, SEQ ID NO:852, SEQ ID NO:854, SEQ ID NO:890, SEQ ID NO:916, SEQ ID NO:943, SEQ ID NO:975, SEQ ID NO:981, SEQ ID NO:224, SEQ ID NO:1053, SEQ ID NO:1098, SEQ ID NO:1111, SEQ ID NO:1115, SEQ ID NO:1156, SEQ ID NO:1158, SEQ ID NO:1165, SEQ ID NO:1184, SEQ ID NO:1193, SEQ ID NO:1209, SEQ ID NO:1273, SEQ ID NO:1301, SEQ ID NO:1341, SEQ ID NO:1384, SEQ ID NO:1408, SEQ ID NO:1427, SEQ ID NO:1462, SEQ ID NO:1478, SEQ ID NO:1490, SEQ ID NO:1509, SEQ ID NO:1524, SEQ ID NO:1536, SEQ ID NO:1553, SEQ ID NO:1576, or SEQ ID NO:175 were designated ME00919, ME01312, ME01463, ME01821, ME01910, ME02538, ME02603, ME02613, ME02801, ME03123, ME04204, ME04477, ME04507, ME04587, ME04753, ME04772, ME04909, ME05033, ME05194, ME05267, ME05300, ME05341, ME05392, ME05429, ME05493, ME05885, ME07344, ME07859, ME08464, ME09939, ME11735, ME12910, ME12927, ME12929, ME12954, ME12970, ME13006, ME13021, ME13064, ME13071, ME13087, ME13106, ME13107, ME13108, ME13110, ME13125, ME13149, ME13151, ME13153, ME13177, ME13200, ME13204, ME14649, ME16546, ME17457, ME17567, ME17932, ME17936, ME18275, ME18924, ME19182, or ME20628, respectively. The presence of each vector containing a nucleic acid described above in the respective transgenic *Arabidopsis* line transformed with the vector was confirmed by FINALE™ resistance, PCR amplification from green leaf tissue extract, and/or sequencing of PCR products. As controls, wild-type *Arabidopsis* ecotype Ws plants were transformed with the empty vector, either CRS338 or CRS311.

Example 2—Screening for Transgenic Plants Tolerant to Low-Nitrogen Growth Conditions A low-nitrogen tolerance screen was carried out on seedlings in order to identify transgenic lines that showed increased photosynthesis efficiency or seedling size or greenness under limiting nitrogen conditions relative to the internal control plants. The media used for the low-nitrogen tolerance assay contained 0.5% sucrose, 0.5×MS without nitrogen media (PhytoTech), 0.05% MES Hydrate, and 0.8% Phytagar. In addition, for low ammonium nitrate assay, 240 µM NH4NO3 was used as nitrogen source. For low nitrate assay, nitrogen source was 300 µM KNO3. pH of the media was adjusted to pH 5.7 using 10N KOH. Sterilized seeds were plated on agar plates and stratified for 2 days in the dark at 4° C. to promote uniform germination. Agar plates with germinating seedlings were placed horizontally in a CONVIRON® growth chamber set at 22° C., 16:8 hour light:dark cycle, 70% humidity with a combination of incandescent and fluorescent lamps emitting a light intensity of ~100 µEinsteins. The control plates were placed randomly within the set. Screen the seedlings daily starting at 14 days. In this screen, seedlings that were larger or greener relative to the internal controls on low nitrogen growth media were selected. As they were found each day, candidate seedlings were aseptically transplanted to standard MS germination plates for recovery. This intermediate recovery step was necessary before transplanting to soil to minimize the overall candidate mortality rate. The scoring and transplanting of candidates were continued until all remaining plants were small and yellowed from nitrogen stress. On the very last day of scoring, each plate was scanned for photosynthetic efficiency (Fv/Fm) on the chlorophyll fluorescence (CF) imager and scored as candidates and transplanted any extreme outliers on the high end of Fv/Fm scores. Fv/Fm ratio typically provides an estimate of the photosystem II (PSII) maximum efficiency within dark-adapted material where Fv is variable fluorescence, i.e. difference between minimum (Fo) and maximum (Fm) fluorescence signal, from dark-adapted material. This could be done visually by looking at the false color image for each seedling using the CF image analysis software (plants with high end Fv/Fm scores appear red). This step was typically done at ~24 days after germination. Seven days after being transferred to MS recovery plates, candidates were transplanted to soil (standard Sunshine:vermiculite 3:2 mix; Osmocote; Marathon). Five days after being transplanted to soil, candidates were sprayed with FINALE® [5 mL FINALE®/48 oz. water] to eliminate non-transgenics from the population. Two days after spraying with FINALE®, cauline leaf tissue of each candidate was collected for genomic DNA extraction, PCR, and sequencing to determine the identity of the transgene for each candidate.

Example 3—Validation Plate Assay

This assay was designed to validate transgenic lines that showed increased photosynthesis or size under limiting nitrogen conditions relative to the internal control. The media used for the low-nitrogen tolerance assay contained 0.5% sucrose, 0.5×MS without nitrogen media (PhytoTech), 0.05% MES Hydrate, and 0.8% Phytagar. pH of the media was adjusted to pH 5.7 using 10N KOH. In addition, for low ammonium nitrate assay, 240 µM NH$_4$NO$_3$ was used as nitrogen source. For low nitrate assay, nitrogen source was 300 µM KNO$_3$. Sterilized seeds were plated on agar plates and stratified for 2 days in the dark at 4° C. to promote uniform germination. Agar plates with germinating seedlings were placed horizontally in a CONVIRON® growth chamber set at 22° C., 16:8 hour light:dark cycle, 70% humidity with a combination of incandescent and fluorescent lamps emitting a light intensity of ~100 µEinsteins. The control plates were placed randomly within the set. Plates were scanned every other day using the CF Imager (after 45 minute of dark-acclimation) and were completed after all wild-type plants have completely yellowed. After the plates were scanned on the last day, they were sprayed with FINALE® (10 mL FINALE® into 48 oz. full-strength MS liquid media). Two days after spraying, each plate was dark-acclimated for 45 minutes and scanned for Fv/Fm on the CF imager and scored for each of the plants at each time point. For each separate time point, the data for all the T$_2$ transgenic plants across an event was pooled and a one-tailed t-test was used to compare both the Fv/Fm ratios and rosette areas relative to the pooled non-transgenics across the same plate. Whenever possible, this process was repeated for the T$_3$ generation plants. A low nitrogen tolerant candidate was confirmed when the transgenic Fv/Fm ratio and/or rosette area was greater than the wild-type segregants with a p-value≤0.05 in 2 or more events in both generations.

Example 4—Validation Soil Assay

A Low, Medium, and High Nitrogen experiment on soil was carried out to assess phenotypic characteristics at a mature point in the life cycle of *Arabidopsis*, as compared to seedling screens. The lines to be tested were originally identified through superpool screens for low nitrate and low ammonium nitrate tolerance. These lines were later individually assayed as seedlings on low nitrate and low ammonium nitrate agar. For this assay, MetroMix200 soil was mixed with vermiculite and Marathon™ (MetroMix200: vermiculite 3:2 mix; Osmocote; Marathon) autoclaved and cooled before use. Experimental plants and controls were randomized across the flats. Prior to sowing seed, each flat was watered with 3 L filtered water. Flats with 24 wells were filled with the following 3:2 ratios of MetroMix200 to Thermorock vermiculite. At the beginning of the experiment no nitrogen was provided until 2 weeks after germination when ¼ Hoaglands supplemented with KNO$_3$ at 25 ppm, 250 ppm, and 1500 ppm were used to water the flats from beneath.

Seeds were stratified on soil and in the dark at 4° C. for 3 days. After the cold treatment, flats were transferred to the growth chamber. Plants were grown for approximately 5 weeks, or until full grown/mature. Plants were then dark-acclimated for one hour. Chlorophyll fluorescence images were taken using a CF-Imager (Technologica, UK) according to the manufacturer's protocol to measure the performance and efficiency of photosystem II: 1) Fv/Fm, maximum photosystem II efficiency 2) Fq'/Fm', operating efficiency and 3) non-photochemical quenching (NPQ).

One week after watering with ¼ Hoaglands supplemented with various KNO$_3$ concentrations, plant rosette area measurements were taken using the WhinRhizo imaging software (Reagent Instruments, Canada). The plants were then collected in manila envelopes, placed in a 125° C. drying oven for 1-2 days and weighed.

Example 5—Analysis of ME00919 Events

ME00919 contains Ceres Clone: 29661 (At3g61880, SEQ ID NO:1) from *Arabidopsis thaliana*, which encodes a 534 amino acid cytochrome P450 protein. Evaluation of low-nitrogen tolerance for ME00919 in T$_2$ and T$_3$ was conducted under the same conditions as described in Example 2. In this study, the seedling photosynthetic efficiency was measured as Fv/Fm comparing transgenic plants within an event to non-transgenic segregants pooled across the same plate. Two events, -01 and -03, showed significantly increased photosynthetic efficiency relative to the internal controls in both generations at p≤0.05 using a one-tailed t-test assuming unequal variance. A summary of photosynthetic efficiency of ME00919 seedlings on low ammonium nitrate-containing media are shown in Table 1. Events -01 and -03 segregated 15:1 and 3:1 (R:S), respectively, for FINALE™ resistance in the $T_2$ generation. ME00919 events were also tested for enhanced growth on the low ammonium nitrate media. No significant differences between the transgenics and the controls were observed.

TABLE 1 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME00919 | ME00919-01 ($T_2$) | 0.65641304 | 46 | 0.595818 | 11 | $2.48 \times 10^{-2}$ |
| ME00919 | ME00919-01 ($T_3$) | 0.66348780 | 41 | 0.595818 | 11 | $1.55 \times 10^{-2}$ |
| ME00919 | ME00919-03 ($T_2$) | 0.67212195 | 41 | 0.634026 | 38 | $3.35 \times 10^{-3}$ |
| ME00919 | ME00919-03 ($T_3$) | 0.69278947 | 19 | 0.634026 | 38 | $2.39 \times 10^{-5}$ |

Events -01 and -03 of ME00919 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 6—Analysis of ME01312 Events

ME01312 contains Ceres Clone: 251343 (At3g21270, SEQ ID NO:48) from *Arabidopsis thaliana*, which encodes a 204 amino acid Dof zinc finger protein. Ceres Clone: 251343 shares approximately 40% amino acid identity to the corn Dof1 gene, which when overexpressed in *Arabidopsis*, has shown to confer tolerance to plants receiving low nitrogen stress (Yanagisawa et al., 2004). Evaluation of low-nitrogen tolerance for ME01312 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -11, showed significantly enhanced photosynthetic efficiency on either low nitrate or low ammonium nitrate-containing media after 16 and 17 days compared to the internal controls in both generations at $p \leq 0.05$ using a one-tailed t-test assuming unequal variance. Event -03 had a slightly greater p-value than 0.05 in the $T_3$ generation for the low nitrate screen, significant at $p \leq 0.10$. A summary of photosynthetic efficiency of ME01312 seedlings on either low nitrate or low ammonium nitrate-containing media is shown in Table 2. Events -03 and -11 segregated 3:1 (R:S), respectively, for FINALE™ resistance in the $T_2$ generation.

TABLE 2

A. T-test comparison of photosynthetic efficiency between transgenic seedlings and pooled non-transgenic segregants after 16 days of growth on low nitrate.

| Line | Events | Transgenic Fv/Fm | n | Pooled Non-Transgenics Fv/Fm | n | t-test p-value |
|---|---|---|---|---|---|---|
| ME01312 | ME01312-03 ($T_2$) | 0.63 | 38 | 0.60 | 58 | 0.03 |
| ME01312 | ME01312-03 ($T_3$) | 0.63 | 38 | 0.60 | 58 | 0.07 |
| ME01312 | ME01312-11 ($T_2$) | 0.64 | 41 | 0.60 | 58 | 0.019 |
| ME01312 | ME01312-11 ($T_3$) | 0.64 | 47 | 0.60 | 58 | $9.89 \times 10^{-3}$ |

B. T-test comparison of photosynthetic efficiency between transgenic seedlings and pooled non-transgenic segregants after 17 days of growth on low ammonium nitrate.

| ME01312 | ME01312-03 ($T_2$) | 0.64 | 36 | 0.61 | 88 | $2.64 \times 10^{-3}$ |
| ME01312 | ME01312-03 ($T_3$) | 0.66 | 27 | 0.61 | 88 | $1.87 \times 10^{-5}$ |
| ME01312 | ME01312-11 ($T_2$) | 0.65 | 35 | 0.61 | 88 | $7.06 \times 10^{-4}$ |
| ME01312 | ME01312-11 ($T_3$) | 0.64 | 37 | 0.61 | 88 | 0.011 |

Events -03-11 of ME01312 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 7—Analysis of ME01463 Events

ME01463 contains Ceres Clone: 19586 (At1g80600, SEQ ID NO:76) from *Arabidopsis thaliana*, which encodes a 457 acetylornithine aminotransferase, a member of the Class-III aminotransferase family. Evaluation of low-nitrogen tolerance for ME01463 in two generations was conducted under the same conditions as described in Examples 2 and 3. In this study, the seedling photosynthetic efficiency was measured as Fv/Fm comparing transgenic plants within an event to non-transgenic segregants pooled across the same plate. Three events, -02, -06, and -10, showed significantly increased photosynthetic efficiency on low ammonium nitrate containing-media relative to the internal controls in both generations at $p \leq 0.05$ using a one-tailed t-test assuming unequal variance. A summary of photosynthetic efficiency of ME01463 seedlings is shown in Table 3. Events -02, -06, and -10 segregated 2:1, 2:1 and 3:1 (R:S), respectively, for FINALE™ resistance in the $T_2$ generation. ME01463 events were also tested for enhanced growth on the low ammonium nitrate media. No significant differences between the transgenics and the controls were observed (data not shown).

TABLE 3

T-test comparison of seedling photosynthetic efficiency between
transgenic seedlings and pooled non-transgenic segregants
after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME01463 | ME01463-02 ($T_3$) | 0.6815 | 26 | 0.6376 | 122 | $2.47 \times 10^{-4}$ |
| ME01463 | ME01463-02 ($T_4$) | 0.6701 | 41 | 0.6376 | 122 | $1.57 \times 10^{-3}$ |
| ME01463 | ME01463-06 ($T_3$) | 0.6615 | 31 | 0.6376 | 122 | $2.37 \times 10^{-2}$ |
| ME01463 | ME01463-06 ($T_4$) | 0.6881 | 35 | 0.6376 | 122 | $5.85 \times 10^{-6}$ |
| ME01463 | ME01463-10 ($T_2$) | 0.6699 | 33 | 0.6376 | 122 | $2.25 \times 10^{-3}$ |
| ME01463 | ME01463-10 ($T_3$) | 0.6809 | 18 | 0.6376 | 122 | $4.60 \times 10^{-4}$ |

Events -02, -06, and -10 of ME01463 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 8—Analysis of ME01821 Events

ME01821 contains Ceres Clone: 25136 (At1g65500, SEQ ID NO:96) from *Arabidopsis thaliana*, which encodes a 86 amino acid protein of unknown function. Evaluation of low-nitrogen tolerance for ME01821 in $T_2$ generation was conducted under the same conditions as described in Examples 2 and 3. In this study, the seedling photosynthetic efficiency was measured as Fv/Fm comparing transgenic plants within an event to non-transgenic segregants pooled across the same plate. Three events, -01, -04 and -05, showed significantly increased photosynthetic efficiency on low nitrate-containing media relative to the internal controls in $T_2$ generation. Two events, -04 and -05, showed significantly increased photosynthetic efficiency on low ammonium nitrate-containing media relative to the internal controls in $T_2$ generation at p≤0.05 using a one-tailed t-test assuming unequal variance. A summary of photosynthetic efficiency of ME01821 seedlings is shown in Table 4.

TABLE 4

A. T-test comparison of seedling photosynthetic efficiency
between transgenic seedlings and pooled non-transgenic
segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME01821 | ME01821-01 ($T_2$) | 0.6745 | 15 | 0.6520 | 33 | $3.76 \times 10^{-2}$ |
| ME01821 | ME01821-04 ($T_2$) | 0.6826 | 17 | 0.6614 | 14 | $2.76 \times 10^{-2}$ |
| ME01821 | ME01821-05 ($T_2$) | 0.6826 | 20 | 0.6614 | 14 | $3.74 \times 10^{-2}$ |

TABLE 4-continued

A. T-test comparison of seedling photosynthetic efficiency
between transgenic seedlings and pooled non-transgenic
segregants after 14 days of growth on low nitrate.

B. T-test comparison of seedling photosynthetic efficiency between
transgenic seedlings and pooled non-transgenic segregants
after 18 days of growth on low ammonium nitrate.

| ME01821 | ME01821-04 ($T_2$) | 0.7422 | 13 | 0.7166 | 21 | $5.20 \times 10^{-3}$ |
|---|---|---|---|---|---|---|
| ME01821 | ME01821-05 ($T_2$) | 0.7426 | 19 | 0.7166 | 21 | $6.07 \times 10^{-3}$ |

A summary of the enhanced growth of ME01812 events on either low nitrate- or low ammonium nitrate-containing media is shown in Table 5. For two events -01 and -05, transgenic seedlings were found significantly larger than the pooled non-transgenic segregants after 14 days of growth on low nitrate-containing media (Table 5A). Transgenic seedlings of two events -02 and -05 were found significantly larger than the pooled non-transgenic segregants after 14 days of growth on low ammonium nitrate-containing media (Table 5B). In this study, the seedling area for transgenic plants within an event was compared to the seedling area for non-transgenic segregants pooled across the same line.

TABLE 5A

T-test comparison of seedling area between transgenic
seedlings and pooled non-transgenic segregants
after 14 days of growth on low nitrate.

| Line | Events | Transgenic Area | n | Pooled Non-Transgenics Area | n | t-test p-value |
|---|---|---|---|---|---|---|
| ME01821 | ME01821-01 ($T_2$) | 0.0608 | 15 | 0.0555 | 33 | $3.97 \times 10^{-2}$ |
| ME01821 | ME01821-05 ($T_2$) | 0.0666 | 20 | 0.0530 | 14 | $3.05 \times 10^{-6}$ |

TABLE 5B

T-test comparison of seedling area between transgenic
seedlings and pooled non-transgenic segregants after
18 days of growth on low ammonium nitrate.

| Line | Events | Transgenic Area | n | Pooled Non-Transgenics Area | n | t-test p-value |
|---|---|---|---|---|---|---|
| ME01821 | ME01821-02 ($T_2$) | 0.0750 | 19 | 0.0567 | 21 | $8.94 \times 10^{-5}$ |
| ME01821 | ME01821-05 ($T_2$) | 0.0680 | 19 | 0.0567 | 21 | $7.89 \times 10^{-3}$ |

Example 9—Analysis of ME01910 Events

ME01910 contains Ceres Clone: 1820 (At2g30620, SEQ ID NO:99) from *Arabidopsis thaliana*, which encodes a 273 amino acid linker histone H1 and H5 family protein. Evaluation of low-nitrogen tolerance for ME01910 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -02, showed significantly increased photosynthetic efficiency relative to the internal controls in both generations at $p \leq 0.05$ using a one-tailed t-test assuming unequal variance. A summary of photosynthetic efficiency of ME01910 seedlings is shown in Table 6. Events -01 and -02 segregated 3:1 (R:S) for FINALE™ resistance in the $T_2$ generation. ME01910 events were also tested for enhanced growth on the low ammonium nitrate media. No significant differences between the transgenics and the controls were observed.

TABLE 6 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME01910 | ME01910-01 ($T_2$) | 0.60433 | 39 | 0.56396 | 27 | $2.03 \times 10^{-2}$ |
| ME01910 | ME01910-01 ($T_3$) | 0.61274 | 31 | 0.56396 | 27 | $9.23 \times 10^{-3}$ |
| ME01910 | ME01910-02 ($T_2$) | 0.62705 | 37 | 0.58083 | 29 | $7.39 \times 10^{-3}$ |
| ME01910 | ME01910-02 ($T_3$) | 0.64146 | 24 | 0.58083 | 29 | $9.23 \times 10^{-4}$ |

Events -01 and -02 of ME01910 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 10—Analysis of ME02538 Events

ME02538 contains Ceres Clone: 13102 (At1g67920, SEQ ID NO:151) from *Arabidopsis thaliana*, which encodes a 67 amino acid protein of unknown function. Evaluation of low-nitrogen tolerance for ME02538 in $T_2$ generation was conducted under the same conditions as described in Example 2. In this study, the seedling photosynthetic efficiency was measured as Fv/Fm comparing transgenic plants within an event to non-transgenic segregants pooled across the same plate. Two events, -04 and -05, showed significantly increased photosynthetic efficiency relative to the internal controls in $T_2$ generation on both low nitrate-containing and ammonium nitrate-containing media at $p \leq 0.05$ using a one-tailed t-test assuming unequal variance. A summary of photosynthetic efficiency of ME01821 seedlings is shown in Table 7.

TABLE 7

A. T-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME02538 | ME02538-04 ($T_2$) | 0.6686 | 15 | 0.6171 | 24 | $1.92 \times 10^{-4}$ |
| ME02538 | ME02538-05 ($T_2$) | 0.6420 | 20 | 0.6171 | 24 | $4.84 \times 10^{-2}$ |

B. T-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME02538 | ME02538-04 ($T_2$) | 0.7345 | 13 | 0.7080 | 22 | $4.45 \times 10^{-3}$ |
| ME02538 | ME02538-05 ($T_2$) | 0.7356 | 20 | 0.7080 | 22 | $5.93 \times 10^{-3}$ |

ME02538 events were also tested for enhanced growth on the low ammonium nitrate media. A summary of the growth assay performed on ME01812 events is shown in Table 8. Transgenic seedlings of two events -01 and -02 were found significantly larger than the pooled non-transgenic segregants on both low nitrate- (Table 8A) and low ammonium nitrate-containing media (Table 8B).

TABLE 8A

T-test comparison of seedling area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME02538 | ME02538-01 ($T_2$) | 0.0655 | 16 | 0.0558 | 36 | $2.80 \times 10^{-4}$ |
| ME02538 | ME02538-02 ($T_2$) | 0.0651 | 13 | 0.0601 | 20 | $1.32 \times 10^{-2}$ |

TABLE 8B

T-test comparison of seedling area between transgenic seedlings and pooled non-transgenic segregants after 18 days of growth on low ammonium nitrate.

| Line | Events | Transgenic Area | n | Pooled Non-Transgenics Area | n | t-test p-value |
|---|---|---|---|---|---|---|
| ME02538 | ME02538-01 ($T_2$) | 0.0856 | 15 | 0.0737 | 39 | $8.60 \times 10^{-3}$ |
| ME02538 | ME02538-02 ($T_2$) | 0.0864 | 14 | 0.0776 | 22 | $3.13 \times 10^{-2}$ |

Example 11—Analysis of ME02603 Events

ME02603 contains Ceres Clone: 15457 (At5g47610, SEQ ID NO:165) from *Arabidopsis thaliana*, which encodes a 166 amino acid zinc ion binding protein. Evaluation of low-nitrogen tolerance for ME02603 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -04, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME02603 seedlings is shown in Table 9. Events -01 and -04 segregated 3:1 (R:S) for FINALE™ resistance in the $T_2$ generation. Transgenic plants of two events -01 and -04—were also tested for enhanced photosynthetic efficiency on the low nitrate media. No significant differences between the transgenics and the controls were observed.

TABLE 9

T-test comparison of photosynthetic efficiency between transgenic seedlings and pooled non-transgenic segregants after 17 days (21 days for the $T_2$ generation of ME02603-01) of growth on low ammonium nitrate.

| Line | Events | Transgenic Fv/Fm | n | Pooled Non-Transgenics Fv/Fm | n | t-test p-value |
|---|---|---|---|---|---|---|
| ME02603 | ME02603-01 ($T_2$) | 0.61 | 10 | 0.54 | 32 | $9.00 \times 10^{-4}$ |
| ME02603 | ME02603-01 ($T_3$) | 0.67 | 28 | 0.65 | 62 | $6.11 \times 10^{-3}$ |
| ME02603 | ME02603-04 ($T_2$) | 0.69 | 25 | 0.65 | 62 | $4.45 \times 10^{-5}$ |
| ME02603 | ME02603-04 ($T_3$) | 0.68 | 24 | 0.65 | 62 | $7.53 \times 10^{-3}$ |

Events -01 and -04 of ME02603 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 12—Analysis of ME02613 Events

ME02613 contains Ceres Clone: 17883 (At3g13910, SEQ ID NO:185) from *Arabidopsis thaliana*, which encodes a 102 amino acid protein of unknown function. Evaluation of low-nitrogen tolerance for ME02613 in $T_2$ generation was conducted under the same conditions as described in Examples 2 and 3. In this study, the seedling photosynthetic efficiency was measured as Fv/Fm comparing transgenic plants within an event to non-transgenic segregants pooled across the same plate. In $T_2$ generation, two events, -01 and -04, showed significantly increased photosynthetic efficiency on low nitrate containing-media relative to the internal controls in $T_2$ generation at $p \leq 0.05$ using a one-tailed t-test assuming unequal variance. Two events, -03 and -04, showed significantly increased photosynthetic efficiency on low ammonium nitrate containing-media relative to the internal controls in $T_2$ generation at $p \leq 0.05$ using a one-tailed t-test assuming unequal variance. A summary of photosynthetic efficiency of ME02613 seedlings is shown in Table 10.

TABLE 10

A. T-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME02613 | ME02613-01 ($T_2$) | 0.6979 | 16 | 0.6630 | 21 | $1.45 \times 10^{-2}$ |
| ME02613 | ME02613-04 ($T_2$) | 0.7046 | 13 | 0.6630 | 21 | $5.73 \times 10^{-4}$ |

B. T-test comparison of seedling photosynthetic efficiency between transgenic seedlings and pooled non-transgenic segregants after 18 days of growth on low ammonium nitrate.

| ME02613 | ME02613-03 ($T_2$) | 0.7270 | 9 | 0.7068 | 29 | $4.34 \times 10^{-2}$ |
| ME02613 | ME02613-04 ($T_2$) | 0.7485 | 15 | 0.7068 | 29 | $7.09 \times 10^{-5}$ |

A summary of the enhanced growth of ME02613 events on either low nitrate- or low ammonium nitrate-containing media is shown in Table 11. For two events -01 and -03, transgenic seedlings were found significantly larger than the pooled non-transgenic segregants after 14 days of growth on low nitrate-containing media (Table 11A). Transgenic seedlings of two events -02 and -03 were found significantly larger than the pooled non-transgenic segregants after 14 days of growth on low ammonium nitrate-containing media (Table 11B).

TABLE 11A

T-test comparison of seedling area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME02613 | ME02613-01 ($T_2$) | 0.05706 | 16 | 0.05259 | 31 | $4.71 \times 10^{-2}$ |
| ME02613 | ME02613-03 ($T_2$) | 0.06236 | 12 | 0.05789 | 29 | $2.39 \times 10^{-2}$ |

TABLE 1

T-test comparison of seedling area between transgenic seedlings and pooled non-transgenic segregants after 18 days of growth on low ammonium nitrate.

| Line | Events | Transgenic Area | n | Pooled Non-Transgenics Area | n | t-test p-value |
|---|---|---|---|---|---|---|
| ME02613 | ME02613-02 ($T_2$) | 0.08324 | 14 | 0.07018 | 29 | $2.72 \times 10^{-4}$ |
| ME02613 | ME02613-03 ($T_2$) | 0.08273 | 9 | 0.07018 | 29 | $1.41 \times 10^{-2}$ |

Example 13—Analysis of ME02801 Events

ME02801 contains Ceres Clone: 251590 (At3g53080, SEQ ID NO:207) from *Arabidopsis thaliana*, which encodes a 155 amino acid protein of unknown function. Evaluation of low-nitrogen tolerance for ME02801 in $T_2$ and $T_3$ was conducted under the same conditions as described in Example 2 and 3. In this study, the seedling photosynthetic efficiency was measured as Fv/Fm comparing transgenic plants within an event to non-transgenic segregants pooled across the same plate. Two events, -02 and -04, showed significantly increased photosynthetic efficiency on low nitrate-containing media relative to the internal controls in both generations at $p \leq 0.05$ using a one-tailed t-test assuming unequal variance. A summary of photosynthetic efficiency of ME02801 seedlings is shown in Table 12. Events -02 and -04 segregated 3:1 (R:S) for FINALE™ resistance in the $T_2$ generation. ME02801 events were also tested for enhanced growth on the low nitrate media and enhanced photosynthetic efficiency and growth on low ammonium nitrate media. No significant differences between the transgenics and the controls were observed.

TABLE 12 t-test comparison of seedling photosynthetic efficiency between transgenic seedlings and pooled non-transgenic segregants after 14 days of growth on low nitrate.

| Line | Events | Transgenic | | Pooled Non-Transgenics | | t-test |
|------|--------|------------|---|------------------------|---|--------|
|      |        | Fv/Fm | n | Fv/Fm | n | p-value |
| ME02801 | ME02801-02 ($T_2$) | 0.536385 | 39 | 0.465903 | 113 | $5.49 \times 10^{-7}$ |
| ME02801 | ME02801-02 ($T_3$) | 0.536465 | 43 | 0.465903 | 113 | $5.11 \times 10^{-7}$ |
| ME02801 | ME02801-04 ($T_2$) | 0.532419 | 31 | 0.465903 | 113 | $1.28 \times 10^{-5}$ |
| ME02801 | ME02801-04 ($T_3$) | 0.510406 | 32 | 0.465903 | 113 | $1.74 \times 10^{-2}$ |

Events -02 and -04 of ME02801 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 14—Analysis of ME03123 Events

ME03123 contains Ceres Clone: 4898 (At1g29970, SEQ ID NO:217) from *Arabidopsis thaliana*, which encodes a 158 amino acid protein of unknown function. Evaluation of low-nitrogen tolerance for ME03123 in $T_2$ and/or $T_3$ was conducted under the same conditions as described in Examples 2 and 3. In this study, the seedling photosynthetic efficiency was measured as Fv/Fm comparing transgenic plants within an event to non-transgenic segregants pooled across the same plate. A summary of photosynthetic efficiency of ME03123 seedlings is shown in Table 13. Two events, -01 and -10, showed significantly increased photosynthetic efficiency on low nitrate- or low ammonium nitrate-containing media relative to the internal controls in $T_2$ or $T_3$ generation at $p \leq 0.05$ using a one-tailed t-test assuming unequal variance.

TABLE 13

A. T-test comparison of seedling photosynthetic efficiency between transgenic seedlings and pooled non-transgenic segregants after 14 days of growth on low nitrate.

| Line | Events | Transgenic | | Pooled Non-Transgenics | | t-test |
|------|--------|------------|---|------------------------|---|--------|
|      |        | Fv/Fm | n | Fv/Fm | n | p-value |
| ME03123 | ME03123-01 ($T_2$) | 0.6282 | 15 | 0.5732 | 26 | $6.60 \times 10^{-5}$ |
| ME03123 | ME03123-10 ($T_3$) | 0.6069 | 12 | 0.5732 | 26 | $1.05 \times 10^{-2}$ |

B. T-test comparison of seedling photosynthetic efficiency between transgenic seedlings and pooled non-transgenic segregants after 18 days of growth on low ammonium nitrate.

| ME03123 | ME03123-01 ($T_2$) | 0.6736 | 17 | 0.6315 | 16 | $1.74 \times 10^{-2}$ |
| ME03123 | ME03123-10 ($T_3$) | 0.6699 | 20 | 0.6315 | 16 | $1.60 \times 10^{-2}$ |

ME03123 events were also tested for enhanced growth on the low ammonium nitrate media. In this assay, transgenic seedlings of ME03123-02 and ME03123-04 ($T_2$) were significantly larger than the pooled non-transgenic segregants after 14 days of growth on low nitrate (Table 14).

TABLE 14

T-test comparison of seedling area between transgenic seedlings and pooled non-transgenic segregants after 14 days of growth on low nitrate.

| Line | Events | Transgenic | | Pooled Non-Transgenics | | t-test |
|------|--------|------------|---|------------------------|---|--------|
|      |        | Area | n | Area | n | p-value |
| ME03123 | ME03123-02 ($T_2$) | 0.07235 | 19 | 0.05623 | 20 | $1.41 \times 10^{-6}$ |
| ME03123 | ME03123-04 ($T_3$) | 0.06571 | 7 | 0.05729 | 41 | $7.74 \times 10^{-3}$ |

Example 15—Analysis of ME04204 Events

ME04204 contains Ceres Clone: 148977 (At1g78770, SEQ ID NO:233) from *Arabidopsis thaliana*, which encodes a 159 amino acid anaphase promoting complex/cyclosome subunit protein. However, it is also possible that this is natural variant transcript produced by the plant, because multiple annotations for locus At1g78770 were found in public domain. Evaluation of low-nitrogen tolerance for ME04204 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -05, showed significantly increased photosynthetic efficiency relative to the internal controls in both generations at $p \leq 0.05$ using a one-tailed t-test assuming unequal variance. A summary of photosynthetic efficiency of ME04204 seedlings is shown in Table 15. Events -01 and -05 segregated 3:1 (R:S) for FINALE™ resistance in the $T_2$ generation. ME04204 events were also tested for enhanced growth on the low nitrate media. No significant differences between the transgenics and the controls were observed.

TABLE 15

T-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME04204 | ME04204-01 ($T_2$) | 0.623676 | 34 | 0.585504 | 121 | $2.15 \times 10^{-4}$ |
| ME04204 | ME04204-01 ($T_3$) | 0.627706 | 17 | 0.585504 | 121 | $8.22 \times 10^{-5}$ |
| ME04204 | ME04204-05 ($T_2$) | 0.615857 | 35 | 0.585504 | 121 | $9.41 \times 10^{-3}$ |
| ME04204 | ME04204-05 ($T_3$) | 0.611419 | 43 | 0.585504 | 121 | $1.25 \times 10^{-2}$ |

Events -01 and -05 of ME04204 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 16—Analysis of ME04477 Events

ME04477 contains Ceres Clone: 24255 (At2g36320, SEQ ID NO:245) from *Arabidopsis thaliana*, which encodes a 161 amino acid DNA binding/zinc ion binding protein. Evaluation of low-nitrogen tolerance for ME04477 in $T_2$ and $T_3$ was conducted under the same conditions as described in Example 2. In this study, the seedling photosynthetic efficiency was measured as Fv/Fm comparing transgenic plants within an event to non-transgenic segregants pooled across the same plate. Two events, -01 and -05, showed significantly increased photosynthetic efficiency on low nitrate-containing media relative to the internal controls in both generations at $p \leq 0.05$ using a one-tailed t-test assuming unequal variance. A summary of photosynthetic efficiency of ME04477 seedlings is shown in Table 16. Events -01 and -05 segregated 3:1 (R:S) for FINALE™ resistance in the $T_2$ generation. ME04477 events were also tested for enhanced growth on the low nitrate media. No significant differences between the transgenics and the controls were observed.

TABLE 16

T-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME04204 | ME04204-01 ($T_2$) | 0.623676 | 34 | 0.585504 | 121 | $2.15 \times 10^{-4}$ |
| ME04204 | ME04204-01 ($T_3$) | 0.627706 | 17 | 0.585504 | 121 | $8.22 \times 10^{-5}$ |
| ME04204 | ME04204-05 ($T_2$) | 0.615857 | 35 | 0.585504 | 121 | $9.41 \times 10^{-3}$ |
| ME04204 | ME04204-05 ($T_3$) | 0.611419 | 43 | 0.585504 | 121 | $1.25 \times 10^{-2}$ |

Events -01 and -05 of ME04477 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 17—Analysis of ME04507 Events

ME04507 contains Ceres Clone: 38432 (At4g38250, SEQ ID NO:299) from *Arabidopsis thaliana*, which encodes a 436 amino acid transmembrane amino acid transporter protein. Evaluation of low-nitrogen tolerance for ME04507 in $T_2$ and $T_3$ was conducted under the same conditions as described in Example 2. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low nitrate-containing media relative to the internal controls in both generations at $p \leq 0.05$ using a one-tailed t-test assuming unequal variance. A summary of photosynthetic efficiency of ME04507 seedlings is shown in Table 17. Events -03 and -04 segregated 15:1 and 3:1 (R:S), respectively, for FINALE™ resistance in the $T_2$ generation. ME04507 events were also tested for enhanced growth on the low nitrate media. No significant differences between the transgenics and the controls were observed.

TABLE 17

T-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME04507 | ME04507-03 ($T_2$) | 0.57753 | 40 | 0.53084 | 103 | $4.90 \times 10^{-4}$ |
| ME04507 | ME04507-03 ($T_3$) | 0.56318 | 39 | 0.53084 | 103 | $2.64 \times 10^{-2}$ |
| ME04507 | ME04507-04 ($T_2$) | 0.57708 | 38 | 0.53084 | 103 | $6.12 \times 10^{-3}$ |
| ME04507 | ME04507-04 ($T_3$) | 0.57277 | 22 | 0.53084 | 103 | $2.35 \times 10^{-2}$ |

Events -03 and -04 of ME04507 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 18—Analysis of ME04587 Events

ME04587 contains Ceres Annot: 553243 (At2g27010, SEQ ID NO:331) from *Arabidopsis thaliana*, which encodes a 516 amino acid cytochrome P450 protein. Evaluation of low-nitrogen tolerance for ME04587 in $T_2$ and $T_3$ was conducted under the same conditions as described in Example 2. In this study, the seedling photosynthetic efficiency was measured as Fv/Fm comparing transgenic plants within an event to non-transgenic segregants pooled across the same plate. Two events, -01 and -02, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME04587 seedlings is shown in Table 18. In $T_2$ generation, events -01 and -02 segregated 1:1 and 47:1 respectively (R:S) for FINALE™ resistance. These two events segregated 2:1 and 7:1 respectively (R:S) for FINALE® resistance in the $T_3$ generation.

TABLE 18

T-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME04587 | ME04587-01 ($T_2$) | 0.6424 | 10 | 0.5437 | 30 | $2.48 \times 10^{-3}$ |
| ME04587 | ME04587-01 ($T_3$) | 0.6165 | 25 | 0.5437 | 30 | $1.24 \times 10^{-2}$ |
| ME04587 | ME04587-02 ($T_2$) | 0.6022 | 47 | 0.5437 | 30 | $3.08 \times 10^{-2}$ |
| ME04587 | ME04587-02 ($T_3$) | 0.6310 | 43 | 0.5437 | 30 | $3.68 \times 10^{-3}$ |

ME04587 events were also tested for enhanced growth on the low ammonium nitrate media. In addition, these events were tested on low nitrate media for increased seedling area and photosynthetic efficiency. No statistically significant differences between the transgenics and the controls were observed.

Events -01 and -02 of ME04587 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 19—Analysis of ME04753 Events

ME04753 contains Ceres Clone: 1011900 (At2g21660, SEQ ID NO:367) from *Arabidopsis thaliana*, which encodes a 130 amino acid glycine-rich RNA binding protein. Evaluation of low-nitrogen tolerance for ME04753 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -02, showed significantly increased photosynthetic efficiency on low nitrate-containing media relative to the internal controls in both generations at $p \leq 0.05$ using a one-tailed t-test assuming unequal variance. A summary of photosynthetic efficiency of ME04753 seedlings is shown in Table 19. Events -01 and -02 segregated 3:1 and 2:1 respectively (R:S) for FINALE™ resistance in the $T_2$ generation. ME04753 events were also tested for enhanced growth on the low nitrate media. No significant differences between the transgenics and the controls were observed.

TABLE 19

T-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME04753 | ME04753-01 ($T_2$) | 0.49323 | 39 | 0.45917 | 66 | $3.17 \times 10^{-2}$ |
| ME04753 | ME04753-01 ($T_3$) | 0.50942 | 26 | 0.45917 | 66 | $1.80 \times 10^{-2}$ |
| ME04753 | ME04753-02 ($T_2$) | 0.49856 | 34 | 0.45917 | 66 | $2.43 \times 10^{-2}$ |
| ME04753 | ME04753-02 ($T_3$) | 0.51274 | 27 | 0.45917 | 66 | $1.15 \times 10^{-2}$ |

Events -01 and -02 of ME04753 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 20—Analysis of ME04772 Events

ME04772 contains Ceres Clone: 5232 (At1g13380, SEQ ID NO:509) from *Arabidopsis thaliana*, which encodes a 188 amino acid protein of unknown function. Evaluation of low-nitrogen tolerance for ME04772 in $T_2$ and $T_3$ was conducted under the same conditions as described in Example 2. In this study, the seedling photosynthetic efficiency was measured as Fv/Fm comparing transgenic plants within an event to non-transgenic segregants pooled across the same plate. Two events, -02 and -04, showed significantly increased photosynthetic efficiency on low nitrate-containing media relative to the internal controls in both generations at $p \leq 0.05$ using a one-tailed t-test assuming unequal variance. A summary of photosynthetic efficiency of ME04772 seedlings is shown in Table 20. Events -02 and -04 segregated 2:1 and 3:1 respectively (R:S) for FINALE™ resistance in the $T_2$ generation. ME04772 events were also tested for enhanced growth on the low nitrate media. No significant differences between the transgenics and the controls were observed.

TABLE 20

T-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME04772 | ME04772-02 ($T_2$) | 0.53708 | 25 | 0.46204 | 53 | $3.36 \times 10^{-5}$ |
| ME04772 | ME04772-02 ($T_3$) | 0.53121 | 34 | 0.46204 | 53 | $1.27 \times 10^{-4}$ |

TABLE 20-continued

T-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME04772 | ME04772-04 ($T_2$) | 0.52921 | 34 | 0.46204 | 53 | $3.71 \times 10^{-4}$ |
| ME04772 | ME04772-04 ($T_3$) | 0.50272 | 36 | 0.46204 | 53 | $2.73 \times 10^{-2}$ |

Events -02 and -04 of ME04772 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 21—Analysis of ME04772 Events

ME04909 contains Ceres Clone: 29302 (At1g49010, SEQ ID NO:532) from *Arabidopsis thaliana*, which encodes a 314 amino acid Myb-like DNA-binding domain protein. Evaluation of low-nitrogen tolerance for ME04909 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -03, showed significantly increased photosynthetic efficiency on low nitrate-containing media relative to the internal controls in both generations at $p \leq 0.05$ using a one-tailed t-test assuming unequal variance. A summary of photosynthetic efficiency of ME04909 seedlings is shown in Table 21. Events -01 and -03 segregated 15:1 (R:S) for FINALE™ resistance in the $T_2$ generation. ME04909 events were also tested for enhanced growth on the low nitrate media. No significant differences between the transgenics and the controls were observed.

TABLE 21 t-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME04909 | ME04909-01 ($T_2$) | 0.587774 | 31 | 0.550342 | 111 | $1.36 \times 10^{-2}$ |
| ME04909 | ME04909-01 ($T_3$) | 0.607452 | 31 | 0.550342 | 111 | $1.28 \times 10^{-3}$ |
| ME04909 | ME04909-03 ($T_2$) | 0.581537 | 41 | 0.550342 | 111 | $1.8 \times 10^{-2}$ |
| ME04909 | ME04909-03 ($T_3$) | 0.609806 | 31 | 0.550342 | 111 | $4.3 \times 10^{-5}$ |

Events -01 and -03 of ME04909 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 22—Analysis of ME05033 Events

ME05033 contains Ceres Clone: 93971 (At4g19095, SEQ ID NO:555) from *Arabidopsis thaliana*, which encodes a 188 amino acid protein of unknown function. Evaluation of low-nitrogen tolerance for ME05033 in $T_2$ and $T_3$ was conducted under the same conditions as described in Example 2. In this study, the seedling photosynthetic efficiency was measured as Fv/Fm comparing transgenic plants within an event to non-transgenic segregants pooled across the same plate. Two events, -03 and -05, showed significantly increased photosynthetic efficiency on low nitrate-containing media relative to the internal controls in both generations at $p \leq 0.05$ using a one-tailed t-test assuming unequal variance. A summary of photosynthetic efficiency of ME05033 seedlings is shown in Table 22. Events -03 and -05 segregated 15:1 and 2:1 respectively (R:S) for FINALE™ resistance in the $T_2$ generation. ME05033 events were also tested for enhanced growth on the low nitrate media. No significant differences between the transgenics and the controls were observed.

TABLE 22

T-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME05033 | ME05033-03 ($T_2$) | 0.65717 | 46 | 0.62621 | 132 | $9.20 \times 10^{-5}$ |
| ME05033 | ME05033-03 ($T_3$) | 0.64956 | 39 | 0.62621 | 132 | $4.52 \times 10^{-3}$ |
| ME05033 | ME05033-05 ($T_2$) | 0.64448 | 29 | 0.62621 | 132 | $3.46 \times 10^{-2}$ |
| ME05033 | ME05033-05 ($T_3$) | 0.65537 | 30 | 0.62621 | 132 | $2.38 \times 10^{-4}$ |

Events -03 and -05 of ME05033 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 23—Analysis of ME05194 Events

ME05194 contains Ceres cDNA: 12669619 (At1g30710, SEQ ID NO:557) from *Arabidopsis thaliana*, which encodes a 531 amino acid electron carrier protein. Evaluation of low-nitrogen tolerance for ME05194 in $T_2$ and $T_3$ was conducted under the same conditions as described in Examples 2 and 3. Two events, -03 and -05, showed significantly enhanced growth on low nitrate-containing media relative to the internal controls in both generations at $p \leq 0.05$ using a one-tailed t-test assuming unequal variance. In this study, the seedling area at 14 days for transgenic plants within an event was compared to the seedling area for non-transgenic segregants pooled across the same line. A summary of enhanced growth under low nitrate growth conditions of ME05194 seedlings is shown in Table 23. Events -03 and -05 segregated 1:1 (R:S) for FINALE™ resistance in the $T_2$ generation. ME05194 events were also tested for increased photosynthetic efficiency on the low nitrate media. No significant differences between the transgenics and the controls were observed.

TABLE 23 t-test comparison of seedline area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME05194 | ME05194-03 ($T_2$) | 0.051216 | 38 | 0.040874 | 82 | $2.54 \times 10^{-5}$ |
| ME05194 | ME05194-03 ($T_3$) | 0.047042 | 45 | 0.040874 | 82 | $2.61 \times 10^{-2}$ |
| ME05194 | ME05194-05 ($T_2$) | 0.048746 | 26 | 0.040874 | 82 | $6.15 \times 10^{-3}$ |
| ME05194 | ME05194-05 ($T_3$) | 0.048457 | 14 | 0.040874 | 82 | $3.03 \times 10^{-2}$ |

Events -03 and -05 of ME05194 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 24—Analysis of ME05267 Events

ME05267 contains Ceres Clone: 21608 (At5g49510, SEQ ID NO:592) from *Arabidopsis thaliana*, which encodes a 195 amino acid von Hippel-Lindau binding protein. Evaluation of low-nitrogen tolerance for ME05267 in $T_2$ and $T_3$ was conducted under the same conditions as described in Examples 2 and 3. Two events, -01 and -04, showed significantly enhanced growth on low nitrate-containing media relative to the internal controls in both generations at p≤0.05 using a one-tailed t-test assuming unequal variance. In this study, the seedling area at 14 days for transgenic plants within an event was compared to the seedling area for non-transgenic segregants pooled across the same line. A summary of enhanced growth under low nitrate growth conditions of ME05194 seedlings is shown in Table 24. Events -01 and -04 segregated 15:1 (R:S) for FINALE™ resistance in the $T_2$ generation. ME05267 events were also tested for increased photosynthetic efficiency on the low nitrate media. No significant differences between the transgenics and the controls were observed.

TABLE 24 t-test comparison of seedling area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME05267 | ME05267-01 ($T_2$) | 0.053263 | 46 | 0.0450197 | 122 | $4.4 \times 10^{-5}$ |
| ME05267 | ME05267-01 ($T_3$) | 0.051135 | 26 | 0.0450197 | 122 | $5.0 \times 10^{-2}$ |
| ME05267 | ME05267-04 ($T_2$) | 0.049977 | 44 | 0.0450197 | 122 | $6.4 \times 10^{-3}$ |
| ME05267 | ME05267-04 ($T_3$) | 0.053084 | 38 | 0.0450197 | 122 | $8.4 \times 10^{-4}$ |

Events -01 and -04 of ME05267 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 25—Analysis of ME05300 Events

ME05300 contains Ceres Clone: 2031 (At1g72020, SEQ ID NO:612) from *Arabidopsis thaliana*, which encodes a 97 amino acid protein of unknown function. Evaluation of low-nitrogen tolerance for ME05300 in $T_2$ generation was conducted under the same conditions as described in Examples 2 and 3. A summary of photosynthetic efficiency of ME05300 seedlings is shown in Table 25. Two events, -04 and -05, showed significantly increased photosynthetic efficiency on low nitrate- and low ammonium nitrate-containing media relative to the internal controls in $T_2$ generation at p≤0.05 using a one-tailed t-test assuming unequal variance. In this study, the seedling photosynthetic efficiency was measured as Fv/Fm comparing transgenic plants within an event to non-transgenic segregants pooled across the same plate. In addition, two events, -01 and -05, showed significantly enhanced growth on low nitrate- and low ammonium nitrate-containing media relative to the internal controls in $T_2$ generation at p≤0.05 using a one-tailed t-test assuming unequal variance. In this study, the seedling area for transgenic plants within an event was compared to the seedling area for non-transgenic segregants pooled across the same line. A summary of enhanced growth under low nitrate and low ammonium nitrate growth conditions of ME05300 seedlings is shown in Table 26.

TABLE 25

A. T-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME05300 | ME05300-04 ($T_2$) | 0.6867 | 7 | 0.6488 | 27 | $1.65 \times 10^{-2}$ |

TABLE 25-continued

A. T-test comparison of seedling photosynthetic efficiency between transgenic seedlings and pooled non-transgenic segregants after 14 days of growth on low nitrate.

| | | | | | | |
|---|---|---|---|---|---|---|
| ME05300 | ME05300-05 ($T_2$) | 0.6839 | 16 | 0.6488 | 27 | $2.50 \times 10^{-3}$ |

B. T-test comparison of seedling photosynthetic efficiency between transgenic seedlings and pooled non-transgenic segregants after 18 days of growth on low ammonium nitrate.

| | | | | | | |
|---|---|---|---|---|---|---|
| ME05300 | ME05300-04 ($T_2$) | 0.6767 | 6 | 0.6323 | 32 | $1.68 \times 10^{-2}$ |
| ME05300 | ME05300-05 ($T_2$) | 0.6934 | 11 | 0.6323 | 32 | $7.04 \times 10^{-4}$ |

TABLE 26

A. T-test comparison of seedling area between transgenic seedlings and pooled non-transgenic segregants after 14 days of growth on low nitrate.

| | | Transgenic | | Pooled Non-Transgenics | | t-test |
|---|---|---|---|---|---|---|
| Line | Events | Area | n | Area | n | p-value |
| ME05300 | ME05300-01 ($T_2$) | 0.0737 | 18 | 0.0588 | 21 | $3.80 \times 10^{-3}$ |
| ME05300 | ME05300-05 ($T_2$) | 0.0655 | 16 | 0.0570 | 27 | $1.59 \times 10^{-2}$ |

B. T-test comparison of seedling area between transgenic seedlings and pooled non-transgenic segregants after 18 days of growth on low ammonium nitrate.

| | | | | | | |
|---|---|---|---|---|---|---|
| ME05300 | ME05300-01 ($T_2$) | 0.0987 | 17 | 0.0776 | 29 | $3.89 \times 10^{-3}$ |
| ME05300 | ME05300-05 ($T_2$) | 0.1082 | 11 | 0.0776 | 29 | $1.57 \times 10^{-3}$ |

Example 26—Analysis of ME05341 Events

ME05341 contains Ceres Clone: 94503 (At4g14420, SEQ ID NO:645) from *Arabidopsis thaliana*, which encodes a 158 amino acid elicitor-like protein. Evaluation of low-nitrogen tolerance for ME05341 in $T_2$ and $T_3$ was conducted under the same conditions as described in Examples 2 and 3. Two events, -01 and -02, showed significantly enhanced growth on low nitrate-containing media relative to the internal controls in both generations at $p \leq 0.05$ using a one-tailed t-test assuming unequal variance. In this study, the seedling area at 14 days for transgenic plants within an event was compared to the seedling area for non-transgenic segregants pooled across the same line. A summary of photosynthetic efficiency of ME05341 seedlings is shown in Table 27. Events -01 and -02 segregated 15:1 (R:S) for FINALE™ resistance in the $T_2$ generation. ME05341 events were also tested for increased photosynthetic efficiency on the low nitrate media. No significant differences between the transgenics and the controls were observed.

TABLE 27 t-test comparison of seedling area between transgenic seedlings and pooled non-transgenic segregants after 14 days of growth on low nitrate.

| | | Transgenic | | Pooled Non-Transgenics | | t-test |
|---|---|---|---|---|---|---|
| Line | Events | Area | n | Area | n | p-value |
| ME05341 | ME05341-01 ($T_2$) | 0.06253 | 46 | 0.04988 | 143 | $4.17 \times 10^{-10}$ |
| ME05341 | ME05341-01 ($T_3$) | 0.05876 | 38 | 0.04988 | 143 | $4.13 \times 10^{-4}$ |
| ME05341 | ME05341-02 ($T_2$) | 0.06152 | 46 | 0.04988 | 143 | $2.91 \times 10^{-7}$ |
| ME05341 | ME05341-02 ($T_3$) | 0.05572 | 48 | 0.04988 | 143 | $2.90 \times 10^{-3}$ |

Events -01 and -02 of ME05341 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 27—Analysis of ME05392 Events

ME05392 contains Ceres Clone: 21740 (At5g01610, SEQ ID NO:686) from *Arabidopsis thaliana*, which encodes a 170 amino acid protein of unknown function. Evaluation of low-nitrogen tolerance for ME05392 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -03, showed significantly increased photosynthetic efficiency on low nitrate-containing media relative to the internal controls in both generations at $p \leq 0.05$ using a one-tailed t-test assuming unequal variance. A summary of photosynthetic efficiency of ME05392 seedlings is shown in Table 20. Events -01 and -03 segregated 2:1 (R:S) for FINALE™ resistance in the $T_2$ generation. ME05392 events were also tested for enhanced growth on the low nitrate media. No significant differences between the transgenics and the controls were observed.

TABLE 28

T-test comparison of seedling photosynthetic efficiency between transgenic seedlings and pooled non-transgenic segregants after 14 days of growth on low nitrate media.

| | | Transgenic | | Pooled Non-Transgenics | | t-test |
|---|---|---|---|---|---|---|
| Line | Events | Fv/Fm | n | Fv/Fm | n | p-value |
| ME05392 | ME05392-01 ($T_2$) | 0.61759 | 32 | 0.60093 | 107 | $3.70 \times 10^{-2}$ |
| ME05392 | ME05392-01 ($T_3$) | 0.63388 | 40 | 0.60093 | 107 | $5.05 \times 10^{-5}$ |
| ME05392 | ME05392-03 ($T_2$) | 0.64335 | 23 | 0.60093 | 107 | $5.81 \times 10^{-5}$ |
| ME05392 | ME05392-03 ($T_3$) | 0.63397 | 36 | 0.60093 | 107 | $4.30 \times 10^{-5}$ |

Events -01 and -03 of ME05392 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 28—Analysis of ME05429 Events

ME05429 contains Ceres Clone: 5609 (At3g60480, SEQ ID NO:729) from *Arabidopsis thaliana*, which encodes a 188 amino acid protein of unknown function. Evaluation of low-nitrogen tolerance for ME05429 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -06 and -08, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME05429 seedlings is shown in Table 29. Events -06 and -08 segregated 3:1 and 2:1 respectively (R:S) for FINALE™ resistance in the $T_2$ generation. ME05429 events were tested for enhanced growth on the low ammonium nitrate media. In addition, these events were also tested for enhanced growth and photosynthetic efficiency on low nitrate media. No significant differences between the transgenics and the controls were observed.

TABLE 29 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME05429 | ME05429-06 ($T_2$) | 0.62521 | 28 | 0.59991 | 78 | $2.85 \times 10^{-2}$ |
| ME05429 | ME05429-06 ($T_3$) | 0.63031 | 39 | 0.59991 | 78 | $8.49 \times 10^{-3}$ |
| ME05429 | ME05429-08 ($T_2$) | 0.64526 | 23 | 0.59991 | 78 | $1.67 \times 10^{-3}$ |
| ME05429 | ME05429-08 ($T_3$) | 0.65076 | 17 | 0.59991 | 78 | $2.76 \times 10^{-4}$ |

Events -06 and -08 of ME05429 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 29—Analysis of ME05493 Events

ME05493 contains Ceres Clone: 3137 (At3g43430, SEQ ID NO:745) from *Arabidopsis thaliana*, which encodes a 169 amino acid zinc finger family protein. Evaluation of low-nitrogen tolerance for ME05493 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -05, showed significantly increased photosynthetic efficiency on low nitrate-containing media relative to the internal controls in both generations at $p \leq 0.05$ using a one-tailed t-test assuming unequal variance. A summary of photosynthetic efficiency of ME05493 seedlings is shown in Table 30. Events -01 and -05 segregated 15:1 (R:S) for FINALE™ resistance in the $T_2$ generation. ME05493 events were also tested for enhanced growth on the low nitrate media. No significant differences between the transgenics and the controls were observed.

TABLE 30 t-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME05493 | ME05493-01 ($T_2$) | 0.64121 | 32 | 0.61097 | 92 | $1.13 \times 10^{-3}$ |
| ME05493 | ME05493-01 ($T_3$) | 0.64250 | 46 | 0.61097 | 92 | $3.03 \times 10^{-4}$ |
| ME05493 | ME05493-05 ($T_2$) | 0.62865 | 43 | 0.61097 | 92 | $1.75 \times 10^{-2}$ |
| ME05493 | ME05493-05 ($T_3$) | 0.63936 | 42 | 0.61097 | 92 | $1.21 \times 10^{-4}$ |

Events -01 and -05 of ME05493 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 30—Analysis of ME05885 Events

ME05885 contains Ceres Clone: 32430 (At1g16170, SEQ ID NO:768) from *Arabidopsis thaliana*, which encodes a 92 amino acid protein of unknown function. Evaluation of low-nitrogen tolerance for ME05885 in $T_3$ generation was conducted under the same conditions as described in Examples 2 and 3. A summary of photosynthetic efficiency of ME05885 seedlings is shown in Table 31. In this study, the seedling photosynthetic efficiency was measured as Fv/Fm comparing transgenic plants within an event to non-transgenic segregants pooled across the same plate. Two events, -01 and -05, showed significantly increased photosynthetic efficiency on low nitrate-containing media and low ammonium nitrate-containing media relative to the internal controls in $T_3$ generation at $p \leq 0.05$ using a one-tailed t-test assuming unequal variance.

TABLE 31

| Line | Events | Transgenic Fv/Fm | n | Pooled Non-Transgenics Fv/Fm | n | t-test p-value |
|---|---|---|---|---|---|---|
| A. T-test comparison of seedling photosynthetic efficiency between transgenic seedlings and pooled non-transgenic segregants after 14 days of growth on low nitrate. | | | | | | |
| ME05885 | ME05885-01 ($T_3$) | 0.6759 | 12 | 0.6533 | 28 | $4.32 \times 10^{-2}$ |
| ME05885 | ME05885-05 ($T_3$) | 0.6831 | 7 | 0.6530 | 52 | $3.68 \times 10^{-6}$ |
| B. T-test comparison of seedling photosynthetic efficiency between transgenic seedlings and pooled non-transgenic segregants after 18 days of growth on low ammonium nitrate. | | | | | | |
| ME05885 | ME05885-01 ($T_3$) | 0.6490 | 13 | 0.6135 | 30 | $3.06 \times 10^{-2}$ |
| ME05885 | ME05885-05 ($T_3$) | 0.6810 | 9 | 0.6133 | 43 | $6.77 \times 10^{-5}$ |

ME05885 events were also tested for enhanced growth on the low nitrate and low ammonium nitrate media. A summary of enhanced growth under low nitrate and low ammonium nitrate growth conditions of ME05885 seedlings in $T_3$ generation is shown in Table 32. Two events, -03 and -05, showed significantly enhanced growth on low nitrate-containing media. Two events, -02 and -05, showed significantly enhanced growth on low ammonium nitrate-containing media relative to the internal controls at $p \leq 0.05$ using a one-tailed t-test assuming unequal variance. In this study, the seedling area for transgenic plants within an event was compared to the seedling area for non-transgenic segregants pooled across the same line.

TABLE 32

| Line | Events | Transgenic Area | n | Pooled Non-Transgenics Area | n | t-test p-value |
|---|---|---|---|---|---|---|
| A. T-test comparison of seedling area between transgenic seedlings and pooled non-transgenic segregants after 14 days of growth on low nitrate. | | | | | | |
| ME05885 | ME05885-03 ($T_3$) | 0.06245 | 6 | 0.05286 | 14 | $1.42 \times 10^{-2}$ |
| ME05885 | ME05885-05 ($T_3$) | 0.05893 | 7 | 0.04725 | 12 | $5.61 \times 10^{-3}$ |
| B. T-test comparison of seedling area between transgenic seedlings and pooled non-transgenic segregants after 18 days of growth on low ammonium nitrate. | | | | | | |
| ME05885 | ME05885-02 ($T_3$) | 0.0744 | 14 | 0.05595 | 6 | $3.28 \times 10^{-5}$ |
| ME05885 | ME05885-05 ($T_3$) | 0.0753 | 9 | 0.06179 | 11 | $5.08 \times 10^{-3}$ |

Example 31—Analysis of ME07344 Events

ME07344 contains Ceres Clone: 101255 (At2g19810, SEQ ID NO:791) from *Arabidopsis thaliana*, which encodes a 359 amino acid CCCH-type zinc finger protein. Evaluation of low-nitrogen tolerance for ME07344 in $T_2$ and $T_3$ was conducted under the same conditions as described in Example 4. In this study, the 4$^{th}$ true leaf from each plant was collected on day 38 and analyzed on the CF imager for its Fv/Fm value. Transgenic plants within an event were compared to all non-transgenic plants, including the non-transgenic segregants and external controls. Two events, -02 and -03, showed significantly increased photosynthetic efficiency relative to the internal controls in both generations at $p \leq 0.05$ using a one-tailed t-test assuming unequal variance. A summary of photosynthetic efficiency of ME07344 seedlings is shown in Table 33. Events -02 and -03 segregated 3:1 (R:S) for FINALE™ resistance in the $T_2$ generation. ME07344 events were also tested for enhanced growth on the low nitrate media. No significant differences between the transgenics and the controls were observed.

TABLE 33

T-test comparison of photosynthetic efficiency between transgenic plants and non-transgenic controls after 38 days of growth on nitrogen-depleted soil.

| Line | Events | Transgenic Fv/Fm | n | Non-Transgenic Controls Fv/Fm | n | t-test p-value |
|---|---|---|---|---|---|---|
| ME07344 | ME07344-02 ($T_2$) | 0.752 | 17 | 0.729 | 50 | $2.86 \times 10^{-4}$ |
| ME07344 | ME07344-02 ($T_3$) | 0.750 | 16 | 0.729 | 50 | $1.11 \times 10^{-4}$ |
| ME07344 | ME07344-03 ($T_2$) | 0.741 | 13 | 0.729 | 50 | 0.018 |
| ME07344 | ME07344-03 ($T_3$) | 0.754 | 17 | 0.729 | 50 | $4.62 \times 10^{-6}$ |

Events -02 and -03 of ME07344 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 32—Analysis of ME07859 Events

ME07859 contains Ceres Clone: 276809 (SEQ ID NO:823) from *Zea mays*, which encodes a 135 amino acid sterol desaturase protein. Evaluation of low-nitrogen tolerance for ME07859 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -02 and -04, showed significantly increased photosynthetic efficiency on low nitrate-containing media relative to the internal controls in both generations at $p \leq 0.05$ using a one-tailed t-test assuming unequal variance. A summary of photosynthetic efficiency of ME07859 seedlings is shown in Table 34. Events -02 and -04 segregated 1:1 and 2:1 respectively (R:S) for FINALE™ resistance in the $T_2$ generation. ME07859 events were also tested for enhanced growth on the low nitrate media as well as for enhanced growth and photosynthetic efficiency on low ammonium nitrate media. No significant differences between the transgenics and the controls were observed.

TABLE 34 t-test comparison of seedling photosynthetic efficiency between transgenic seedlings and pooled non-transgenic segregants after 14 days of growth on low nitrate media.

| | | Transgenic | | Pooled Non-Transgenics | | t-test |
|---|---|---|---|---|---|---|
| Line | Events | Fv/Fm | n | Fv/Fm | n | p-value |
| ME07859 | ME07859-02 ($T_2$) | 0.6598 | 24 | 0.6378 | 127 | 0.03 |
| ME07859 | ME07859-02 ($T_3$) | 0.6825 | 14 | 0.6378 | 127 | $1.3 \times 10^{-3}$ |
| ME07859 | ME07859-04 ($T_2$) | 0.6539 | 33 | 0.6378 | 127 | 0.05 |
| ME07859 | ME07859-04 ($T_3$) | 0.6601 | 17 | 0.6378 | 127 | 0.05 |

Events -02 and -04 of ME07859 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 33—Analysis of ME08464 Events

ME08464 contains Ceres Clone: 424522 (SEQ ID NO:827) from *Zea mays*, which encodes a 500 amino acid unknown protein. Evaluation of low-nitrogen tolerance for ME08464 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -02 and -03, showed significantly increased photosynthetic efficiency on low ammonium nitrate-containing media relative to the internal controls in both generations at p≤0.05 using a one-tailed t-test assuming unequal variance. A summary of photosynthetic efficiency of ME07859 seedlings is shown in Table 35. Events -02 and -03 segregated 3:1 (R:S) for FINALE™ resistance in the $T_2$ generation. ME08464 events were also tested for increased photosynthetic efficiency on the low nitrate media. No significant differences between the transgenics and the controls were observed.

TABLE 35

T-test comparison of photosynthetic efficiency between transgenic seedlings and pooled non-transgenic segregants after 15 days of growth on low ammonium nitrate.

| | | Transgenic | | Pooled Non-Transgenics | | t-test |
|---|---|---|---|---|---|---|
| Line | Events | Fv/Fm | n | Fv/Fm | n | p-value |
| ME08464 | ME08464-02 ($T_2$) | 0.65 | 41 | 0.62 | 40 | 0.015 |
| ME08464 | ME08464-02 ($T_3$) | 0.67 | 32 | 0.62 | 40 | $2.32 \times 10^{-4}$ |
| ME08464 | ME08464-03 ($T_2$) | 0.65 | 43 | 0.62 | 40 | 0.013 |
| ME08464 | ME08464-03 ($T_3$) | 0.65 | 42 | 0.62 | 40 | $6.85 \times 10^{-3}$ |

Events -02 and -03 of ME08464 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 34—Analysis of ME09939 Events

ME09939 contains Ceres Clone: 324216 (SEQ ID NO:852) from *Zea mays*, which encodes a 38 amino acid protein of unknown function. Evaluation of low-nitrogen tolerance for ME09939 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -04 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME09939 seedlings is shown in Table 36. Events -04 and -05 segregated 15:1 and 3:1 respectively (R:S) for FINALE™ resistance in the $T_2$ generation. ME09939 events were also tested for enhanced growth on the low ammonium nitrate media. No significant differences between the transgenics and the controls were observed.

TABLE 36

T-test comparison of seedling photosynthetic efficiency between transgenic seedlings and pooled non-transgenic segregants after 18 days of growth on low ammonium nitrate.

| | | Transgenic | | Pooled Non-Transgenics | | t-test |
|---|---|---|---|---|---|---|
| Line | Events | Fv/Fm | n | Fv/Fm | n | p-value |
| ME09939 | ME09939-04 ($T_2$) | 0.49285 | 40 | 0.38571 | 7 | 0.05 |
| ME09939 | ME09939-04 ($T_3$) | 0.50697 | 34 | 0.38571 | 7 | $3.50 \times 10^{-2}$ |
| ME09939 | ME09939-05 ($T_2$) | 0.53487 | 39 | 0.47492 | 24 | $1.19 \times 10^{-2}$ |
| ME09939 | ME09939-05 ($T_3$) | 0.55341 | 32 | 0.47492 | 24 | $1.82 \times 10^{-3}$ |

Events -04 and -05 of ME09939 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 35—Analysis of ME11735 Events

ME11735 contains Ceres Annot: 573161 (At5g43260, SEQ ID NO:854) from *Arabidopsis thaliana*, which encodes a 97 amino acid DnaJ-related chaperone protein. Evaluation of low-nitrogen tolerance for ME11735 in $T_2$ and $T_3$ was conducted under the same conditions as described in Example 2 and 3. A summary of the enhanced growth of ME11735 events on low nitrate-containing media is shown in Table 37. In this study, the seedling area for transgenic plants within an event was compared to the seedling area for non-transgenic segregants pooled across the same line. Two events, -04 and -05, were found significantly larger than the pooled non-transgenic segregants after 14 days of growth on low nitrate-containing media relative to the internal controls in both generations at p≤0.05 using a one-tailed t-test assuming unequal variance. ME11735 events were also tested for increased photosynthetic efficiency on the low nitrate media. No significant differences between the transgenics and the controls were observed. Events -04 and -05 segregated 40:1 and 4:1 respectively (R:S) for FINALE™ resistance in the $T_2$ generation.

TABLE 37 t-test comparison of seedling area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME11735 | ME11735-04 ($T_2$) | 0.05820 | 41 | 0.04994 | 127 | $5.91 \times 10^{-5}$ |
| ME11735 | ME11735-04 ($T_3$) | 0.05553 | 42 | 0.04994 | 127 | $1.26 \times 10^{-2}$ |
| ME11735 | ME11735-05 ($T_2$) | 0.05788 | 37 | 0.04994 | 127 | $1.59 \times 10^{-3}$ |
| ME11735 | ME11735-05 ($T_3$) | 0.06011 | 13 | 0.04994 | 127 | $1.64 \times 10^{-2}$ |

Events -04 and -05 of ME11735 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 36—Analysis of ME12910 Events

ME12910 contains Ceres Annot: 552727 (At2g22930, SEQ ID NO:890) from *Arabidopsis thaliana*, which encodes a 442 amino acid UDP-glucoronosyl and UDP-glucosyl transferase family protein. Evaluation of low-nitrogen tolerance for ME12910 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME12910 seedlings is shown in Table 38. ME12910 events were also tested for enhanced growth on the low ammonium nitrate media. No significant differences between the transgenics and the controls were observed.

TABLE 38 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME12910 | ME12910-03 ($T_2$) | 0.5851 | 39 | 0.5191 | 29 | $1.54 \times 10^{-3}$ |
| ME12910 | ME12910-03 ($T_3$) | 0.5861 | 22 | 0.5191 | 29 | $2.17 \times 10^{-3}$ |
| ME12910 | ME12910-05 ($T_2$) | 0.5523 | 44 | 0.4251 | 7 | $1.23 \times 10^{-2}$ |
| ME12910 | ME12910-05 ($T_3$) | 0.5600 | 42 | 0.4251 | 7 | $9.62 \times 10^{-3}$ |

Events -03 and -05 segregated 3:1 and 15:1 respectively (R:S) for FINALE™ resistance in the $T_2$ generation.

Events -03 and -05 of ME12910 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 37—Analysis of ME12927 Events

ME12927 contains Ceres Clone: 239806 (SEQ ID NO:916) from *Zea mays*, which encodes a 201 amino acid lipoprotein amino terminal region. Evaluation of low-nitrogen tolerance for ME12927 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Three events, -02, -03 and -05, showed significantly increased photosynthetic efficiency on low ammonium nitrate-containing media relative to the internal controls in both generations at p≤0.05, using a one-tailed t-test assuming unequal variance. A summary of photosynthetic efficiency of ME12927 seedlings is shown in Table 39.

TABLE 39 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME12927 | ME12927-02 ($T_2$) | 0.60843 | 44 | 0.47813 | 8 | $4.88 \times 10^{-3}$ |
| ME12927 | ME12927-02 ($T_3$) | 0.60867 | 36 | 0.47813 | 8 | $5.23 \times 10^{-3}$ |
| ME12927 | ME12927-03 ($T_2$) | 0.61906 | 32 | 0.57929 | 38 | $8.96 \times 10^{-3}$ |
| ME12927 | ME12927-03 ($T_3$) | 0.63437 | 19 | 0.57929 | 38 | $5.35 \times 10^{-4}$ |
| ME12927 | ME12927-05 ($T_2$) | 0.60581 | 43 | 0.53982 | 22 | $7.26 \times 10^{-3}$ |
| ME12927 | ME12927-05 ($T_3$) | 0.63145 | 29 | 0.53982 | 22 | $5.83 \times 10^{-4}$ |

ME12927 events were also tested for enhanced growth on the low ammonium nitrate media. A summary of the enhanced growth of ME11735 events on low ammonium nitrate-containing media is shown in Table 40. In this study, the seedling area for transgenic plants within an event was compared to the seedling area for non-transgenic segregants pooled across the same line. Three events, -02, -03 and -05, were found significantly larger than the pooled non-transgenic segregants after 18 days of growth on low ammonium nitrate-containing media relative to the internal controls in both generations at $p \leq 0.05$, using a one-tailed t-test assuming unequal variance.

TABLE 40 t-test comparison of seedling area between transgenic seedlings and pooled non-transgenic segregants after 18 days of growth on low ammonium nitrate.

| Line | Events | Transgenic Area | n | Pooled Non-Transgenics Area | n | t-test p-value |
|---|---|---|---|---|---|---|
| ME12927 | ME12927-02 ($T_2$) | 0.066920 | 44 | 0.056585 | 117 | $1.65 \times 10^{-4}$ |
| ME12927 | ME12927-02 ($T_3$) | 0.062119 | 36 | 0.056585 | 117 | $3.51 \times 10^{-2}$ |
| ME12927 | ME12927-03 ($T_2$) | 0.068972 | 32 | 0.056585 | 117 | $1.18 \times 10^{-5}$ |
| ME12927 | ME12927-03 ($T_3$) | 0.063716 | 19 | 0.056585 | 117 | $1.98 \times 10^{-2}$ |
| ME12927 | ME12927-05 ($T_2$) | 0.069972 | 43 | 0.056585 | 117 | $4.25 \times 10^{-6}$ |
| ME12927 | ME12927-05 ($T_3$) | 0.064014 | 29 | 0.056585 | 117 | $8.49 \times 10^{-3}$ |

Events 02, -03 and -05 segregated 15:1, 2:1 and 15:1 respectively (R:S) for FINALE™ resistance in the $T_2$ generation.

Events 02, -03 and -05 of ME12927 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill) in $T_1$ generation.

Example 38—Analysis of ME12929 Events

ME12929 contains Ceres Clone: 208995 (SEQ ID NO:943) from *Zea mays*, which encodes a 94 amino acid protein of unknown function. Evaluation of low-nitrogen tolerance for ME12929 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME12929 seedlings is shown in Table 41. ME12929 events were also tested for enhanced growth on the low ammonium nitrate media. No significant differences between the transgenics and the controls were observed. Events -03 and -04 segregated 1:1 and 3:1 respectively (R:S) for FINALE™ resistance in the $T_2$ generation.

Events -03 and -04 of ME12929 exhibited no statistically relevant negative phenotypes. That is, there was no detectable reduction in germination rate, the transgenic

TABLE 41 t-test comparison of seedling photosynthetic efficiency between transgenic seedlings and pooled non-transgenic segregants after 14 days of growth on low ammonium nitrate.

| Line | Events | Transgenic Fv/Fm | n | Pooled Non-Transgenics Fv/Fm | n | t-test p-value |
|---|---|---|---|---|---|---|
| ME12929 | ME12929-03 ($T_2$) | 0.6410 | 33 | 0.5736 | 24 | $9.44 \times 10^{-4}$ |
| ME12929 | ME12929-03 ($T_3$) | 0.6610 | 41 | 0.5736 | 24 | $4.38 \times 10^{-5}$ |
| ME12929 | ME12929-04 ($T_2$) | 0.6544 | 47 | 0.5790 | 9 | $3.68 \times 10^{-2}$ |
| ME12929 | ME12929-04 ($T_3$) | 0.6663 | 43 | 0.5790 | 9 | $2.15 \times 10^{-2}$ | plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 39—Analysis of ME12954 Events

ME12954 contains Ceres Clone: 225681 (SEQ ID NO:975) from *Zea mays*, which encodes a 286 amino acid protein of unknown function. Evaluation of low-nitrogen tolerance for ME12954 in $T_2$ and $T_3$ was conducted under the same conditions as described in Examples 2 and 3. Two events, -04 and -05, showed significantly increased photosynthetic efficiency on low ammonium nitrate-containing media relative to the internal controls in both generations at $p \leq 0.05$ using a one-tailed t-test assuming unequal variance. In this study, the seedling photosynthetic efficiency was measured as Fv/Fm comparing transgenic plants within an event to non-transgenic segregants pooled across the same plate. A summary of photosynthetic efficiency of ME12954 seedlings is shown in Table 42.

TABLE 42 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME12954 | ME12954-04 ($T_2$) | 0.6236 | 40 | 0.5973 | 152 | $6.61 \times 10^{-3}$ |
| ME12954 | ME12954-04 ($T_3$) | 0.6200 | 39 | 0.5973 | 152 | $1.97 \times 10^{-2}$ |
| ME12954 | ME12954-05 ($T_2$) | 0.6280 | 45 | 0.5973 | 152 | $1.79 \times 10^{-2}$ |
| ME12954 | ME12954-05 ($T_3$) | 0.6315 | 35 | 0.5973 | 152 | $2.85 \times 10^{-2}$ |

ME12954 events were also tested for enhanced growth on the low ammonium nitrate media. A summary of the enhanced growth of ME12954 events on low ammonium nitrate-containing media is shown in Table 43. In this study, the seedling area for transgenic plants within an event was compared to the seedling area for non-transgenic segregants pooled across the same line. Two events, -02 and -04, were found significantly larger than the pooled non-transgenic segregants after 18 days of growth on low ammonium nitrate-containing media relative to the internal controls in both generations at $p \leq 0.05$, using a one-tailed t-test assuming unequal variance.

TABLE 43 t-test comparison of seedling area between transgenic seedlings and pooled non-transgenic segregants after 18 days of growth on low ammonium nitrate.

| Line | Events | Transgenic Area | n | Pooled Non-Transgenics Area | n | t-test p-value |
|---|---|---|---|---|---|---|
| ME12954 | ME12954-02 ($T_2$) | 0.06883 | 31 | 0.05579 | 152 | $1.86 \times 10^{-5}$ |
| ME12954 | ME12954-02 ($T_3$) | 0.06604 | 26 | 0.05579 | 152 | $1.48 \times 10^{-3}$ |
| ME12954 | ME12954-04 ($T_2$) | 0.06469 | 40 | 0.05579 | 152 | $1.95 \times 10^{-4}$ |
| ME12954 | ME12954-04 ($T_3$) | 0.06301 | 39 | 0.05579 | 152 | $3.32 \times 10^{-3}$ |

Events -02, -04 and -05 segregated 2:1, 3:1 and 15:1 respectively (R:S) for FINALE™ resistance in the T2 generation.

Events -02, -04 and -05 of ME12954 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 40—Analysis of ME12970 Events

ME12970 contains Ceres Clone: 1387146 (SEQ ID NO:981) from *Zea mays*, which encodes a 147 amino acid C2 domain-containing protein. Evaluation of low-nitrogen tolerance for ME12970 in $T_2$ and $T_3$ was conducted under the same conditions as described in Examples 2 and 3. Two events, -02 and -03, showed significantly increased photosynthetic efficiency on low ammonium nitrate-containing media relative to the internal controls in both generations at $p \leq 0.05$ using a one-tailed t-test assuming unequal variance. In this study, the seedling photosynthetic efficiency was measured as Fv/Fm comparing transgenic plants within an event to non-transgenic segregants pooled across the same plate. A summary of photosynthetic efficiency of ME12970 seedlings is shown in Table 44. ME12970 events were also tested for enhanced growth on the low ammonium nitrate media. No significant differences between the transgenics and the controls were observed.

TABLE 44 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME12970 | ME12970-02 ($T_2$) | 0.55136 | 44 | 0.52401 | 108 | $3.78 \times 10^{-2}$ |
| ME12970 | ME12970-02 ($T_3$) | 0.58305 | 43 | 0.52401 | 108 | $1.89 \times 10^{-5}$ |
| ME12970 | ME12970-03 ($T_2$) | 0.58759 | 37 | 0.52401 | 108 | $2.14 \times 10^{-6}$ |
| ME12970 | ME12970-03 ($T_3$) | 0.59131 | 29 | 0.52401 | 108 | $3.05 \times 10^{-6}$ |

Events -02 and -03 segregated 15:1 and 3:1 respectively (R:S) for FINALE™ resistance in the T2 generation.

Events -02 and -03 of ME12970 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 41—Analysis of ME13006 Events

ME13006 contains Ceres Clone: 1017441 (SEQ ID NO:224) from *Triticum aestivum*, which encodes a 143 amino acid polypeptide, predicted to be a homolog of Ceres Clone: 4898 (ME03123, SEQ ID NO:217). Evaluation of low-nitrogen tolerance for ME13006 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -03, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME13006 seedlings is shown in Table 45. ME13006 events were also tested for enhanced growth on the low nitrate media. No significant differences between the transgenics and the controls were observed.

TABLE 45 t-test comparison of seedling area between transgenic seedlings and pooled non-transgenic segregants after 14 days of growth on low ammonium nitrate.

| Line | Events | Transgenic Area | n | Pooled Non-Transgenics Area | n | t-test p-value |
|---|---|---|---|---|---|---|
| ME13006 | ME13006-01 ($T_2$) | 0.0777 | 42 | 0.0648 | 7 | $3.29 \times 10^{-2}$ |
| ME13006 | ME13006-01 ($T_3$) | 0.0660 | 28 | 0.0540 | 19 | $1.49 \times 10^{-3}$ |
| ME13006 | ME13006-03 ($T_2$) | 0.0706 | 21 | 0.0601 | 29 | $4.83 \times 10^{-3}$ |
| ME13006 | ME13006-03 ($T_3$) | 0.0758 | 14 | 0.0617 | 33 | $2.60 \times 10^{-3}$ |

Events -01 and -03 segregated 3:1 and 1:1 respectively (R:S) for FINALE™ resistance in the $T_2$ generation.

Events -01 and -03 of ME13006 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 42—Analysis of ME13021 Events

ME13021 contains Ceres Clone: 244306 (SEQ ID NO:1053) from *Zea mays*, which encodes a 572 amino acid TCP-1/cpn60 chaperonin family protein. Evaluation of low-nitrogen tolerance for ME13021 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -04 and -05, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME13021 seedlings is shown in Table 46. ME13021 events were also tested for enhanced growth on the low ammonium nitrate media. No significant differences between the transgenics and the controls were observed.

TABLE 46 t-test comparison of seedling photosynthetic efficiency between
transgenic seedlings and pooled non-transgenic segregants
after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME13021 | ME13021-04 ($T_2$) | 0.56697 | 39 | 0.49440 | 10 | $2.47 \times 10^{-2}$ |
| ME13021 | ME13021-04 ($T_3$) | 0.59916 | 37 | 0.48685 | 13 | $1.54 \times 10^{-3}$ |
| ME13021 | ME13021-05 ($T_2$) | 0.60575 | 32 | 0.50344 | 18 | $6.05 \times 10^{-4}$ |
| ME13021 | ME13021-05 ($T_3$) | 0.64400 | 23 | 0.55638 | 26 | $3.86 \times 10^{-6}$ |

Events -04 and -05 segregated 3:1 and 2:1 respectively (R:S) for FINALE™ resistance in the T2 generation.

Events -04 and -05 of ME13021 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill) in T1 generation.

Example 43—Analysis of ME13064 Events

ME13064 contains Ceres Clone: 1408950 (SEQ ID NO:1098) from Zea mays, which encodes a 152 amino acid protein of unknown function. Evaluation of low-nitrogen tolerance for ME13064 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low ammonium nitrate-containing media relative to the internal controls in both generations at p≤0.05 using a one-tailed t-test assuming unequal variance. A summary of photosynthetic efficiency of ME13064 seedlings is shown in Table 47. ME13064 events were also tested for enhanced growth on the low ammonium nitrate media. No significant differences between the transgenics and the controls were observed.

Events -03 and -04 segregated 2:1 (R:S) for FINALE™ resistance in the T2 generation.

Events -03 and -04 of ME13064 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill) in T1 generation.

Example 44—Analysis of ME13071 Events

ME13071 contains Ceres Clone: 208453 (SEQ ID NO:1111) from Zea mays, which encodes a 74 amino acid protein of unknown function. Evaluation of low-nitrogen tolerance for ME13071 in $T_2$ and $T_3$ was conducted under the same conditions as described in Examples 2 and 3. Two events, -03 and -05, showed significantly enhanced growth on low nitrate- and low ammonium nitrate-containing media relative to the internal controls in $T_2$ generation at p≤0.05 using a one-tailed t-test assuming unequal variance. In this study, the seedling area for transgenic plants within an event was compared to the seedling area for non-transgenic segregants pooled across the same line. A summary of enhanced growth under low ammonium nitrate growth conditions of ME13071 seedlings is shown in Table 48. ME13071 events were also tested for photosynthetic efficiency on the low ammonium nitrate media. No significant differences between the transgenics and the controls were observed.

TABLE 47 t-test comparison of seedling photosynthetic efficiency between
transgenic seedlings and pooled non-transgenic segregants
after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME13064 | ME13064-03 ($T_2$) | 0.59444 | 27 | 0.54793 | 28 | $5.84 \times 10^{-3}$ |
| ME13064 | ME13064-03 ($T_3$) | 0.59676 | 29 | 0.54793 | 28 | $1.25 \times 10^{-2}$ |
| ME13064 | ME13064-04 ($T_2$) | 0.58577 | 31 | 0.51053 | 40 | $2.05 \times 10^{-3}$ |
| ME13064 | ME13064-04 ($T_3$) | 0.59128 | 25 | 0.51053 | 40 | $8.93 \times 10^{-4}$ |

TABLE 48 t-test comparison of seedling area between transgenic seedlings and pooled
non-transgenic segregants after 18 days of growth on low ammonium nitrate.

| Line | Events | Transgenic | | Pooled Non-Transgenics | | t-test |
|---|---|---|---|---|---|---|
| | | Area | n | Area | n | p-value |
| ME13071 | ME13071-03 ($T_2$) | 0.06694 | 26 | 0.05915 | 19 | $3.55 \times 10^{-3}$ |
| ME13071 | ME13071-03 ($T_3$) | 0.07787 | 24 | 0.07040 | 22 | $3.65 \times 10^{-2}$ |
| ME13071 | ME13071-05 ($T_2$) | 0.06232 | 32 | 0.05491 | 16 | $2.07 \times 10^{-3}$ |
| ME13071 | ME13071-05 ($T_3$) | 0.06335 | 22 | 0.05626 | 28 | $1.09 \times 10^{-2}$ |

Events -03 and -05 segregated 1:1 and 2:1 respectively (R:S) for FINALE™ resistance in the T2 generation.

Events -03 and -05 of ME13071 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 45—Analysis of ME13087 Events

ME13087 contains Ceres Clone: 968180 (SEQ ID NO:1115) from *Brassica napus*, which encodes a 159 amino acid zinc finger protein. Evaluation of low-nitrogen tolerance for ME13087 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Four events, -01, -02, -03 and -04, showed significantly increased photosynthetic efficiency on low ammonium nitrate-containing media relative to the internal controls in both generations at p≤0.05 using a one-tailed t-test assuming unequal variance. A summary of photosynthetic efficiency of ME13087 seedlings is shown in Table 49. ME13087 events were also tested for enhanced growth on the low ammonium nitrate media. No significant differences between the transgenics and the controls were observed.

Events -01, -02, -03 and -04 segregated 2:1, 3:1, 3:1 and 2:1 respectively (R:S) for FINALE™ resistance in the T2 generation.

Events -01, -02, -03 and -04 of ME13087 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill) in T1 generation.

Example 46—Analysis of ME13106 Events

ME13106 contains Ceres Clone: 986438 (SEQ ID NO:1156) from *Zea mays*, which encodes a 188 amino acid protein of unknown function. Evaluation of low-nitrogen tolerance for ME13106 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low ammonium nitrate-containing media relative to the internal controls in both generations at p≤0.05 using a one-tailed t-test assuming unequal variance. A summary of photosynthetic efficiency of ME13106 seedlings is shown in Table 50. ME13106 events were also tested for enhanced growth on the low ammonium nitrate media. No significant differences between the transgenics and the controls were observed.

TABLE 49 t-test comparison of seedling photosynthetic efficiency
between transgenic seedlings and pooled non-transgemc segregants
after 18 days of growth on low ammonium nitrate.

| Line | Events | Transgenic | | Pooled Non-Transgenics | | t-test |
|---|---|---|---|---|---|---|
| | | Fv/Fm | n | Fv/Fm | n | p-value |
| ME13087 | ME13087-01 ($T_2$) | 0.59761 | 23 | 0.56163 | 38 | $9.61 \times 10^{-3}$ |
| ME13087 | ME13087-01 ($T_3$) | 0.61247 | 15 | 0.56163 | 38 | $5.99 \times 10^{-4}$ |
| ME13087 | ME13087-02 ($T_2$) | 0.63400 | 39 | 0.58532 | 34 | $9.30 \times 10^{-3}$ |
| ME13087 | ME13087-02 ($T_3$) | 0.63442 | 26 | 0.58532 | 34 | $1.22 \times 10^{-2}$ |
| ME13087 | ME13087-03 ($T_2$) | 0.61429 | 38 | 0.55533 | 24 | $5.04 \times 10^{-3}$ |
| ME13087 | ME13087-03 ($T_3$) | 0.62283 | 35 | 0.55533 | 24 | $3.31 \times 10^{-3}$ |
| ME13087 | ME13087-04 ($T_2$) | 0.62714 | 28 | 0.60068 | 56 | $3.02 \times 10^{-2}$ |
| ME13087 | ME13087-04 ($T_3$) | 0.64543 | 7 | 0.60068 | 56 | $9.04 \times 10^{-3}$ |

TABLE 50 t-test comparison of seedling photosynthetic efficiency between transgenic seedlings and pooled non-transgenic segregants after 18 days of growth on low ammonium nitrate.

| | | Transgenic | | Pooled Non-Transgenics | | t-test |
|---|---|---|---|---|---|---|
| Line | Events | Fv/Fm | n | Fv/Fm | n | p-value |
| ME13106 | ME13106-03 ($T_2$) | 0.62726 | 27 | 0.58600 | 43 | $1.50 \times 10^{-2}$ |
| ME13106 | ME13106-03 ($T_3$) | 0.65163 | 30 | 0.58600 | 43 | $1.69 \times 10^{-4}$ |
| ME13106 | ME13106-04 ($T_2$) | 0.60836 | 36 | 0.55876 | 25 | $2.62 \times 10^{-2}$ |
| ME13106 | ME13106-04 ($T_3$) | 0.64250 | 38 | 0.55876 | 25 | $5.01 \times 10^{-4}$ |

Events -03 and -04 segregated 1:1 and 3:1 respectively (R:S) for FINALE™ resistance in the $T_2$ generation.

Events -03 and -04 of ME13106 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 47—Analysis of ME13107 Events

ME13107 contains Ceres Clone: 996227 (SEQ ID NO:1158) from *Zea mays*, which encodes a 240 amino acid zein seed storage protein. Evaluation of low-nitrogen tolerance for ME13107 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Three events, -02, -04 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME13107 seedlings is shown in Table 51.

TABLE 51 t-test comparison of seedling photosynthetic efficiency between transgenic seedlings and pooled non-transgenic segregants after 18 days of growth on low ammonium nitrate.

| | | Transgenic | | Pooled Non-Transgenics | | t-test |
|---|---|---|---|---|---|---|
| Line | Events | Fv/Fm | n | Fv/Fm | n | p-value |
| ME13107 | ME13107-02 ($T_2$) | 0.63122 | 37 | 0.56643 | 21 | $1.07 \times 10^{-2}$ |
| ME13107 | ME13107-02 ($T_3$) | 0.63848 | 29 | 0.56643 | 21 | $6.03 \times 10^{-3}$ |
| ME13107 | ME13107-04 ($T_2$) | 0.62948 | 27 | 0.55918 | 50 | $2.07 \times 10^{-5}$ |
| ME13107 | ME13107-04 ($T_3$) | 0.63019 | 21 | 0.55918 | 50 | $6.72 \times 10^{-5}$ |
| ME13107 | ME13107-05 ($T_2$) | 0.61952 | 29 | 0.54440 | 48 | $7.85 \times 10^{-5}$ |
| ME13107 | ME13107-05 ($T_3$) | 0.62185 | 20 | 0.54440 | 48 | $4.02 \times 10^{-5}$ |

ME13107 events were also tested for enhanced growth on the low ammonium nitrate media. Two events, -02 and -04, showed significantly enhanced growth on low ammonium nitrate-containing media relative to the internal controls in $T_2$ generation at p≤0.05 using a one-tailed t-test assuming unequal variance. In this study, the seedling area for transgenic plants within an event was compared to the seedling area for non-transgenic segregants pooled across the same line. A summary of enhanced growth under low ammonium nitrate growth conditions of ME13071 seedlings is shown in Table 52.

TABLE 2 t-test comparison of seedling area between transgenic seedlings and pooled non-transgenic segregants after 18 days of growth on low ammonium nitrate.

| | | Transgenic | | Pooled Non-Transgenics | | t-test |
|---|---|---|---|---|---|---|
| Line | Events | Area | n | Area | n | p-value |
| ME13107 | ME13107-02 ($T_2$) | 0.07738 | 37 | 0.06919 | 203 | $3.63 \times 10^{-2}$ |
| ME13107 | ME13107-02 ($T_3$) | 0.07688 | 29 | 0.06919 | 203 | $4.60 \times 10^{-2}$ |

TABLE 2-continued t-test comparison of seedling area between transgenic seedlings and pooled
non-transgenic segregants after 18 days of growth on low ammonium nitrate.

| Line | Events | Transgenic | | Pooled Non-Transgenics | | t-test |
| --- | --- | --- | --- | --- | --- | --- |
| | | Area | n | Area | n | p-value |
| ME13107 | ME13107-04 ($T_2$) | 0.07514 | 27 | 0.06919 | 203 | $3.18 \times 10^{-2}$ |
| ME13107 | ME13107-04 ($T_3$) | 0.07585 | 21 | 0.06919 | 203 | $2.27 \times 10^{-2}$ |

Events -02, -04 and -05 segregated 3:1, 1:1 and 2:1 respectively (R:S) for FINALE™ resistance in the $T_2$ generation.

Events -02, -04 and -05 of ME13107 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 48—Analysis of ME13108 Events

ME13108 contains Ceres Clone: 996263 (SEQ ID NO:1165) from *Zea mays*, which encodes an 84 amino acid BRICK1 protein. Evaluation of low-nitrogen tolerance for ME13108 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Three events, -01, -04 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME13108 seedlings is shown in Table 53. ME13108 events were also tested for enhanced growth on the low ammonium nitrate media. No significant differences between the transgenics and the controls were observed.

Events -01, -04 and -05 segregated 3:1 (R:S) for FINALE™ resistance in the $T_2$ generation.

Events -01, -04 and -05 of ME13108 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 49—Analysis of ME13110 Events

ME13110 contains Ceres Clone: 988083 (SEQ ID NO:1184) from *Zea mays*, which encodes a 188 amino acid protein of unknown function. Evaluation of low-nitrogen tolerance for ME13110 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Three events, -03, -04 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME13110 seedlings is shown in Table 54. ME13110 events were also tested for enhanced growth on the low ammonium nitrate media. No significant differences between the transgenics and the controls were observed.

TABLE 53 t-test comparison of seedling photosynthetic efficiency between
transgenic seedlings and pooled non-transgenic segregants
after 18 days of growth on low ammonium nitrate.

| Line | Events | Transgenic | | Pooled Non-Transgenics | | t-test |
| --- | --- | --- | --- | --- | --- | --- |
| | | Fv/Fm | n | Fv/Fm | n | p-value |
| ME13108 | ME13108-01 ($T_2$) | 0.56703 | 36 | 0.53932 | 195 | $1.97 \times 10^{-2}$ |
| ME13108 | ME13108-01 ($T_3$) | 0.59250 | 26 | 0.53932 | 195 | $3.64 \times 10^{-4}$ |
| ME13108 | ME13108-04 ($T_2$) | 0.60032 | 37 | 0.53932 | 195 | $3.37 \times 10^{-7}$ |
| ME13108 | ME13108-04 ($T_3$) | 0.60463 | 30 | 0.53932 | 195 | $4.10 \times 10^{-5}$ |
| ME13108 | ME13108-05 ($T_2$) | 0.60727 | 30 | 0.53932 | 195 | $4.97 \times 10^{-9}$ |
| ME13108 | ME13108-05 ($T_3$) | 0.61850 | 32 | 0.53932 | 195 | $2.35 \times 10^{-9}$ |

TABLE 54 t-test comparison of seedling photosynthetic efficiency between transgenic seedlings and pooled non-transgenic segregants after 18 days of growth on low ammonium nitrate.

| Line | Events | Transgenic | | Pooled Non-Transgenics | | t-test |
| --- | --- | --- | --- | --- | --- | --- |
| | | Fv/Fm | n | Fv/Fm | n | p-value |
| ME13110 | ME13110-03 ($T_2$) | 0.5721 | 34 | 0.3948 | 16 | $8.92 \times 10^{-3}$ |
| ME13110 | ME13110-03 ($T_3$) | 0.5773 | 24 | 0.4583 | 26 | $4.58 \times 10^{-4}$ |
| ME13110 | ME13110-04 ($T_2$) | 0.5651 | 35 | 0.4243 | 15 | $4.34 \times 10^{-2}$ |
| ME13110 | ME13110-04 ($T_3$) | 0.6000 | 10 | 0.4594 | 40 | $3.29 \times 10^{-3}$ |
| ME13110 | ME13110-05 ($T_2$) | 0.5143 | 28 | 0.3809 | 22 | $2.24 \times 10^{-2}$ |
| ME13110 | ME13110-05 ($T_3$) | 0.5278 | 28 | 0.3688 | 21 | $1.28 \times 10^{-2}$ |

Events -03, -04 and -05 segregated 3:1, 1:1 and 3:1 respectively (R:S) for FINALE™ resistance in the $T_2$ generation.

Events -03, -04 and -05 of ME13110 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 50—Analysis of ME13125 Events

ME13125 contains Ceres Clone: 732 (At3g50880, SEQ ID NO:1193) from *Arabidopsis thaliana*, which encodes a 188 amino acid protein of unknown function. Evaluation of low-nitrogen tolerance for ME13125 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Three events, -01, -03 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME13125 seedlings is shown in Table 55. ME13125 events were also tested for enhanced growth on the low ammonium nitrate media. No significant differences between the transgenics and the controls were observed.

Events -01, -03 and -05 segregated 3:1, 15:1 and 2:1 respectively (R:S) for FINALE™ resistance in the $T_2$ generation.

Events -01, -03 and -05 of ME13125 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 51—Analysis of ME13149 Events

ME13149 contains Ceres Clone: 2267 (At2g24765, SEQ ID NO:1209) from *Arabidopsis thaliana*, which encodes a 182 amino acid ADP-ribosylation factor 3 protein. Evaluation of low-nitrogen tolerance for ME13149 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -02 and -03, showed significantly increased photosynthetic efficiency on low ammonium nitrate-containing media relative to the internal controls in both generations at p≤0.05 using a one-tailed t-test assuming unequal variance. A summary of photosynthetic efficiency of ME13149 seedlings is shown in Table 56. ME13149 events were also tested for enhanced growth on the low ammonium nitrate media. No significant differences between the transgenics and the controls were observed.

TABLE 55 t-test comparison of seedling photosynthetic efficiency between transgenic seedlings and pooled non-transgenic segregants after 18 days of growth on low ammonium nitrate.

| Line | Events | Transgenic | | Pooled Non-Transgenics | | t-test |
| --- | --- | --- | --- | --- | --- | --- |
| | | Fv/Fm | n | Fv/Fm | n | p-value |
| ME13125 | ME13125-01 ($T_2$) | 0.61129 | 42 | 0.53829 | 125 | $4.82 \times 10^{-7}$ |
| ME13125 | ME13125-01 ($T_3$) | 0.61929 | 38 | 0.53829 | 125 | $1.96 \times 10^{-7}$ |
| ME13125 | ME13125-03 ($T_2$) | 0.63360 | 45 | 0.53829 | 125 | $3.05 \times 10^{-13}$ |
| ME13125 | ME13125-03 ($T_3$) | 0.62218 | 44 | 0.53829 | 125 | $3.81 \times 10^{-9}$ |
| ME13125 | ME13125-05 ($T_2$) | 0.61565 | 31 | 0.53829 | 125 | $4.12 \times 10^{-8}$ |
| ME13125 | ME13125-05 ($T_3$) | 0.58469 | 16 | 0.53829 | 125 | 0.05 |

TABLE 56

T-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME13149 | ME13149-02 ($T_2$) | 0.55623 | 30 | 0.51138 | 55 | $2.29 \times 10^{-2}$ |
| ME13149 | ME13149-02 ($T_3$) | 0.54818 | 17 | 0.51138 | 55 | $4.56 \times 10^{-2}$ |
| ME13149 | ME13149-03 ($T_2$) | 0.55998 | 42 | 0.51138 | 55 | $5.11 \times 10^{-3}$ |
| ME13149 | ME13149-03 ($T_3$) | 0.58450 | 24 | 0.51138 | 55 | $2.77 \times 10^{-4}$ |

Events -02 and -03 segregated 2:1 and 15:1 respectively (R:S) for FINALE™ resistance in the $T_2$ generation.

Events -02 and -03 of ME13149 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 52—Analysis of ME13151 Events

ME13151 contains Ceres Clone: 39358 (At3g25150, SEQ ID NO:1273) from *Arabidopsis thaliana*, which encodes a 488 amino acid nuclear transport factor 2 (NTF2) domain protein. Evaluation of low-nitrogen tolerance for ME13151 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -02, showed significantly increased photosynthetic efficiency on low ammonium nitrate-containing media relative to the internal controls in both generations at p≤0.05 using a one-tailed t-test assuming unequal variance. A summary of photosynthetic efficiency of ME13151 seedlings is shown in Table 57. ME13151 events were also tested for enhanced growth on the low ammonium nitrate media. No significant differences between the transgenics and the controls were observed.

Events -01 and -02 segregated 9:1 and 6:1 respectively (R:S) for FINALE™ resistance in the T2 generation.

Events -01 and -02 of ME13151 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 53—Analysis of ME13153 Events

ME13153 contains Ceres Clone: 115046 (At3g17760, SEQ ID NO:1301) from *Arabidopsis thaliana*, which encodes a 494 amino acid glutamate decarboxylase. Evaluation of low-nitrogen tolerance for ME13153 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low ammonium nitrate-containing media relative to the internal controls in both generations at p≤0.05 using a one-tailed t-test assuming unequal variance. A summary of photosynthetic efficiency of ME13153 seedlings is shown in Table 58. ME13153 events were also tested for increased photosynthetic efficiency on the low nitrate media. No significant differences between the transgenics and the controls were observed.

TABLE 57

T-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME13151 | ME13151-01 ($T_2$) | 0.62593 | 44 | 0.53141 | 17 | $8.58 \times 10^{-4}$ |
| ME13151 | ME13151-01 ($T_3$) | 0.59936 | 33 | 0.53141 | 17 | $1.21 \times 10^{-2}$ |
| ME13151 | ME13151-02 ($T_2$) | 0.59879 | 39 | 0.46956 | 16 | $3.08 \times 10^{-5}$ |
| ME13151 | ME13151-02 ($T_3$) | 0.59566 | 32 | 0.46956 | 16 | $4.28 \times 10^{-5}$ |

TABLE 58

T-test comparison of seedling photosynthetic efficiency
between transgenic seedlings and non-transgenic segregants
after 14 days of growth on low ammonium nitrate.

| Line | Events | Transgenic | | Pooled Non-Transgenics | | t-test |
| | | Fv/Fm | n | Fv/Fm | n | p-value |
| --- | --- | --- | --- | --- | --- | --- |
| ME13153 | ME13153-03 ($T_2$) | 0.62 | 34 | 0.56 | 16 | $3.0 \times 10^{-2}$ |
| ME13153 | ME13153-03 ($T_3$) | 0.60 | 19 | 0.54 | 22 | $2.9 \times 10^{-2}$ |
| ME13153 | ME13153-04 ($T_2$) | 0.57 | 32 | 0.50 | 18 | $4.3 \times 10^{-2}$ |
| ME13153 | ME13153-04 ($T_3$) | 0.61 | 24 | 0.55 | 24 | $2.1 \times 10^{-2}$ |

Events -03 and -04 segregated 3:1 (R:S) for FINALE™ resistance in the $T_2$ generation.

Events -03 and -04 of ME13153 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting. Events -03 and -04 yielded slightly less seed per plant compared to the controls, but these differences are not significant at p≤0.10.

Example 54—Analysis of ME13177 Events

ME13177 contains Ceres Clone: 339439 (SEQ ID NO:1341) from *Zea mays*, which encodes a 345 amino acid cyclin C-terminal domain protein. Evaluation of low-nitrogen tolerance for ME13177 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -02, showed significantly increased photosynthetic efficiency on low ammonium nitrate-containing media relative to the internal controls in both generations at p≤0.05 using a one-tailed t-test assuming unequal variance. A summary of photosynthetic efficiency of ME13177 seedlings is shown in Table 59. ME13177 events were also tested for enhanced growth on the low ammonium nitrate media. No significant differences between the transgenics and the controls were observed.

Events -01 and -02 segregated 2:1 and 3:1 respectively (R:S) for FINALE™ resistance in the $T_2$ generation.

Events -01 and -02 of ME13177 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 55—Analysis of ME13200 Events

ME13200 contains Ceres Clone: 896483 (SEQ ID NO:1384) from *Zea mays*, which encodes an 85 amino acid myb family transcription factor. Evaluation of low-nitrogen tolerance for ME13200 in $T_2$ and $T_3$ was conducted under the same conditions as described in Examples 2 and 3. A summary of the enhanced growth of ME13200 events on low ammonium nitrate-containing media is shown in Table 60. In this study, the seedling area for transgenic plants within an event was compared to the seedling area for non-transgenic segregants pooled across the same line. Two events, -03 and -04, were found significantly larger than the pooled non-transgenic segregants after 18 days of growth on low ammonium nitrate-containing media relative to the internal controls in both generations at p≤0.05 using a one-tailed t-test assuming unequal variance. ME13200 events were also tested for increased photosynthetic efficiency on the low ammonium nitrate media as well as for enhanced photosynthesis and growth on low nitrate media. No significant differences between the transgenics and the controls were observed.

TABLE 59 t-test comparison of seedling photosynthetic efficiency between
transgenic seedlings and pooled non-transgenic segregants
after 18 days of growth on low ammonium nitrate.

| Line | Events | Transgenic | | Pooled Non-Transgenics | | t-test |
| | | Fv/Fm | n | Fv/Fm | n | p-value |
| --- | --- | --- | --- | --- | --- | --- |
| ME13177 | ME13177-01 ($T_2$) | 0.6315 | 32 | 0.6112 | 175 | $2.43 \times 10^{-2}$ |
| ME13177 | ME13177-01 ($T_3$) | 0.6407 | 29 | 0.6112 | 175 | $7.33 \times 10^{-3}$ |
| ME13177 | ME13177-02 ($T_2$) | 0.6400 | 41 | 0.6112 | 175 | $1.23 \times 10^{-3}$ |
| ME13177 | ME13177-02 ($T_3$) | 0.6499 | 20 | 0.6112 | 175 | $6.47 \times 10^{-3}$ |

TABLE 60 t-test comparison of seedline area between transgenic seedlings and pooled non-transgenic segregants after 18 days of growth on low ammonium nitrate.

| | | Transgenic | | Pooled Non-Transgenics | | t-test |
|---|---|---|---|---|---|---|
| Line | Events | Area | n | Area | n | p-value |
| ME13200 | ME13200-03 ($T_2$) | 0.07366 | 43 | 0.06342 | 35 | $4.09 \times 10^{-4}$ |
| ME13200 | ME13200-03 ($T_3$) | 0.08193 | 34 | 0.06342 | 35 | $2.37 \times 10^{-5}$ |
| ME13200 | ME13200-04 ($T_2$) | 0.07377 | 48 | 0.06342 | 35 | $4.87 \times 10^{-4}$ |
| ME13200 | ME13200-04 ($T_3$) | 0.07530 | 47 | 0.06342 | 35 | $1.88 \times 10^{-4}$ |

Events -03 and -04 segregated 3:1 and 15:1 respectively (R:S) for FINALE™ resistance in the $T_2$ generation.

Events -03 and -04 of ME13200 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 56—Analysis of ME13204 Events

ME13204 contains Ceres Clone: 995409 (SEQ ID NO:1408) from *Zea mays*, which encodes a 178 amino acid protein of unknown function. Evaluation of low-nitrogen tolerance for ME13204 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -05, showed significantly increased photosynthetic efficiency on low nitrate-containing media relative to the internal controls in both generations at $p \leq 0.05$ using a one-tailed t-test assuming unequal variance. A summary of photosynthetic efficiency of ME13204 seedlings is shown in Table 61. ME13204 events were also tested for enhanced growth on the low nitrate media as well as for enhanced growth and photosynthetic efficiency on low ammonium nitrate media. No significant differences between the transgenics and the controls were observed.

Events -01 and -05 segregated 9:1 and 3:1 respectively (R:S) for FINALE™ resistance in the $T_2$ generation.

Events -01 and -05 of ME13204 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 57—Analysis of ME14649 Events

ME14649 contains Ceres Annot: 850581 (At5g01880, SEQ ID NO:1427) from *Arabidopsis thaliana*, which encodes a 159 amino acid zinc finger protein. Evaluation of low-nitrogen tolerance for ME14649 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -02 and -03, showed significantly increased photosynthetic efficiency on low ammonium nitrate-containing media relative to the internal controls in both generations at $p \leq 0.05$ using a one-tailed t-test assuming unequal variance. A summary of photosynthetic efficiency of ME14649 seedlings is shown in Table 62. ME14649 events were also tested for enhanced growth on the low ammonium nitrate media. No significant differences between the transgenics and the controls were observed.

TABLE 61

T-test comparison of seedling photosynthetic efficiency between transgenic seedlings and pooled non-transgenic segregants after 14 days of growth on low nitrate media.

| | | Transgenic | | Pooled Non-Transgenics | | t-test |
|---|---|---|---|---|---|---|
| Line | Events | Fv/Fm | n | Fv/Fm | n | p-value |
| ME13204 | ME13204-01 ($T_2$) | 0.5874 | 45 | 0.5354 | 46 | $1.41 \times 10^{-2}$ |
| ME13204 | ME13204-01 ($T_3$) | 0.5932 | 36 | 0.5354 | 46 | $9.85 \times 10^{-3}$ |
| ME13204 | ME13204-05 ($T_2$) | 0.5855 | 34 | 0.5354 | 46 | $2.00 \times 10^{-2}$ |
| ME13204 | ME13204-05 ($T_3$) | 0.5998 | 20 | 0.5354 | 46 | $5.58 \times 10^{-3}$ |

TABLE 62 t-test comparison of seedling photosynthetic efficiency between
transgenic seedlings and pooled non-transgenic segregants
after 18 days of growth on low ammonium nitrate.

| Line | Events | Transgenic | | Pooled Non-Transgenics | | t-test |
| --- | --- | --- | --- | --- | --- | --- |
| | | Fv/Fm | n | Fv/Fm | n | p-value |
| ME14649 | ME14649-02 ($T_2$) | 0.59789 | 35 | 0.54533 | 30 | $1.54 \times 10^{-4}$ |
| ME14649 | ME14649-02 ($T_3$) | 0.58154 | 26 | 0.54533 | 30 | $3.42 \times 10^{-2}$ |
| ME14649 | ME14649-03 ($T_2$) | 0.61875 | 28 | 0.56539 | 33 | $2.03 \times 10^{-3}$ |
| ME14649 | ME14649-03 ($T_3$) | 0.62630 | 27 | 0.56539 | 33 | $9.18 \times 10^{-4}$ |

Events -02 and -03 segregated 3:1 and 2:1 respectively (R:S) for FINALE™ resistance in the $T_2$ generation.

Events -02 and -03 of ME14649 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill) in T1 generation.

Example 58—Analysis of ME16546 Events

ME16546 contains Ceres Annot: 862321 (At2g45360, SEQ ID NO:1462) from *Arabidopsis thaliana*, which encodes a 215 amino acid protein of unknown function. Evaluation of low-nitrogen tolerance for ME16546 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -04 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME16546 seedlings is shown in Table 63. ME16546 events were also tested for enhanced growth on the low ammonium nitrate media. No significant differences between the transgenics and the controls were observed.

Events -04 and -05 segregated 2:1 and 3:1 respectively (R:S) for FINALE™ resistance in the $T_2$ generation.

Events -04 and -05 of ME16546 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 59—Analysis of ME17457 Events

ME17457 contains Ceres Annot: 839064 (At1g80600, SEQ ID NO:1478) from *Arabidopsis thaliana*, which encodes a 457 acetylornithine aminotransferase, a member of the Class-III aminotransferase family. This is a homolog of Ceres Clone: 19586 (ME01463, SEQ ID NO:76). Evaluation of low-nitrogen tolerance for ME17457 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Four events, -02, -03, -05 and -06, showed significantly increased photosynthetic efficiency on low ammonium nitrate-containing media relative to the internal controls in both generations at p≤0.05 using a one-tailed t-test assuming unequal variance. A summary of photosynthetic efficiency of ME17457 seedlings is shown in Table 64. ME17457 events were also tested for enhanced growth on the low ammonium nitrate media. No significant differences between the transgenics and the controls were observed.

TABLE 63 t-test comparison of seedling photosynthetic efficiency between
transgenic seedlings and pooled non-transgenic segregants
after 18 days of growth on low ammonium nitrate.

| Line | Events | Transgenic | | Pooled Non-Transgenics | | t-test |
| --- | --- | --- | --- | --- | --- | --- |
| | | Fv/Fm | n | Fv/Fm | n | p-value |
| ME16546 | ME16546-04 ($T_2$) | 0.59891 | 33 | 0.56124 | 130 | $2.21 \times 10^{-4}$ |
| ME16546 | ME16546-04 ($T_3$) | 0.57924 | 41 | 0.56124 | 130 | $3.77 \times 10^{-2}$ |
| ME16546 | ME16546-05 ($T_2$) | 0.58861 | 36 | 0.56124 | 130 | $7.17 \times 10^{-3}$ |
| ME16546 | ME16546-05 ($T_3$) | 0.61763 | 27 | 0.56124 | 130 | $3.25 \times 10^{-6}$ |

TABLE 64 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME17457 | ME17457-02 ($T_2$) | 0.60800 | 21 | 0.50878 | 46 | $6.99 \times 10^{-4}$ |
| ME17457 | ME17457-02 ($T_3$) | 0.59539 | 18 | 0.50878 | 46 | $9.02 \times 10^{-3}$ |
| ME17457 | ME17457-03 ($T_2$) | 0.55164 | 11 | 0.49673 | 45 | $3.45 \times 10^{-2}$ |
| ME17457 | ME17457-03 ($T_3$) | 0.57356 | 18 | 0.49673 | 45 | $2.49 \times 10^{-3}$ |
| ME17457 | ME17457-05 ($T_2$) | 0.52928 | 18 | 0.42672 | 32 | $2.23 \times 10^{-3}$ |
| ME17457 | ME17457-05 ($T_3$) | 0.56660 | 25 | 0.42672 | 32 | $5.97 \times 10^{-5}$ |
| ME17457 | ME17457-06 ($T_2$) | 0.54088 | 33 | 0.47350 | 30 | $3.59 \times 10^{-4}$ |
| ME17457 | ME17457-06 ($T_3$) | 0.52210 | 21 | 0.47350 | 30 | $2.03 \times 10^{-2}$ |

Events -02, -03 and -05 segregated 1:1, and Event -06 segregated 3:1 (R:S) for FINALE™ resistance in the $T_2$ generation.

Events -02, -03, -05 and -06 of ME17457 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 60—Analysis of ME17567 Events

ME17567 contains Ceres Annot: 864666 (At1g16320, SEQ ID NO:1490) from *Arabidopsis thaliana*, which encodes a 273 amino acid protein of unknown function. Evaluation of low-nitrogen tolerance for ME17567 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -04, showed significantly increased photosynthetic efficiency on low nitrate-containing media relative to the internal controls in both generations at p≤0.05 using a one-tailed t-test assuming unequal variance. A summary of photosynthetic efficiency of ME17567 seedlings is shown in Table 65. ME17567 events were also tested for enhanced growth on the low nitrate media as well as enhanced photosynthetic efficiency and growth on low ammonium nitrate media. No significant differences between the transgenics and the controls were observed.

Events -01 and -04 segregated 2:1 and 3:1 respectively (R:S) for FINALE™ resistance in the $T_2$ generation.

Events -01 and -04 of ME17567 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 61—Analysis of ME17932 Events

ME17932 contains Ceres Annot: 875012 (At3g53560, SEQ ID NO:1509) from *Arabidopsis thaliana*, which encodes a 340 amino acid chloroplast lumen common family protein. Evaluation of low-nitrogen tolerance for ME17932 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Four events, -01, -02, -03 and -05, showed significantly increased photosynthetic efficiency on low ammonium nitrate-containing media relative to the internal controls in both generations at p≤0.05 using a one-tailed t-test assuming unequal variance. A summary of photosynthetic efficiency of ME17932 seedlings is shown in Table 66. ME17932 events were also tested for enhanced growth on the low ammonium nitrate media. No significant differences between the transgenics and the controls were observed.

TABLE 65 t-test comparison of seedling photosynthetic efficiency between transgenic seedlings and pooled non-transgenic segregants after 14 days of growth on low nitrate.

| Line | Events | Transgenic Fv/Fm | n | Pooled Non-Transgenics Fv/Fm | n | t-test p-value |
|---|---|---|---|---|---|---|
| ME17567 | ME17567-01 ($T_2$) | 0.605455 | 33 | 0.474791 | 67 | $9.69 \times 10^{-10}$ |
| ME17567 | ME17567-01 ($T_3$) | 0.6244 | 20 | 0.474791 | 67 | $6.79 \times 10^{-13}$ |
| ME17567 | ME17567-04 ($T_2$) | 0.57727 | 37 | 0.474791 | 67 | $1.22 \times 10^{-7}$ |
| ME17567 | ME17567-04 ($T_3$) | 0.615143 | 35 | 0.474791 | 67 | $5.95 \times 10^{-13}$ |

TABLE 66 t-test comparison of seedling photosynthetic efficiency between transgenic seedlings and pooled non-transgenic segregants after 18 days of growth on low ammonium nitrate.

| Line | Events | Transgenic | | Pooled Non-Transgenics | | t-test |
|---|---|---|---|---|---|---|
| | | Fv/Fm | n | Fv/Fm | n | p-value |
| ME17932 | ME17932-01 ($T_2$) | 0.6292 | 36 | 0.6094 | 194 | 0.050 |
| ME17932 | ME17932-01 ($T_3$) | 0.6640 | 22 | 0.6094 | 194 | $2.82 \times 10^{-6}$ |
| ME17932 | ME17932-02 ($T_2$) | 0.6351 | 32 | 0.6094 | 194 | $1.05 \times 10^{-2}$ |
| ME17932 | ME17932-02 ($T_3$) | 0.6373 | 20 | 0.6094 | 194 | $2.82 \times 10^{-2}$ |
| ME17932 | ME17932-03 ($T_2$) | 0.6504 | 45 | 0.6094 | 194 | $1.80 \times 10^{-5}$ |
| ME17932 | ME17932-03 ($T_3$) | 0.6708 | 20 | 0.6094 | 194 | $8.38 \times 10^{-4}$ |
| ME17932 | ME17932-05 ($T_2$) | 0.6349 | 24 | 0.6094 | 194 | $3.23 \times 10^{-2}$ |
| ME17932 | ME17932-05 ($T_3$) | 0.6615 | 11 | 0.6094 | 194 | $1.16 \times 10^{-3}$ |

Events -01, -02, -03 and -05 segregated 3:1, 2:1, 15:1 and 1:1 respectively (R:S) for FINALE™ resistance in the $T_2$ generation.

Events -01, -02, -03 and -05 of ME17932 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 62—Analysis of ME17936 Events

ME17936 contains Ceres Annot: 874016 (At3g42800, SEQ ID NO:1524) from *Arabidopsis thaliana*, which encodes a 341 amino acid protein of unknown function. Evaluation of low-nitrogen tolerance for ME17936 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -05, showed significantly increased photosynthetic efficiency on low nitrate-containing media relative to the internal controls in both generations at p≤0.05 using a one-tailed t-test assuming unequal variance. A summary of photosynthetic efficiency of ME17936 seedlings is shown in Table 67. ME17936 events were also tested for enhanced growth on the low nitrate media as well as for increased photosynthetic efficiency and enhanced growth on low ammonium nitrate media. No significant differences between the transgenics and the controls were observed.

Events -01 and -05 segregated 3:1 (R:S) for FINALE™ resistance in the $T_2$ generation.

Events -01 and -05 of ME17936 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 63—Analysis of ME18275 Events

ME18275 contains Ceres Annot: 827304 (At2g18300, SEQ ID NO:1536) from *Arabidopsis thaliana*, which encodes a 335 amino acid helix-loop-helix DNA-binding domain. Evaluation of low-nitrogen tolerance for ME18275 in $T_2$ and $T_3$ was conducted under the same conditions as described in Examples 2 and 3. A summary of the enhanced growth of ME18275 events on low nitrate-containing media is shown in Table 68. In this study, the seedling area for transgenic plants within an event was compared to the seedling area for non-transgenic segregants pooled across the same line. Three events, -01, -02 and -03, were found significantly larger than the pooled non-transgenic segregants after 14 days of growth on low nitrate-containing media relative to the internal controls in both generations at p≤0.05, using a one-tailed t-test assuming unequal variance. ME18275 events were also tested for photosynthetic efficiency on the low nitrate media as well as for increased photosynthetic efficiency and enhanced growth on low ammonium nitrate media. No significant differences between the transgenics and the controls were observed.

TABLE 67 t-test comparison of seedling photosynthetic efficiency between transgenic seedlings and pooled non-transgenic segregants after 14 days of growth on low nitrate media.

| Line | Events | Transgenic | | Pooled Non-Transgenics | | t-test |
|---|---|---|---|---|---|---|
| | | Fv/Fm | n | Fv/Fm | n | p-value |
| ME17936 | ME17936-01 ($T_2$) | 0.64778 | 36 | 0.61762 | 39 | $4.68 \times 10^{-3}$ |
| ME17936 | ME17936-01 ($T_3$) | 0.66081 | 21 | 0.61762 | 39 | $4.33 \times 10^{-5}$ |
| ME17936 | ME17936-05 ($T_2$) | 0.63189 | 35 | 0.61444 | 50 | $2.73 \times 10^{-2}$ |
| ME17936 | ME17936-05 ($T_3$) | 0.64257 | 14 | 0.61444 | 50 | $2.56 \times 10^{-2}$ |

TABLE 68 t-test comparison of seedling area between transgenic seedlings and pooled non-transgenic segregants after 14 days of growth on low nitrate.

| Line | Events | Transgenic Area | n | Pooled Non-Transgenics Area | n | t-test p-value |
|---|---|---|---|---|---|---|
| ME18275 | ME18275-01 ($T_2$) | 0.09574 | 40 | 0.05961 | 10 | $3.24 \times 10^{-10}$ |
| ME18275 | ME18275-01 ($T_3$) | 0.07807 | 32 | 0.05142 | 15 | $3.71 \times 10^{-4}$ |
| ME18275 | ME18275-02 ($T_2$) | 0.11903 | 33 | 0.05884 | 16 | $6.21 \times 10^{-14}$ |
| ME18275 | ME18275-02 ($T_3$) | 0.08552 | 22 | 0.04208 | 24 | $2.82 \times 10^{-5}$ |
| ME18275 | ME18275-03 ($T_2$) | 0.10281 | 39 | 0.06789 | 9 | $9.48 \times 10^{-8}$ |
| ME18275 | ME18275-03 ($T_3$) | 0.09136 | 20 | 0.05646 | 26 | $9.46 \times 10^{-4}$ |

Events -01, -02 and -03 segregated 3:1 (R:S) for FINALE™ resistance in the $T_2$ generation.

Events -01, -02 and -03 of ME18275 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 64—Analysis of ME18924 Events

ME18924 contains Ceres Annot: 869192 (At1g72160, SEQ ID NO:1553) from *Arabidopsis thaliana*, which encodes a 490 amino acid emp24/gp25L/p24 family protein. Evaluation of low-nitrogen tolerance for ME18924 in $T_2$ and $T_3$ was conducted under the same conditions as described in Examples 2 and 3. A summary of photosynthetic efficiency of ME18924 seedlings is shown in Table 69. In this study, the seedling photosynthetic efficiency was measured as Fv/Fm comparing transgenic plants within an event to non-transgenic segregants pooled across the same plate. Three events, -02, -04 and -05, showed significantly increased photosynthetic efficiency on low ammonium nitrate-containing media relative to the internal controls in both generations at p≤0.05, using a one-tailed t-test assuming unequal variance.

TABLE 69 t-test comparison of seedling photosynthetic efficiency between transgenic seedlings and pooled non-transgenic segregants after 18 days of growth on low ammonium nitrate.

| Line | Events | Transgenic Fv/Fm | n | Pooled Non-Transgenics Fv/Fm | n | t-test p-value |
|---|---|---|---|---|---|---|
| ME18924 | ME18924-02 ($T_2$) | 0.6515 | 46 | 0.6223 | 138 | $6.43 \times 10^{-3}$ |
| ME18924 | ME18924-02 ($T_3$) | 0.6639 | 45 | 0.6223 | 138 | $1.52 \times 10^{-4}$ |
| ME18924 | ME18924-04 ($T_2$) | 0.6489 | 33 | 0.6223 | 138 | $2.72 \times 10^{-3}$ |
| ME18924 | ME18924-04 ($T_3$) | 0.6517 | 21 | 0.6223 | 138 | $1.58 \times 10^{-2}$ |
| ME18924 | ME18924-05 ($T_2$) | 0.6602 | 35 | 0.6223 | 138 | $5.55 \times 10^{-5}$ |
| ME18924 | ME18924-05 ($T_3$) | 0.6488 | 31 | 0.6223 | 138 | $4.25 \times 10^{-2}$ |

ME18924 events were also tested for enhanced growth on the low ammonium nitrate media. A summary of the enhanced growth of ME18924 events on low nitrate-containing media is shown in Table 70. In this study, the seedling area for transgenic plants within an event was compared to the seedling area for non-transgenic segregants pooled across the same line. Two events, -01 and -04, were found significantly larger than the pooled non-transgenic segregants after 18 days of growth on low ammonium nitrate-containing media relative to the internal controls in both generations at p≤0.05, using a one-tailed t-test assuming unequal variance.

TABLE 70 t-test comparison of seedling area between transgenic seedlings and pooled
non-transgenic segregants after 18 days of growth on low ammonium nitrate.

| Line | Events | Transgenic | | Pooled Non-Transgenics | | t-test |
| | | Area | n | Area | n | p-value |
| --- | --- | --- | --- | --- | --- | --- |
| ME18924 | ME18924-01 ($T_2$) | 0.06881 | 37 | 0.06311 | 138 | $1.31 \times 10^{-2}$ |
| ME18924 | ME18924-01 ($T_3$) | 0.07164 | 34 | 0.06311 | 138 | $7.43 \times 10^{-3}$ |
| ME18924 | ME18924-04 ($T_2$) | 0.08401 | 33 | 0.06311 | 138 | $5.64 \times 10^{-8}$ |
| ME18924 | ME18924-04 ($T_3$) | 0.07365 | 21 | 0.06311 | 138 | $3.82 \times 10^{-2}$ |

Events -01, -02, -04 and -05 segregated 3:1, 15:1, 2:1 and 2:1 respectively (R:S) for FINALE™ resistance in the $T_2$ generation.

Events -01, -02, -04 and -05 of ME18924 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 65—Analysis of ME19182 Events

ME19182 contains Ceres Annot: 876419 (At4g01480, SEQ ID NO:1576) from *Arabidopsis thaliana*, which encodes a 216 amino acid inorganic pyrophosphatase protein. Evaluation of low-nitrogen tolerance for ME19182 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -01 and -03, showed significantly increased photosynthetic efficiency on low ammonium nitrate-containing media relative to the internal controls in both generations at p≤0.05 using a one-tailed t-test assuming unequal variance. A summary of photosynthetic efficiency of ME19182 seedlings is shown in Table 71. ME19182 events were also tested for enhanced growth on the low ammonium nitrate media. No significant differences between the transgenics and the controls were observed.

Events -01 and -03 segregated 2:1 and 3:1 respectively (R:S) for FINALE™ resistance in the T2 generation.

Events -01 and -03 of ME19182 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 66—Analysis of ME20628 Events

ME20628 contains Ceres Annot: 859276 (At2g21230, SEQ ID NO:175) from *Arabidopsis thaliana*, which encodes a 188 amino acid protein of unknown function. Evaluation of low-nitrogen tolerance for ME20628 in $T_2$ and $T_3$ was conducted under the same conditions as described in Examples 2 and 3. In this study, the seedling photosynthetic efficiency was measured as Fv/Fm comparing transgenic plants within an event to non-transgenic segregants pooled across the same plate. Two events, -03 and -04, showed significantly increased photosynthetic efficiency on low nitrate-containing media relative to the internal controls in both generations at p≤0.05 using a one-tailed t-test assuming unequal variance. A summary of photosynthetic efficiency of ME20628 seedlings is shown in Table 72. ME20628 events were also tested for enhanced growth on the low nitrate media as well as for increased photosynthetic efficiency and enhanced growth on low ammonium nitrate media. No significant differences between the transgenics and the controls were observed.

TABLE 71 t-test comparison of seedling photosynthetic efficiency between
transgenic seedlings and pooled non-transgenic segregants
after 18 days of growth on low ammonium nitrate.

| Line | Events | Transgenic | | Pooled Non-Transgenics | | t-test |
| | | Fv/Fm | n | Fv/Fm | n | p-value |
| --- | --- | --- | --- | --- | --- | --- |
| ME19182 | ME19182-01 ($T_2$) | 0.64938 | 24 | 0.61988 | 154 | $2.47 \times 10^{-2}$ |
| ME19182 | ME19182-01 ($T_3$) | 0.65546 | 13 | 0.61988 | 154 | $1.08 \times 10^{-2}$ |
| ME19182 | ME19182-03 ($T_2$) | 0.64797 | 37 | 0.61988 | 154 | $3.84 \times 10^{-3}$ |
| ME19182 | ME19182-03 ($T_3$) | 0.65388 | 26 | 0.61988 | 154 | $3.15 \times 10^{-3}$ |

TABLE 72 t-test comparison of seedling photosynthetic efficiency between transgenic seedlings and pooled non-transgenic segregants after 14 days of growth on low nitrate media.

| Line | Events | Transgenic Fv/Fm | n | Pooled Non-Transgenics Fv/Fm | n | t-test p-value |
|---|---|---|---|---|---|---|
| ME20628 | ME20628-03 ($T_2$) | 0.62771 | 42 | 0.58957 | 7 | $9.94 \times 10^{-3}$ |
| ME20628 | ME20628-03 ($T_3$) | 0.64375 | 20 | 0.61914 | 28 | $2.97 \times 10^{-2}$ |
| ME20628 | ME20628-04 ($T_2$) | 0.62439 | 38 | 0.59667 | 12 | $4.78 \times 10^{-2}$ |
| ME20628 | ME20628-04 ($T_3$) | 0.64768 | 22 | 0.61360 | 25 | $9.93 \times 10^{-4}$ |

Events -03 and -04 segregated 3:1 (R:S) for FINALE™ resistance in the $T_2$ generation.

Events -03 and -04 of ME20628 exhibited no statistically relevant negative phenotypes. That is, there was no detectable reduction in germination rate, the transgenic plants appeared wild type in all instances; there was no observable or statistical differences between transgenics and controls in days to flowering; there was no observable or statistical differences between transgenics and controls in the size of the rosette area 7 days post-bolting; and there was no observable or statistical differences between transgenics and controls in fertility (silique number and seed fill).

Example 67—Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al. (1998) *Proc. Natl. Acad. Sci. USA*, 95:6239-6244) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Missouri, USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NO:3, SEQ ID NO:49, SEQ ID NO:77, SEQ ID NO:100, SEQ ID NO:152, SEQ ID NO:166, SEQ ID NO:186, SEQ ID NO:208, SEQ ID NO:218, SEQ ID NO:234, SEQ ID NO:246, SEQ ID NO:300, SEQ ID NO:332, SEQ ID NO:368, SEQ ID NO:510, SEQ ID NO:533, SEQ ID NO:558, SEQ ID NO:593, SEQ ID NO:613, SEQ ID NO:646, SEQ ID NO:687, SEQ ID NO:730, SEQ ID NO:746, SEQ ID NO:769, SEQ ID NO:792, SEQ ID NO:824, SEQ ID NO:828, SEQ ID NO:855, SEQ ID NO:891, SEQ ID NO:917, SEQ ID NO:944, SEQ ID NO:976, SEQ ID NO:982, SEQ ID NO:1054, SEQ ID NO:1099, SEQ ID NO:1112, SEQ ID NO:1116, SEQ ID NO:1159, SEQ ID NO:1166, SEQ ID NO:1185, SEQ ID NO:1194, SEQ ID NO:1210, SEQ ID NO:1274, SEQ ID NO:1302, SEQ ID NO:1342, SEQ ID NO:1385, SEQ ID NO:1409, SEQ ID NO:1428, SEQ ID NO:1463, SEQ ID NO:1491, SEQ ID NO:1510, SEQ ID NO:1525, SEQ ID NO:1537, SEQ ID NO:1554, SEQ ID NO:1577, and SEQ ID NO:1437 are shown in FIGS. 1-57, respectively. Additional exemplary homologs are correlated to certain Figures in the Sequence Listing.

Example 68—Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:3.

The procedure above was repeated and an HMM was generated for each group of sequences shown in FIGS. 2-57, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

VIII. Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (7796 sequences)

SEQ ID NO: 1 - DNA, 1878 bp, Arabidopsis thaliana
  misc_feature (1)..(1878): Ceres SEEDLINE ID no.ME00919
  misc_feature (1)..(1878): Ceres CLONE ID no.29661
  misc_feature (1)..(1878): Inplanta Sequence
  misc_feature (1)..(1878): Encodes the peptide sequence at SEQ ID NO. 3
acagcaaaaagccactctcctttctctctctctcttgttcctctgcatccatggccaccaagctcgacaccagtagcttacttttggccctcttgtccaaatgtagcctccttactcaaaccaatcttgctctctctctcctcgtagcctccctagcttctctcgctctttctctcttcttctggtctcatcccggaggacccgcatggggaaagtacttcctccaccgccgccgtcaaaccaccgtgatacccgggccaagaggcttaccttttgtcggaagcatgtctctcatgtcaaacactctggctcaccgttgcatagccgcaaccgcagagaaatttagagccgaacggttaatggcgtttagtttgggagaaactcgcgtgatcgtcacgtgcaatcctgatgtagctaaagagattctaaacagtccggttttcgctgaccgcccggttaaggaatcagcttattccctcatgtttaaccgtgctatcggtttcgctccttacggcgtttactggcaaaccttgagaaaaatcgcgtctaatcatcttttcagcccgaaacagattaaacgttccgaaacgcagagaagcgtgatcgcgaatcaaatcgtgaagtgtctcacaaaacagagtaacaccaaaggtctctgtttcgcacgtgacttgatcaaaacggcatcgcttaataacatgatgtgctctgttttcggaaaagaatacgagcttgaggaagagcatgaagaagtgagtgagctacgtgaattggtggaagaaggttatgatttactcggtacactgaattggaccgatcatctcccatggctctctgaatttgatcctcaaagaatccggtctagatgctctaatctcgtcccaaaagtaaaccggtttgtgaaccggattatctctgaccaccgtgaacaaactcgtgactcaccgagtgacttcgttgacgtattgctctctctcgatggtcctgataaattatccgaccctgatatcatcgccgttctatgggaaatgatattcagaggaactgacacggtggctgttttgatcgagtggattcttgctaggatggtccttcatccagatattcaatcgacggttcacaatgagcttgatcaaatcgtgggacgatcaagggctgtcgaagagtctgacgtggtgtctctagtatatctaacggctgtggtgaaagaagtcttgaggcttcacccgccaggcccactactctcatgggcccgtttagcaatcacagacacgatcatcgacggtcgtcgtgttccggcggggaccaccgcaatggtgaacatgtgggctattgcacacgatccacacgtgtgggagaatccgttggagtttaaacccgaacgttttgtagccaaggaaggtgaggttgagttctcggttcttgggtctgatttgaggcttgcaccgttcgggtccggtcgtcgggtttgccccgggaagaatcttggtttgaccaccgtgacgttttggactgcgacgcttttgcatgagtttgaatggctgacgccgtccgatgagaagaccgttggcttgtccgagaaactgaggctctcgtgtgagatggctaatcctcttgctgctaaattacgccccaggcgcagttttagtgtatgataagggtaaggctatacacagatacagtggtaactaaagcgaaggaaaattagtgtgaatttaaagcaaaagaataaaataaagaacaaagaaagtaaaggaaacaaaaaaaaagaatcatacaaaaaatactaataagaatggtaatgaagcttttatattaaactaacatcttgatacgtgttgtatatatgatgaaaacattaatgtcacaaagaaaagc

SEQ ID NO: 2 - DNA, 1878 bp, Arabidopsis thaliana
  misc_feature (1)..(1878): Ceres SEEDLINE ID no.ME00919
  misc_feature (1)..(1878): Ceres CLONE ID no.29661
  misc_feature (1)..(1878): Predicted Sequence
  misc_feature (1540)..(1540): k is g or t/u
acagcaaaaagccactctcctttctctctctctcttgttcctctgcatccatggccaccaagctcgacaccagtagcttacttttggccctcttgtccaaatgtagcctccttactcaaaccaatcttgctctctctctcctcgtagcctccctagcttctctcgctctttctctcttcttctggtctcatcccggaggacccgcatggggaaagtacttcctccaccgccgccgtcaaaccaccgtgatacccgggccaagaggcttaccttttgtcggaagcatgtctctcatgtcaaacactctggctcaccgttgcatagccgcaaccgcagagaaatttagagccgaacggttaatggcgtttagtttgggagaaactcgcgtgatcgtcacgtgcaatcctgatgtagctaaagagattctaaacagtccggttttcgctgaccgcccggttaaggaatcagcttattccctcatgtttaaccgtgctatcggtttcgctccttacggcgtttactggcgaaccttgagaaaaatcgcgtctaatcatcttttcagcccgaaacagattaaacgttccgaaacgcagagaagcgtgatcgcgaatcaaatcgtgaagtgtctcacaaaacagagtaacaccaaaggtctctgtttcgcacgtgacttgatcaaaacggcatcgcttaataacatgatgtgctctgttttcggaaaagaatacgagcttgaggaagagcatgaagaagtgagtgagctacgtgaattggtggaagaaggttatgatttactcggtacactgaattggaccgatcatctcccatggctctctgaatttgatcctcaaagaatccggtctagatgctctaatctcgtcccaaaagtaaaccggtttgtgaaccggattatctctgaccaccgtgaacaaactcgtgactcaccgagtgacttcgttgacgtattgctctctctcgatggtcctgataaattatccgaccctgatatcatcgccgttctatgggaaatgatattcagaggaactgacacggtggctgttttgatcgagtggattcttgctaggatggtccttcatccagatattcaatcgacggttcacaatgagcttgatcaaatcgtgggacgatcaagggctgtcgaagagtctgacgtggtgtctctagtatatctaacggctgtggtgaaagaagtcttgaggcttcacccgccaggcccactactctcatgggcccgtttagcaatcacagacacgatcatcgacggtcgtcgtgttccggcggggaccaccgcaatggtgaacatgtgggctattgcacacgatccacacgtgtgggagaatccgttggagtttaaacccgaacgttttgtagccaaggaaggtgaggttgagttctcggttcttgggtctgatttgaggcttgcaccgttcgggtccggtcgtcgggtttgccccgggaagaatcttggtttgaccaccgtgacgttttggactgcgacgcttttgcatgagtttgaatkgctgacgccgtccgatgagaagaccgttgacttgtccgagaaactgaggctctcgtgtgagatggctaatcctcttgctgctaaattacgccccaggcgcagttttagtgtatgataagggtaaggctatacacagatacagtggtaactaaagcgaaggaaaattagtgtgaatttaaagcaaaagaataaaataaagaacaaagaaagtaaaggaaacaaaaaaaaagaatcatacaaaaaatactaataagaatggtaatgaagcttttatattaaactaacatcttgatacgtgttgtatatatgatgaaaacattaatgtcacaaagaaaagc

SEQ ID NO: 3 - protein, 534 aa, Arabidopsis thaliana
  misc_feature (1)..(534): Ceres SEEDLINE ID no.ME00919
  misc_feature (1)..(534): Ceres CLONE ID no.29661
  misc_feature (1)..(534): Bit score of 1310.5 for HMM based on sequences of FIGURE 01.
  misc_feature (67)..(504): Pfam Name: p450 Pfam Description: Cytochrome P450
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWQTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEWLTPSDEKTVGLSEKLRLSCEMANPLAAKLRPRRSFSV

SEQ ID NO: 4 - protein, 553 aa, Pinus radiata
  misc_feature (1)..(553): Public GI ID no.5921925
  misc_feature (1)..(553): Bit score of 1214.4 for HMM based on sequences of FIGURE 01.
  misc_feature (79)..(541): Pfam Name: p450 Pfam Description: Cytochrome P450
  misc_feature (1)..(553): Functional Homolog Of Ceres SEEDLINE ID no. ME00919 at SEQ ID NO: 3
MENRRSSGGSGWWVCVLPLFTKDGPAYFLHSSSDDVSAWRQWPLYIALLIVAVCAVLVSWLSPGGCAWAGRHKRGRVAIPGPKGWPIIGSLMDMSVGLPHRKLESLARLHGAKQLMSFSLGCTPAVITSDPEVARELLTSPHFANRPLKQSAQQLLFGRAIGFAPNGGYWRLLRRIASAHLFAPRRIAAHEAGRQADVVAMLDDIQKEYHSKGVVRVRRHLQGAALNNIMGSVFGRRFDMSHENEEVKKLREMVDEGFQLLGAFNWADHLPWLRPLDPLRIHARCARLVPRVTTFVSNIIEQHRREEQRRESGDQCDFVDVLLSLQGEDKLDEEDMIAVLWEMIFRGTDTTALLTEWTMAELVLHPEAQKKAQAELDAVVGHDRSVKDSDIPKLPYIQAVVKEALRMHPPGPLLSWARLSTEDVNMGDGMCVPAGTTAMVNMWSITHDPNIWESPYEFRPERFVVFEGGEEVDVRGNDLRLAPFGAGRRVCPGKALGLATVNLWVAKLLHHFEWLPHAEHPVDLSEVLKLSCEMARPLHCVPVTRVPFAKFSD

SEQ ID NO: 5 - DNA, 1898 bp, Gossypium hirsutum
  misc_feature (1)..(1898): Ceres CLONE ID no.1929222
  misc_feature (1)..(1898): Encodes the peptide sequence at SEQ ID NO 6
aaaaatcaaaaacccccagttctttttcagtgtgctcttctaggctcttccactttgtttgaataattgcagtacttttataagctaagccacccaacaccaccatgggaagtgacatagagagtgtttggctctttgccctcgcatctaaatgcaaagctttttctcaacagaacactgcatggccaattttgatcatagctttagcttggctggttatgaccatagtgtattgggttcaccctggtggtccagcgtggagcaaatataggttcaaaaagtgtgctatcactaccattaataagccaataccaggaccaagagggttgcctttaatcggtagcatgaacatggtggctaactctttagctcatcatctgattgctaccatagccaaaacatgtaaagccaagagacttatggcttttagccttggtgatacccgtgttatcgttacgtgtaacccggaggtggctaaagagattcttaatagctctgtgtttgctgatcggccggtgaaagaatcggcttatagtttgatgtttaacagagcaattgggtttgctccttatggtgtctattggcgagaactgaggagaattgcggctactcacctgttttgtcctaaacaaataaagaattccgaagaacagagacggttcattgctgatgaaatggtgaacttattcggtcgtcacggccatgaacgaagcttcatcgtacgggaagtggtgaaacgtgcttcgttgaataacatgatggtgtcgatatttggtcggaaatataagttggattgtgataacaatgaagttgatgaacttagaggtttggttgatgaagggtatgatttgttggggacattgaattggtctgatcatttgccatggttagcacaatttgatcctcaaaatatcagggttcgatgctcgaaccttgtacctaaagttaatggctttgtcggtggaatcatagcccaacaccgagctcgaactaacgaggaagctcgtgacttggtcgacgtattgctgtctcttcaaggtgccgataaattatccgattccgacatgatcgccgttctgtgggaaatgatattcaggggaactgatacagtggcagtgttgattgagtggatattggctaggattgtggttcaccctgatgtacagtcaagggttcatgatgagcttgataaggttgttggtaaatcaaaagccgtctatgagtctgacgtgatgaacttgacttatctaatggctgtgatcaaggaggttctaaggttacatccacctggtccgttactatcatgggctcgcttagctattactgatacaaccgttgatgggtatcatgtgccaaaagggaccatggcagtggtgaacatgtgggctatagcaagggacccacaagagtgggcagacccgactgagtttgtgcccgatagattcgtggctaaaacgggtgaggtggagttttccgtactgggttcggatcttaggttggctccattcgggtcgggtaggcgaacatgccccggaaagaacttggggttgaccaccgtcagcttttgggtggcgacccttttgcatgagtttgaatggctaccgtccgatcagaattccgttgacttatcagaagttctaaaactatcttgtgaaatggcaaatcctttgaaggttagaattcgccctaggcgtaagttaacctaagcctatcacaataaagaaatgatcagtacactatcggagaagaatgacataaacaaaatttatctctgcttaaccgttgtactgtaaatacaagtgatggaagtctataatacaaagttcccatgtattaattattactctcttcctttttttttattacataaaatctaacatcttcccaaatttttggac

SEQ ID NO: 6 - protein, 533 aa, Gossypium hirsutum
  misc_feature (1)..(533): Ceres CLONE ID no.1929222
  misc_feature (1)..(533): Bit score of 1331.6 for HMM based on sequences of FIGURE 01.
  misc_feature (69)..(510): Pfam Name: p450 Pfam Description: Cytochrome P450
  misc_feature (1)..(533): Functional Homolog Of Ceres SEEDLINE ID no. ME00919 at SEQ ID NO: 3
MGSDIESVWLFALASKCKAFSQQNTAWPILIIALAWLVMTIVYWVHPGGPAWSKYRFKKCAITTINKPIPGPRGLPLIGSMNMVANSLAHHLIATIAKTCKAKRLMAFSLGDTRVIVTCNPEVAKEILNSSVFADRPVKESAYSLMFNRAIGFAPYGVYWRELRRIAATHLFCPKQIKNSEEQRRFIADEMVNLFGRHGHERSFIVREVVKRASLNNMMVSIFGRKYKLDCDNNEVDELRGLVDEGYDLLGTLNWSDHLPWLAQFDPQNIRVRCSNLVPKVNGFVGGIIAQHRARTNEEARDLVDVLLSLQGADKLSDSDMIAVLWEMIFRGTDTVAVLIEWILARIVVHPDVQSRVHDELDKVVGKSKAVYESDVMNLTYLMAVIKEVLRLHPPGPLLSWARLAITDTTVDGYHVPKGTMAVVNMWAIARDPQEWADPTEFVPDRFVAKTGEVEFSVLGSDLRLAPFGSGRRTCPGKNLGLTTVSFWVATLLHEFEWLPSDQNSVDLSEVLKLSCEMANPLKVRIRPRRKLT

SEQ ID NO: 7 - DNA, 1961 bp, Gossypium hirsutum
  misc_feature (1)..(1961): Ceres CLONE ID no.1920722
  misc_feature (1)..(1961): Encodes the peptide sequence at SEQ ID NO 8
ataaaagccagcatccttgtactccccttgtttcaattcccagaatccagcctccaacgccatgagaagtgagatagagagtgtttgggtgtttgcccttgcatccaaatggcgaaccttttctcaagaaagctttgcatggtcgattttcatcattcttcttgcctggctaatcatgacccttgtctactgggcttaccctggtggcccagcctggggcaagtacaggatcgtgaaccgttcctcacttactgctgctaacaagaggagaattccagggcctagaggtttgcctctaataggcagcatgaagctgatggccagctccttggctcaccaccggattgcggccgcagcagaagcatgcaaagccaagaggctaatggcctttagcctgggtgacactcgtgttatcgtcacgtgcaattcggatgtagcgagagagattctcaacagctctgtgtttgctgataggccggtaaaagagtcggcttatagcttgatgttcaacagagcaatcgggttcgcaccttacggggtttactggcgaaccctgaggagaatcgcggctacgcaccttttctgtcctaagcaaatcagaggtgccgaggaacagagacgccagatcgcctctgaaatggtcaccttatttgctctccataaccaaagcttccacgtccgccaactgctcaaacgagcttctctaaacaacatgatggcttcaatattcggacgaaaatataacttaaattccaccagcaatgaagtcgaacaacttcgagctttggttgaagaaggctacgatttactgggctcattaaattggtccgaccatcttccatggctagccgatttcgaccctcaaaaaatcagagttcgatgctccaaccttgtgcccaaagttaaccgctttgtggcccgaattatatcccaacacagacacaaaacaaactgcgaaacacaagatttcgtcgatgttttactttctcttcaaggtgccgataaaatatcagactccgacatgatcgccgttctgtgggaaatgatattcaggggagctgataccgttgcggtcttgatggagtggatactagcaaggattgtgcttcaccctgatgttcaacaaagggtccatgatgagcttgacgaaattgttggcagatcaagaagagttgatgagtccgatgtaatgaacatgacatacttactggctgtgatcaaggaggtactgaggcttcatccgccgggtccacttctttcttgggctcgtctagctatcactgatacaactattgatgggtatgatgttcccaaagggaccaccgcaatggtgaacatgtgggccatcaccagggaccctcaagagtggccggatcctttggaatttatgccccatagatttgtgactaaagagggtgaagtggagttttctgtgctcggttcggatcttaggctggctccattcgggtcaggcaggcggacatgcccgggaaagaacttaggtttgaccactgtcagcttctgggttgccacccttttgcacgagtttgaatggctaccgtccgatcaaaatactgttgacttatccgagattcttaaactatcctgtgagatggcaaatcctttgagtgttaaaattcgccccagacgtagtgggttaaacctatccctataaggttttactattttctggcattgtcacaattaaaagcaaaatgagattaaaaatgggaattaagcaaagacagaatgattactagtaatagttatatgccaaatctaaaacccgttgtgttggtcgtgtgtcttcgagtgtcagtcaggtttttaatttcatttgttttaaccgttgtaaatatgggtgatgagagtgagaggggtaatacaagttcccagtcttgtaactctcttacttttttttttctctctctttactttataactattatactacttgaaat

SEQ ID NO: 8 - protein, 537 aa, Gossypium hirsutum
  misc_feature (1)..(537): Ceres CLONE ID no.1920722
  misc_feature (1)..(537): Bit score of 1256.4 for HMM based on sequences of FIGURE 01.
  misc_feature (71)..(526): Pfam Name: p450 Pfam Description: Cytochrome P450
  misc_feature (1)..(537): Functional Homolog Of Ceres SEEDLINE ID no. ME00919 at SEQ ID NO: 3
MRSEIESVWVFALASKWRTFSQESFAWSIFIILLAWLIMTLVYWAYPGGPAWGKYRIVNRSSLTAANKRRIPGPRGLPLIGSMKLMASSLAHHRIAAAAEACKAKRLMAFSLGDTRVIVTCNSDVAREILNSSVFADRPVKESAYSLMFNRAIGFAPYGVYWRTLRRIAATHLFCPKQIRGAEEQRRQIASEMVTLFALHNQSFHVRQLLKRASLNNMMASIFGRKYNLNSTSNEVEQLRALVEEGYDLLGSLNWSDHLPWLADFDPQKIRVRCSNLVPKVNRFVARIISQHRHKTNCETQDFVDVLLSLQGADKISDSDMIAVLWEMIFRGADTVAVLMEWILARIVLHPDVQQRVHDELDEIVGRSRRVDESDVMNMTYLLAVIKEVLRLHPPGPLLSWARLAITDTTIDGYDVPKGTTAMVNMWAITRDPQEWPDPLEFMPHRFVTKEGEVEFSVLGSDLRLAPFGSGRRTCPGKNLGLTTVSFWVATLLHEFEWLPSDQNTVDLSEILKLSCEMANPLSVKIRPRRSGLNLSL

SEQ ID NO: 9 - DNA, 1608 bp, Populus balsamifera subsp. trichocarpa
  misc_feature (1)..(1608): Ceres ANNOT ID no.1471370
  misc_feature (1)..(1608): Encodes the peptide sequence at SEQ ID NO 10
atgagaacagacatagatagcttctggatctttgctttggcctccaaatgcagagcctttacacaagaaaatattgcatggtcacttttgatcattggtttagcctggatagttgttaccctgatttactgggcataccctggtggtccagcttggggaaaatataaactcaaaaatacttccttgacaatttctaatccaattccaggtcccaggggattccccattaccggcagcatgaagcttatgacctccttagcacatcacaagattgcagctgctgcagatgcatgcaaagccaggaggctcatggcgtttagccttggtgatactcgtgttatcgtgacatgcaatcctgatgtcgctaaagaaatattgaacagctcggtgtttgcagatcgtccagttaaagaatctgcttatagcctaatgttcaatagagcaatcgggttcgctccttatggtgtctattggcgaacccttagaaaaatagcttctacacaccttttctgccccaagcaaatcaaagctgccgagtctcaaaggctccaaattgcttctcaaatggtgtcaacgttcaatgaccgagaaaagagcagtttcagcgttcgtgaggtccttaaaagagcttcacttaacaacatgatgtgttcagtttttggacgcgaatataaattggattcatttaataatgaagttgaagagctaagagctctagttgaagaggggtacgatttattgggtacacttaactggagtgaccaccttccttggctggcagattttgaccctcaaaaaatccggttcagatgctcaaatctcgtgccaaaagtgaaccggtttgtcagccgaattatagctgaacacagagctctaaccagaagtgaaaacccagatttcgttgatgttttgttgtctctccaaggccacgataaattatcggactccgatatgattgccgtcctttgggaaatgattttcagagggactgatacagtggcggttttgattgagtggattctagcgagaatggtgcttcatcctgatgttcaatcaaaggtccacgatgagctttacaaagttgttggaagatcaagggccgttgctgaatctgatatcacggccatggtgtatctccaggcagtggtgaaggaagtgttgaggctacacccacctggcccacttctctcgtgggccaggctagccatcaccgatacaaccattgatgggtatcacgtgccgaaagggaccacagcaatggttaacatgtgggccatttcaagggacccagagttttgggaggacccacttgaatttatgcccgagagattcgtcgtgactaaggaggatgtgttggagttttctgttctcggctcggatcttaggcttgctccgtttggttccggtaggcggacttgccctggaaagacattgggcataaccacggtgaccttctgggttgcatcactgttacacgagtatgaatgggtgccgggtgaagaaaacaacgttgacctatcagaagtattgcgactgtcctgtgagatggcgaatccattgaccgttaaagtgcggcccaggcgttcctcccaaagccctctgtactag

SEQ ID NO: 10 - protein, 535 aa, Populus balsamifera subsp. trichocarpa
  misc_feature (1)..(535): Ceres ANNOT ID no.1471370
  misc_feature (1)..(535): Bit score of 1370.5 for HMM based on sequences of FIGURE 01.
  misc_feature (68)..(501): Pfam Name: p450 Pfam Description: Cytochrome P450
  misc_feature (1)..(535): Functional Homolog Of Ceres SEEDLINE ID no. ME00919 at SEQ ID NO: 3
MRTDIDSFWIFALASKCRAFTQENIAWSLLIIGLAWIVVTLIYWAYPGGPAWGKYKLKNTSLTISNPIPGPRGFPITGSMKLMTSLAHHKIAAAADACKARRLMAFSLGDTRVIVTCNPDVAKEILNSSVFADRPVKESAYSLMFNRAIGFAPYGVYWRTLRKIASTHLFCPKQIKAAESQRLQIASQMVSTFNDREKSSFSVREVLKRASLNNMMCSVFGREYKLDSFNNEVEELRALVEEGYDLLGTLNWSDHLPWLADFDPQKIRFRCSNLVPKVNRFVSRIIAEHRALTRSENPDFVDVLLSLQGHDKLSDSDMIAVLWEMIFRGTDTVAVLIEWILARMVLHPDVQSKVHDELYKVVGRSRAVAESDITAMVYLQAVVKEVLRLHPPGPLLSWARLAITDTTIDGYHVPKGTTAMVNMWAISRDPEFWEDPLEFMPERFVVTKEDVLEFSVLGSDLRLAPFGSGRRTCPGKTLGITTVTFWVASLLHEYEWVPGEENNVDLSEVLRLSCEMANPLTVKVRPRRSSQSPLY

SEQ ID NO: 11 - DNA, 1635 bp, Populus balsamifera subsp. trichocarpa
  misc_feature (1)..(1635): Ceres ANNOT ID no.1444471
  misc_feature (1)..(1635): Encodes the peptide sequence at SEQ ID NO 12
atgagaacagacatagataacttctggatctttgctttggcctccaaatgcagagtctttacacaagaaaatattgcatggtcgcttttgatcatgggtttagcttggatagccactacccttatttactgggcataccctggtggtcctgcttggggcaaatacaaactcaaaaacacttccttcacaatttctaagccaattccaggtcccaggggattgcctcttataggcggcatgaggcttatgacctccttagcacatcacaagattgcagcggctgcagatgcatgcaaagccaggaggctcatggcgtttagccttggtgatactcgtgttatcgtgacatgcaatcctgatgtggctaaagaaatactgaacagttcggtgtttgcagatcgtccagttaaagaatctgcttatagcctaatgttcaatagagcaattgggttcgctccttatggtgtttactggcgaacccttagaaaaatagcttctacacaccttttctgccccaaacaaatcaaaactgcggcgtctcaaagacgccgaattgcttctgaaacggtgtccatgttcaatgaccatgaagggagtggtttcaccgttcgtgggatactcaagagagcttcacttaataacatgatgtgctcagtttttggacgcgagtatgaattggattcatgtaatagtgaagttgaagaactgagagctctagttgatgaagggtacgatttattgggtacacttaactggaccgaccaccttccttggctggcggattttgaccctcaaaaaatccgattcagatgctcaaatctcgtgccaaaagtgaaccggtttgtcagccgaatcctggctgagcatagagctcaagctggaaatgaaaccccggatttcgttgatgttttgctgtctcttcaaggccacgataaattatcggactccgatatgattgccgtcctttgggaaatgattttcaggggcactgatacggtggcagttttgatggagtggattctagctagaatggtacttcatcctgatgttttatcaaaggtccatgatgagcttgacaaagttgttggaagatcaagggccgtagctgaatctgatatcacggcaatggtgtatctccaggcagcagtgaaggaagtgttgaggctacacccacctggtccacttctctcgtgggccaggcttgccatcactgatacaaccatagatgggtatcacgtgcctaaagggaccacagcaatggttaacatgtgggccatttcaagggacccagattcttgggaggacccgcttgaatttatgcctgagagattcgtgactaagaagggtgagctggagttttctgttcttgggtcggatctaaggcttgctccgtttggttccggtaggcgaacctgcccgggaaagacattgggcttaactacggtgaccttttgggttgcgtcactactacacgagtatgaatggctgccgtgcgatggaaataaagttgacctatcagaagtactgggtctgtcctgtgagatggcaaatccattgaccgttaaactgcggcccaggcgttcccattataagcccactgtactaggtgtacagaactacgtactagatgtctag

SEQ ID NO: 12 - protein, 544 aa, Populus balsamifera subsp. trichocarpa
  misc_feature (1)..(544): Ceres ANNOT ID no.1444471
  misc_feature (1)..(544): Bit score of 1321.4 for HMM based on sequences of FIGURE 01.
  misc_feature (108)..(523): Pfam Name: p450 Pfam Description: Cytochrome P450
  misc_feature (1)..(544): Functional Homolog Of Ceres SEEDLINE ID no. ME00919 at SEQ ID NO: 3
MRTDIDNFWIFALASKCRVFTQENIAWSLLIMGLAWIATTLIYWAYPGGPAWGKYKLKNTSFTISKPIPGPRGLPLIGGMRLMTSLAHHKIAAAADACKARRLMAFSLGDTRVIVTCNPDVAKEILNSSVFADRPVKESAYSLMFNRAIGFAPYGVYWRTLRKIASTHLFCPKQIKTAASQRRRIASETVSMFNDHEGSGFTVRGILKRASLNNMMCSVFGREYELDSCNSEVEELRALVDEGYDLLGTLNWTDHLPWLADFDPQKIRFRCSNLVPKVNRFVSRILAEHRAQAGNETPDFVDVLLSLQGHDKLSDSDMIAVLWEMIFRGTDTVAVLMEWILARMVLHPDVLSKVHDELDKVVGRSRAVAESDITAMVYLQAAVKEVLRLHPPGPLLSWARLAITDTTIDGYHVPKGTTAMVNMWAISRDPDSWEDPLEFMPERFVTKKGELEFSVLGSDLRLAPFGSGRRTCPGKTLGLTTVTFWVASLLHEYEWLPCDGNKVDLSEVLGLSCEMANPLTVKLRPRRSHYKPTVLGVQNYVLDV

SEQ ID NO: 13 - DNA, 1599 bp, Populus balsamifera subsp. trichocarpa
  misc_feature (1)..(1599): Ceres ANNOT ID no.1491278
  misc_feature (1)..(1599): Encodes the peptide sequence at SEQ ID NO 14
atggaaacacaaatagacagcttttgggtattggtccttgtttccaaatgcaaagccttttctgctcaaaaccccatcttccttcttgtttctgttttcctggcctggctagccatggctttgtgttactgggtgtaccctggaggccctgcctggggtaattatttgcgcaagaaaggaattagctgttcaagagccaagatgattccagggcctagagggtttccagtgataggaagcatgaacctcatggttaacttggctcaccacaagcttgctgctgcagcgaaggcttttaaagcagaaagacttatggcttttagcttgggagagactaaggtcattatcacatgcaatcctgatgtagccaaagaaatcttgaacagttcagtctttgctgatcgtccagttaaagagtctgcctatcaactcatgtttaatagagctattggttttgctccttatggggtttactggagaactctaaggagaattgcagcaactcatcttttttgtcctaaacaaatcagctctactgagtcgcaaagattcaatattgcttctcaaatggtatccgcaatagcaagtcaaggtggagattacttttgtgttcgaggcatactaaagaaagcttcactcaacaacatgatgtgctcagtttttggtcgtaaatatgatctgggctcatcaaatagtgaaactgaagagcttagaaggcttgttgatgaaggttatgatcttctagggaaacttaattggtctgatcatcttccttggcttgcaaatttagaccttcaaagaatcaggtttaggtgctccaatttggttcctaaagtgaaccggtttgtgaaccgggttattgaagaacatagagaggaccagactggccaaagaagaaatgactttgtcgatgttttactctctcttcatggaccggacaagttatcacaccatgatatgattgccgttctctgggagatgatttttagaggaacagataccgtggcagttttgatagagtggatactagcaaggatggtacttcaccgtgatatccaatcaaaggtgcatgatgagctcgatcaagttgtgggaagatcaaggccgttgatggaagcagacattcagtcaatggtttacctgcctgcagttgtgaaagaagttctgaggttgcacccaccaggcccactactgtcgtgggcccgtttagcaatcacggacactaatgtggatggatatgatgttccagcagggaccacagctatggttaatatgtgggccataacaagggacccacaagtttgggcgaaccctctaaggttcttgccagagagatttttgtgcaaggatgctactgctgacgtggaattctctgtgtccgggtctgaccttaagctggctccgtttgggtcgggtcggaggacttgcccgggaaaggctctgggtttggccacggttagcttttgggtcggggttttgttgcacgagttcgagtgggtgcaatgtgatcatgagccggtggatctctcagaagtgctaaggttatcttgtgagatgtctaacccacttacaatcaaagtgaatccaaggagaagatga

SEQ ID NO: 14 - protein, 532 aa, Populus balsamifera subsp. trichocarpa
  misc_feature (1)..(532): Ceres ANNOT ID no.1491278
  misc_feature (1)..(532): Bit score of 1199.3 for HMM based on sequences of FIGURE 01.
  misc_feature (69)..(529): Pfam Name: p450 Pfam Description: Cytochrome P450
  misc_feature (1)..(532): Functional Homolog Of Ceres SEEDLINE ID no. ME00919 at SEQ ID NO: 3
METQIDSFWVLVLVSKCKAFSAQNPIFLLVSVFLAWLAMALCYWVYPGGPAWGNYLRKKGISCSRAKMIPGPRGFPVIGSMNLMVNLAHHKLAAAAKAFKAERLMAFSLGETKVIITCNPDVAKEILNSSVFADRPVKESAYQLMFNRAIGFAPYGVYWRTLRRIAATHLFCPKQISSTESQRFNIASQMVSAIASQGGDYFCVRGILKKASLNNMMCSVFGRKYDLGSSNSETEELRRLVDEGYDLLGKLNWSDHLPWLANLDLQRIRFRCSNLVPKVNRFVNRVIEEHREDQTGQRRNDFVDVLLSLHGPDKLSHHDMIAVLWEMIFRGTDTVAVLIEWILARMVLHRDIQSKVHDELDQVVGRSRPLMEADIQSMVYLPAVVKEVLRLHPPGPLLSWARLAITDTNVDGYDVPAGTTAMVNMWAITRDPQVWANPLRFLPERFLCKDATADVEFSVSGSDLKLAPFGSGRRTCPGKALGLATVSFWVGVLLHEFEWVQCDHEPVDLSEVLRLSCEMSNPLTIKVNPRRR

SEQ ID NO: 15 - DNA, 1596 bp, Populus balsamifera subsp. trichocarpa
  misc_feature (1)..(1596): Ceres ANNOT ID no.1447690
  misc_feature (1)..(1596): Encodes the peptide sequence at SEQ ID NO 16
atggaaacacaaatagacagcttttgggtattggctctagtttccaaatgcaaagccttttcctctcaagaccccatcttccttcttctttctcttttcttggcttggctagccattgctttgtgctactgggtttaccctggaggccccgcctggggcaaatattggctcaaaagagcaacctgctcgaaagccaagatgattccgggacctagagggtttccagtgataggaagcatgaacctcatggtaaacttggctcaccacaagcttgctgctgcagccaagactcttaaagcaaaaagactcatggcttttagcatgggagagactagggttattatcacatgcaatcctgatgtagccaaagacatcttgaacagttcagtatttgctgatcgtccagttaaagagtctgcctatcagctcatgtttaatagagctattggttttgctccctatggggtttattggagaactctaaggagaattgcagcaacccatcttctttgtcctaaacaaatcagctctacagagccacagagactcgatattgcttctcaaatggtatcagtaatggcatgtcaaggtggagattactttcgtgttcgagacatactgaggaaagcttcactgaacaacatgatgtgctcagtttttggtcgtaaatatgatctaggcacatcaaataatgaaattgaggaacttggaggacttgttgatgaaggttatgatcttctagggaagcttaactggtctgatcatctaccttggcttgcaaatttcgaccttcaaaaaatcaggttcaggtgctccaatttggttcctaaagtgaaccggtttgtgaaccgggttattcaagaacatagagaggaccaaagtggccaaagaagaaatgactttgttgatgttctgctctctcttcatggaccggacaagttatcagaccatgacatggttgctgttctttgggagatgatttttagaggaacagatacagtggcagttctgatagagtggatactagccaggatgatacttcaccctgatatccaatcaaaggtgcatgatgagcttgatcaagttgcgggaagatcaaggccgttgatggaagcagacatacgatcaatggtttacctgccggcggttgtgaaagaggttctaaggttacacccaccggggccactcttgtcatgggcgcgtttagcaatcacggacactgatgttgatggatatgatgtgccagcggggaccacagctatggttaatatgtgggccataacaagggacccgcaagtttgggtggacccactaaagttctcgccagagagatttttgagcaaggaagtcactgctgacgtggagttctctgtgtcagggtctgacctcaggctggctccattcgggtcgggtcgtaggacttgcccgggaaggacactgggtttggccaccgttagcttctgggttgggagtttgttgcatgagtttgagtgggcgcggtgtggccatgagccggtggacctctctgaagtgttgaggttgtcttgtgaaatggccaaaccactcacagtcaaggtgaatccgaggagaagataa

SEQ ID NO: 16 - protein, 531 aa, Populus balsamifera subsp. trichocarpa
  misc_feature (1)..(531): Ceres ANNOT ID no.1447690
  misc_feature (1)..(531): Bit score of 1212.1 for HMM based on sequences of FIGURE 01.
  misc_feature (68)..(498): Pfam Name: p450 Pfam Description: Cytochrome P450
  misc_feature (1)..(531): Functional Homolog Of Ceres SEEDLINE ID no. ME00919 at SEQ ID NO: 3
METQIDSFWVLALVSKCKAFSSQDPIFLLLSLFLAWLAIALCYWVYPGGPAWGKYWLKRATCSKAKMIPGPRGFPVIGSMNLMVNLAHHKLAAAAKTLKAKRLMAFSMGETRVIITCNPDVAKDILNSSVFADRPVKESAYQLMFNRAIGFAPYGVYWRTLRRIAATHLLCPKQISSTEPQRLDIASQMVSVMACQGGDYFRVRDILRKASLNNMMCSVFGRKYDLGTSNNEIEELGGLVDEGYDLLGKLNWSDHLPWLANFDLQKIRFRCSNLVPKVNRFVNRVIQEHREDQSGQRRNDFVDVLLSLHGPDKLSDHDMVAVLWEMIFRGTDTVAVLIEWILARMILHPDIQSKVHDELDQVAGRSRPLMEADIRSMVYLPAVVKEVLRLHPPGPLLSWARLAITDTDVDGYDVPAGTTAMVNMWAITRDPQVWVDPLKFSPERFLSKEVTADVEFSVSGSDLRLAPFGSGRRTCPGRTLGLATVSFWVGSLLHEFEWARCGHEPVDLSEVLRLSCEMAKPLTVKVNPRRR

SEQ ID NO: 17 - protein, 534 aa, Arabidopsis thaliana
  misc_feature (1)..(534): Public GI ID no.15228624
  misc_feature (1)..(534): Bit score of 1315.9 for HMM based on sequences of FIGURE 01.
  misc_feature (67)..(528): Pfam Name: p450 Pfam Description: Cytochrome P450
  misc_feature (1)..(534): Functional Homolog Of Ceres SEEDLINE ID no. ME00919 at SEQ ID NO: 3
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEWLTPSDEKTVDLSEKLRLSCEMANPLAAKLRPRRSFSV

SEQ ID NO: 18 - DNA, 1872 bp, Arabidopsis thaliana
  misc_feature (1)..(1872): Ceres CLONE ID no.29661
  misc_feature (1)..(1872): Encodes the peptide sequence at SEQ ID NO 19
acagcaaaaagccactctcctttctctctctctcttgttcctctgcatccatggccaccaagctcgacaccagtagcttacttttggccctcttgtccaaatgtagcctccttactcaaaccaatcttgctctctctctcctcgtagcctccctagcttctctcgctctttctctcttcttctggtctcatcccggaggacccgcatggggaaagtacttcctccaccgccgccgtcaaaccaccgtgatacccgggccaagaggcttaccttttgtcggaagcatgtctctcatgtcaaacactctggctcaccgttgcatagccgcaaccgcagagaaatttagagccgaacggttaatggcgtttagtttgggagaaactcgcgtgatcgtcacgtgcaatcctgatgtagctaaagagattctaaacagtccggttttcgctgaccgcccggttaaggaatcagcttattccctcatgtttaaccgtgctatcggtttcgctccttacggcgtttactggcgaaccttgagaaaaatcgcgtctaatcatcttttcagcccgaaacagattaaacgttccgaaacgcagagaagcgtgatcgcgaatcaaatcgtgaagtgtctcacaaaacagagtaacaccaaaggtctctgtttcgcacgtgacttgatcaaaacggcatcgcttaataacatgatgtgctctgttttcggaaaagaatacgagcttgaggaagagcatgaagaagtgagtgagctacgtgaattggtggaagaaggttatgatttactcggtacactgaattggaccgatcatctcccatggctctctgaatttgatcctcaaagaatccggtctagatgctctaatctcgtcccaaaagtaaaccggtttgtgaaccggattatctctgaccaccgtgaacaaactcgtgactcaccgagtgacttcgttgacgtattgctctctctcgatggtcctgataaattatccgaccctgatatcatcgccgttctatgggaaatgatattcagaggaactgacacggtggctgttttgatcgagtggattcttgctaggatggtccttcatccagatattcaatcgacggttcacaatgagcttgatcaaatcgtgggacgatcaagggctgtcgaagagtctgacgtggtgtctctagtatatctaacggctgtggtgaaagaagtcttgaggcttcacccgccaggcccactactctcatgggcccgtttagcaatcacagacacgatcatcgacggtcgtcgtgttccggcggggaccaccgcaatggtgaacatgtgggctattgcacacgatccacacgtgtgggagaatccgttggagtttaaacccgaacgttttgtagccaaggaaggtgaggttgagttctcggttcttgggtctgatttgaggcttgcaccgttcgggtccggtcgtcgggtttgccccgggaagaatcttggtttgaccaccgtgacgttttggactgcgacgcttttgcatgagtttgaatggctgacgccgtccgatgagaagaccgttgacttgtccgagaaactgaggctctcgtgtgagatggctaatcctcttgctgctaaattacgccccaggcgcagttttagtgtatgataagggtaaggctatacacagatacagtggtaactaaagcgaaggaaaattagtgtgaatttaaagcaaaagaataaaataaagaacaaagaaagtaaaggaaacaaaaaaaaagaatcatacaaaaaatactaataagaatggtaatgaagcttttatattaaactaacatcttgatacgtgttgtatatatgatgaaaacattaatgtcacaaag

SEQ ID NO: 19 - protein, 534 aa, Arabidopsis thaliana
  misc_feature (1)..(534): Ceres CLONE ID no.29661
  misc_feature (1)..(534): Expected Sequence
  misc_feature (1)..(534): Bit score of 1308.4 for HMM based on sequences of FIGURE 01.
  misc_feature (67)..(528): Pfam Name: p450 Pfam Description: Cytochrome P450
  misc_feature (1)..(534): Functional Homolog Of Ceres SEEDLINE ID no. ME00919 at SEQ ID NO: 3
  misc_feature (497)..(497): Xaa is any aa, unknown or other
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEXLTPSDEKTVDLSEKLRLSCEMANPLAAKLRPRRSFSV

SEQ ID NO: 20 - protein, 530 aa, Arabidopsis thaliana
  misc_feature (1)..(530): Public GI ID no.15226422
  misc_feature (1)..(530): Bit score of 1209.6 for HMM based on sequences of FIGURE 01.
  misc_feature (71)..(527): Pfam Name: p450 Pfam Description: Cytochrome P450
  misc_feature (1)..(530): Functional Homolog Of Ceres SEEDLINE ID no. ME00919 at SEQ ID NO: 3
MATKLESSLIFALLSKCSVLSQTNLAFSLLAVTIIWLAISLFLWTYPGGPAWGKYLFGRLISGSYKTGNVIPGPKGFPLVGSMSLMSSTLAHRRIADAAEKFGAKRLMAFSLGETRVIVTCNPDVAKEILNSPVFADRPVKESAYSLMFNRAIGFAPHGVYWRTLRRIASNHLFSTKQIRRAETQRRVISSQMVEFLEKQSSNEPCFVRELLKTASLNNMMCSVFGQEYELEKNHVELREMVEEGYDLLGTLNWTDHLPWLSEFDPQRLRSRCSTLVPKVNRFVSRIISEHRNQTGDLPRDFVDVLLSLHGSDKLSDPDIIAVLWEMIFRGTDTVAVLIEWILARMVLHPDMQSTVQNELDQVVGKSRALDESDLASLPYLTAVVKEVLRLHPPGPLLSWARLAITDTIVDGRLVPAGTTAMVNMWAVSHDPHVWVDPLEFKPERFVAKEGEVEFSVLGSDLRLAPFGSGRRICPGKNLGFTTVMFWTAMMLHEFEWGPSDGNGVDLSEKLRLSCEMANPLPAKLRRRRS

SEQ ID NO: 21 - protein, 511 aa, Brassica napus
  misc_feature (1)..(511): Public GI ID no.84380741
  misc_feature (1)..(511): Bit score of 1053.7 for HMM based on sequences of FIGURE 01.
  misc_feature (30)..(496): Pfam Name: p450 Pfam Description: Cytochrome P450
  misc_feature (1)..(511): Functional Homolog Of Ceres SEEDLINE ID no. ME00919 at SEQ ID NO: 3
MTNLYLTILLPTFIFLIVLVLSRRRNNRLPPGPNPWPIIGNLPHMGPKPHQTLAAMVTTYGPILHLRLGFADVVVAASKSVAEQFLKVHDANFASRPPNSGAKHMAYNYQDLVFAPYGQRWRMLRKISSVHLFSAKALEDFKHVRQEEVGTLMRELARANTKPVNLGQLVNMCVLNALGREMIGRRLFGADADHKAEEFRSMVTEMMALAGVFNIGDFVPALDCLDLQGVAGKMKRLHKRFDAFLSSILEEHEAMKNGQDQKHTDMLSTLISLKGTDFDGEGGTLTDTEIKALLLNMFTAGTDTSASTVDWAIAELIRHPEIMRKAQEELDSVVGRGRPINESDLSQLPYLQAVIKENFRLHPPTPLSLPHIASESCEINGYHIPKGSTLLTNIWAIARDPDQWSDPLTFRPERFLPGGEKAGVDVKGNDFELIPFGAGRRICAGLSLGLRTIQLLTATLVHGFEWELAGGVTPEKLNMEETYGITLQRAVPLVVHPKLRLDMSAYGLGSA

SEQ ID NO: 22 - protein, 523 aa, Glycine max
  misc_feature (1)..(523): Public GI ID no.5921926
  misc_feature (1)..(523): Bit score of 1300.4 for HMM based on sequences of FIGURE 01.
  misc_feature (63)..(518): Pfam Name: p450 Pfam Description: Cytochrome P450
  misc_feature (1)..(523): Functional Homolog Of Ceres SEEDLINE ID no. ME00919 at SEQ ID NO: 3
MTSHIDDNLWIIALTSKCTQENLAWVLLIMGSLWLTMTFYYWSHPGGPAWGKYYTYSPPLSIIPGPKGFPLIGSMGLMTSLAHHRIAAAAATCRAKRLMAFSLGDTRVIVTCHPDVAKEILNSSVFADRPVKESAYSLMFNRAIGFASYGVYWRSLRRIASNHLFCPRQIKASELQRSQIAAQMVHILNNKRHRSLRVRQVLKKASLSNMMCSVFGQEYKLHDPNSGMEDLGILVDQGYDLLGLFNWADHLPFLAHFDAQNIRFRCSNLVPMVNRFVGTIIAEHRASKTETNRDFVDVLLSLPEPDQLSDSDMIAVLWEMIFRGTDTVAVLIEWILARMALHPHVQSKVQEELDAVVGKARAVAEDDVAVMTYLPAVVKEVLRLHPPGPLLSWARLSINDTTIDGYHVPAGTTAMVNTWAICRDPHVWKDPLEFMPERFVTAGGDAEFSILGSDPRLAPFGSGRRACPGKTLGWATVNFWVASLLHEFEWVPSDEKGVDLTEVLKLSSEMANPLTVKVRPRRG

SEQ ID NO: 23 - DNA, 1851 bp, Glycine max
  misc_feature (1)..(1851): Ceres CLONE ID no.624225
  misc_feature (1)..(1851): Encodes the peptide sequence at SEQ ID NO 24
aacataagataaccaataaccgtttatgattttacttcccataccaatccctcgagtgtttctccctatatatattcctcaaaccaacctctcccttactcacaactcacaagtctagtcccttcttcctctatctctttggctattagcaaacactctcatatttggttgttctagttctcactaccatgtcaacccacattgaaagcctgtgggtgttggccttagcctcaaaatgcattcaagagaacattgcatggtcactcttgatcatcatggtcactctctggctcaccatgaccttcttctactggtctcaccctggtggtcctgcttggggcaaatactactactttaattactggaaaaaaaccacctcaaccaacacaaacatcaaccttaaaatgattatccctggtcctagaggctaccctttcattgggagtatgagtctcatgacatccctcgcacaccaccgtattgctgcggcgggggaagcatgcaacgccaccaggctcatggctttttccatgggtgacacacgcgccatagtaacgtgcaaccccgatgtcgctaaagagattctcaatagttccacttttgctgatcgtcccataaaggaatcagcttacagcctcatgttcaaccgcgccatcggcttcgccccttacggcgtctactggcgtaccctccgccgcatcgccgccacgcacctcttctgccccaaacaaatcaaagcctccgagctccagcgcgctgaaatcgccgcccaaatgacaaactcattccgaaatcaccgttgcagcggcggtttcggaatccgcagcgtgctcaagagagcgtcactgaacaacatgatgtggtcggtgtttggacaaaagtacaaccttgacgagataaacaccgcaatggacgagctatccatgttggtggaacaaggctatgacttgttgggcacccttaattggggagaccatatccctttcctgaaagactttgacctacagaaaatccggttcacctgctccaaattagtccctcaagtgaaccggttcgttggttcaatcatcgccgaccaccaggccgacacaacccaaaccaaccgcgatttcgttcatgttttgctctctctccaaggtcccgataaattgtctcactccgacatgattgctgtcctctgggaaatgatatttagggggaccgacacggtggcggttttgattgagtggatactggcgaggatggtgcttcatccggaggtgcaaaggaaggtacaagaggagttggacgcggtggttaggggtggcgctttgacggaggaggtcgtggcggcgacggcgtatcttgcggcggtggtgaaagaggttctgaggctgcacccgccgggcccgcttctctcgtgggcccgcttggccatcactgatacgaccattgatgggtatcacgtgcctgcggggaccaccgctatggttaatatgtgggccatagcaagggacccggaggtgtggctggacccacttgagttcaagcccgagaggttcatgggtctggaaaacgagttttctgttttcgggtcggatctgagactcgctccattcggttcgggtcggagaacatgccccgggaagactttgggtttgagcaccgtaaccttctgggtggcttggcttttgcatgagtttgaatggctaccgtctgatgaagccaaggttgatctaacggaggtgctgaggctctcgtgtgaaatggctaacccactcattgttaaagttcgccctaggcatggattaagcacttaatgataatataattaagcctatctacgttattaacttgaaatgttttaatggg

SEQ ID NO: 24 - protein, 536 aa, Glycine max
  misc_feature (1)..(536): Ceres CLONE ID no.624225
  misc_feature (1)..(536): Bit score of 1209.2 for HMM based on sequences of FIGURE 01.
  misc_feature (115)..(528): Pfam Name: p450 Pfam Description: Cytochrome P450
  misc_feature (1)..(536): Functional Homolog Of Ceres SEEDLINE ID no. ME00919 at SEQ ID NO: 3
MSTHIESLWVLALASKCIQENIAWSLLIIMVTLWLTMTFFYWSHPGGPAWGKYYYFNYWKKTTSTNTNINLKMIIPGPRGYPFIGSMSLMTSLAHHRIAAAGEACNATRLMAFSMGDTRAIVTCNPDVAKEILNSSTFADRPIKESAYSLMFNRAIGFAPYGVYWRTLRRIAATHLFCPKQIKASELQRAEIAAQMTNSFRNHRCSGGFGIRSVLKRASLNNMMWSVFGQKYNLDEINTAMDELSMLVEQGYDLLGTLNWGDHIPFLKDFDLQKIRFTCSKLVPQVNRFVGSIIADHQADTTQTNRDFVHVLLSLQGPDKLSHSDMIAVLWEMIFRGTDTVAVLIEWILARMVLHPEVQRKVQEELDAVVRGGALTEEVVAATAYLAAVVKEVLRLHPPGPLLSWARLAITDTTIDGYHVPAGTTAMVNMWAIARDPEVWLDPLEFKPERFMGLENEFSVFGSDLRLAPFGSGRRTCPGKTLGLSTVTFWVAWLLHEFEWLPSDEAKVDLTEVLRLSCEMANPLIVKVRPRHGLST

SEQ ID NO: 25 - protein, 546 aa, Medicago truncatula
  misc_feature (1)..(546): Public GI ID no.84514161
  misc_feature (1)..(546): Bit score of 1309.0 for HMM based on sequences of FIGURE 01.
  misc_feature (85)..(526): Pfam Name: p450 Pfam Description: Cytochrome P450
  misc_feature (1)..(546): Functional Homolog Of Ceres SEEDLINE ID no. ME00919 at SEQ ID NO: 3
MSTNIDNLWIFALASKCTQENIAYSLLIMALLWITMTFFYWSHPGGPAWGKYYYSSNYSTTKTNNKNNLNSSTKPSTTTSSSIFIPGPKGYPLFGSMNLMSSSLAHHRIASTAKTCKATRLMAFSLGDTRAMVTCNPDVAKEILHSSVFADRPIKESAYSLMFNRAIGFAPYGVYWRTLRKISTNHLFSPMQIKSSGPQRSEIATQMIDLFRNRHLHGGFCVRDVLKKASLNNMMCSVFGQRFKIDEVNERMMELSGLVEQGYDLLGGLNWGDHLPFLKDFDVQKIRFSCSELVPKVNRFVGSIISDHRADKNQTNKDFVHVLLSLQEPDKLSDSDMIAVLWEMIFRGTDTVAVLIEWILARLVIHPDVQKKVQTELDEVASGESCAITEEDVAAMVYLPAVIKEVLRLHPPGPLLSWARLAITDTTIDGYHVPAGTTAMVNMWAISRDPDVWRNPLEFNPERFVSEGAEFSVLGSDLRLAPFGSGRRSCPGKNLGLATVTFWVAKLLHEFEWLPLDEVNGVDLTEVLRLSCEMANPLTVQVRPRR

SEQ ID NO: 26 - DNA, 2109 bp, Triticum aestivum
  misc_feature (1)..(2109): Ceres CLONE ID no.779234
  misc_feature (1)..(2109): Encodes the peptide sequence at SEQ ID NO 27
aaaactcaaactgcacttgactttccagctgcgaacaacaaatccgtcctttcatttcgcctcctagtgttcttcccattcggcctcagcgcgagaacgagggaaaaggtacgtgcacgtacgttgacatggctccatccgagaagtgcggctggctgctgtacgtttccctcgccgccaaatgctgcggcaacggcgacggcaagccttaccgcgtggtaggctttgttgtcgttctcctcgccgccttcgtcgtcacgtcgctcctgcactgggcgtctcagggtggtgcggcgtgggggaggtattggtggaggaggaagggtctgggcattggcgaggcccgtatcccggggccacggggcttccccgtgatcggcagcatgggcctcatgaccggcctcgcgcaccggaagctcgcggcggcggcggcgggaaacgtcaggcgccggcggctcatgtcgttctccatgggagagaccagggtggtggtgaccgccgaccctgacgtggcgagagagctgctggctagcccggcgttcgccgaccggccggtcaaggagtccgcctacgggcttatgttccatcgcgccatcgggttcgccccctacggcgcctactggcgcacgctccgccgggtgtcgtcctcgcacctcttctcgccgcggcaggtggccgcctccgccgcgcagcgcgcagtgatcgcgcaccagatggtggatgccatgaggcccgtgggcggcgctggcgtcaagcacgtcgaggcgcggcggttcctgaaacgcgcgtcgctgcacaacgtgatgtggtccgttttcggccggaggtacgagctggacgaggcggggagcggggaggccgcggagctgaagagcctggtcgacgaaggctacgacctgctcggccagctcaattggtccgaccacctcccgtggctcgcgcgcttcgacctgcagaagatccggtccaggtgctccgccctcgtcccccgcgtgaaccgcttcgtcggcaggatcatcgacgagcaccgtgccgccctgaacgacgacgacgacgccgtggtagacttcaccgacgtcctgctctccctccaaggaagcgacaagctctccgacgccgacatgatcgccgtcctctgggagatgatctttcgtggcaccgacaccgtggcagtggtgatcgaatgggtgctggcccggctgatgctgcaccaagacgtgcaggcgagggtccacgaggagctggaccgggtggtcgggccgaaccgggccgtgaccgagtcggacgccgcctcgctcgtctttctccaggccgtagtcaaggaggtcctgcgccttcacccaccgggcccactgctgtcgtgggcgcggcttgccacgtctgacgtccacgtagatgggttacatgttcccgcggggaccactgccatggtcaacatgtgggccataacccacgacccaaccgtgtgggtcaagccggcggagttcaagccagaacggttcctcggcgggtcatcgtcggaccacgctgccgccggcgctgagttctctgtaacgggttccgatctcaggctcgcgccgttcgggtcgggcaggcggagctgccccggcaagtcgctcgcgatcgccaccgttggattctgggttgccacgctgctgcacgagttcgagtggacgccgccgtcgtccgacgggtcaggtggcgtggacctgtctgaggtgctgaggctgtcgtgtgagatggcagctccgctggaggcaaggctgaggccgaggcgtgctgtgtgatgacgtggctgggccatgcgggcagggtagacgttggcctcctcttcttctttactactcctactactatcagtgcgtgtagtgtagtggtaatgtagtgtcccgctttggaaatgtacctgctactaaaataggtccggtcctggtacgtgtactgctgtcctttactgttattagcagggtagatgtttaattacgtagttatgaactactatcaggaagtgagtgtgacagttttcttgtgcttccggtttgctgcctagagatgtactacaagttcctatgtaaaaatatttattttaatgcaagtatcagttgtgtt

SEQ ID NO: 27 - protein, 552 aa, Triticum aestivum
  misc_feature (1)..(552): Ceres CLONE ID no.779234
  misc_feature (1)..(552): Bit score of 1305.3 for HMM based on sequences of FIGURE 01.
  misc_feature (110)..(519): Pfam Name: p450 Pfam Description: Cytochrome P450
  misc_feature (1)..(552): Functional Homolog Of Ceres SEEDLINE ID no. ME00919 at SEQ ID NO: 3
MAPSEKCGWLLYVSLAAKCCGNGDGKPYRVVGFVVVLLAAFVVTSLLHWASQGGAAWGRYWWRRKGLGIGEARIPGPRGFPVIGSMGLMTGLAHRKLAAAAAGNVRRRRLMSFSMGETRVVVTADPDVARELLASPAFADRPVKESAYGLMFHRAIGFAPYGAYWRTLRRVSSSHLFSPRQVAASAAQRAVIAHQMVDAMRPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGSGGVDLSEVLRLSCEMAAPLEARLRPRRAV

SEQ ID NO: 28 - DNA, 2078 bp, Zea mays
  misc_feature (1)..(2078): Ceres CLONE ID no.1600726
  misc_feature (1)..(2078): Encodes the peptide sequence at SEQ ID NO 29
aaagacttgaacaaggccgcctccggtcttcccacttccacacgagaaggaaacgaccacctcctttcctgtgtcccgaatcgggagtagtagtagtagtgcatccaatcgacacacacacaaaaaaaaaggttagttagccatggcgccgccaacagaggactgcggctggctgctgtacctttccctggccgccaaatgcggcgaccctcagcgcctgctcggcttcgccgcggtcttcgtcgcggcctgcgtagtcacgtcgctcctgcactgggcgtccccgggcggccccgcctgggggtggtactggtggaccaggcgggccgggctgggcatcgtccgtgccgccatcccgggaccccggggcctgccggtggtcggcagcatgggcctgatgaccggcctggcgcaccgcaagctctcggcggcggccgagagacaggccagcaggcgccgcctcatggcgttctcgcttggcgagacccgggtggtggtcaccgccgacctcgacgtcgcgcgggagctgctcgccagcgccgccttcgccgaccgccccgtcaaggagtccgcgtacgggctcctgttccaccgcgccatcggcttcgccccgcacggcgcctactggcgcgcgctccggcgcgtcgcgtccgcgcacctcttctcgccgcgccagatcgcggcctccgcggcgcagcgcgcggccatcgcgcgccagatggtggacgccacgacgaccgccgcggcccacgcccccgtcgtcgtggcgcgccggttcctgaagcgcgcgtcgctgcacaacgtcatgtggtcggtgttcggccgcaggtacgacctgatggcggacagccgggaggccgaggagctcaaggccctggtagacgaaggctacgacctgcttgggcagctcaactggtccgaccacctcccgtggctcgcccgcttcgacctgcagaagacccgggccaggtgctgcgcgctcgtcccgcgggtgaaccgcttcgttggcaacatcatcggcgagcaccgtgcccgcctgggccgcggcggcgacaccgccgtcatggacttcacggacgtcctgctctccctccagggcgacgacaagctctccgacgccgacatgatcgccgttctgtgggagatgatcttccgaggcacggacacggtggcagtcctgatcgagtgggtgctggcccgtctggtgctgcaccaggacgtgcagagcaaggtccaggaggagctggaccgggtggtcgggctgggccaggccgtgacggagtcggacacggcctcgctgccctacctccaggcggtcatcaaggaagtgctacgcctgcacccgccaggcccactgctctcctgggcgcgcctcgccacctcagacgtgtacgtaagcgggtaccttgtgcccgcgggcaccaccgccatggtgaacatgtgggccataacccatgaccccagcctgtggcctgagccgatggagttcaggcccgagaggttcatgggccctgccgcagaggacgtcccgataatgggttcggatctccggctcgcgcctttcgggtccggcaggcggagctgccccggcaagtcactcgcggtggctaccgtcggattctgggtcgccaccctgctgtacgagttcaaatggctgccgccgtccgacgagccacgcggcggcggcgtcgacctatccgaagtgctgaggctgtcgtgtgagatggctgcaccgctggaggcgagggtggtgccacgtcacgcggtgtgctgagggggctgagacacgtggcctgcaggggtggggatcagaggaggaaagctcgaccgatcgtcttctagcttctactactacgtactccctccgtctcaggatataaggcgtaaccactttttattcttgtcccacaatataaggcgtgctctctctatgcatacgtacatcgatgcagtggtatagagacaattaaatgcatttcttggtctttgaatcagaggtggttacgccttatatactgagacggagggagtaataccttaccttgtagcagaacgtaacgtggtcgatatgagatgtg

SEQ ID NO: 29 - protein, 543 aa, Zea mays
  misc_feature (1)..(543): Ceres CLONE ID no.1600726
  misc_feature (1)..(543): Bit score of 1288.2 for HMM based on sequences of FIGURE 01.
  misc_feature (71)..(511): Pfam Name: p450 Pfam Description: Cytochrome P450
  misc_feature (1)..(543): Functional Homolog Of Ceres SEEDLINE ID no. ME00919 at SEQ ID NO: 3
MAPPTEDCGWLLYLSLAAKCGDPQRLLGFAAVFVAACVVTSLLHWASPGGPAWGWYWWTRRAGLGIVRAAIPGPRGLPVVGSMGLMTGLAHRKLSAAAERQASRRRLMAFSLGETRVVVTADLDVARELLASAAFADRPVKESAYGLLFHRAIGFAPHGAYWRALRRVASAHLFSPRQIAASAAQRAAIARQMVDATTTAAAHAPVVVARRFLKRASLHNVMWSVFGRRYDLMADSREAEELKALVDEGYDLLGQLNWSDHLPWLARFDLQKTRARCCALVPRVNRFVGNIIGEHRARLGRGGDTAVMDFTDVLLSLQGDDKLSDADMIAVLWEMIFRGTDTVAVLIEWVLARLVLHQDVQSKVQEELDRVVGLGQAVTESDTASLPYLQAVIKEVLRLHPPGPLLSWARLATSDVYVSGYLVPAGTTAMVNMWAITHDPSLWPEPMEFRPERFMGPAAEDVPIMGSDLRLAPFGSGRRSCPGKSLAVATVGFWVATLLYEFKWLPPSDEPRGGGVDLSEVLRLSCEMAAPLEARVVPRHAVC

SEQ ID NO: 30 - DNA, 1962 bp, Zea mays
  misc_feature (1)..(1962): Ceres CLONE ID no.1551657
  misc_feature (1)..(1962): Encodes the peptide sequence at SEQ ID NO 31
aaaccctccgcaccggctcctcgccgcagctataaatacacgggtccgccatttccagtcctccaagacttgaaccacgcaaccctctctggtcgtcccactttcttccacaccagaaggaaacttgagtcgcgcgcgagcagtagtgcatccaatccaatccacaaagaggttagtcagccatggcggcaccgccgaccgaggactgcggctggctgctgtacctctccctggccgccaaatgcggcgaccctagccgcctgctcggcttggcggcggtcttcgtcgccgcctgcgtcgtaacgtcgctcctgcactgggcgtgcccgggcggccccgcctgggggcggtactggtggaccaggcgaggcgggctgggcatcgtccgcgccgccatcccgggaccccggggcctgccggtggtcggcagcatggggctgatgaccggcctggcgcaccgcaagctcgcggcggcggccgtgagtcagggcagcagcaggcgccgccgtctgatggcgctctccctcggcgagacccgggcggtggtgaccggcgacccggacgtcgcgagggagctgctcggcagcgccgccttcgccgaccgccccgtcaaggagtccgcgtacgggctcctcttccaccgcgccatcggcttcgccccgcacggcgcctactggcgcgcgctccgccgcgtggcgtcggcgcacctcttctcgccgcgccaggtcgcggcctcctccgcgcagcgcgcggtcatcgcgcgccagatggtggacgccgtgaccacgaccacgaccacgaccgcccccgccgtcgtggtggcgcgccggttcctgaagcgcgcgtcgctgcacaacgtcatgtggtcggtgttcgggcgcaggtacgacctgctgctggctgcggacggcgaggagctgaaggcgttggtggacgaaggctacgacctcctcgggcagctgaactggtccgaccacctcccgtggctggcccgcttcgacctgcaaaggacccgggccagatgctccgcgctcgttccgcgggtgaaccgcttcgttggcaacatcatcgacgagcaccgtgcgcgcctcggcgacaccggcgtcacggacttcaccgacgtcctgctctccctccagggcgtcgacaagctctccgacgccgacatggtcgccgttctctgggagatgatcttccgaggcacggacacggtggccgtcctaatggagtgggtgctggcgcgtctcgtgctgcaccaggacgtgcagagcaaggtccaggaggagctggaccgggtggtcgggccaccgggccaggccgcatccgtgacggagtcggacaccgcctcgctcgtctacctccaggcggtcatcaaggaagtgctgcgcctgcacccgccaggcccgctgctctcctgggcgcgcctggccacgtcggacgcgcgcgtaggcgggtaccacgtgcccgcgggcacaaccgccatggtgaacatgtgggccataacgcatgaccccagcgtgtgggccgagccgacggagttcaggcccgagaggtttgtgggcgcccctgctggtgctggtgccgaggacgttcccatgataatgggctcggatctccggctcgcgcccttcgggtccggcaggcggagctgccccggcaagtcgctcgcgctggctaccgtcgggttctgggtggccaccctgctccacgagttcaaatggttgccgccgtgccgcggcgtcgacctgtccgaggtgctgaggctgtcgtgtgagatggctgcaccgctggaggcgagggtggtgccacgtcacgcggtgtgagatgacgaggatgagacacgtggcctggggaggaggagttgcccgatcgtctgtctagatatatcttatcttagctttccttaccttgtagcagagaacgtaacgtggcccggcggcgatggatgagaatgagatgtgt

SEQ ID NO: 31 - protein, 546 aa, Zea mays
  misc_feature (1)..(546): Ceres CLONE ID no.1551657
  misc_feature (1)..(546): Bit score of 1217.3 for HMM based on sequences of FIGURE 01.
  misc_feature (113)..(516): Pfam Name: p450 Pfam Description: Cytochrome P450
  misc_feature (1)..(546): Functional Homolog Of Ceres SEEDLINE ID no. ME00919 at SEQ ID NO: 3
MAAPPTEDCGWLLYLSLAAKCGDPSRLLGLAAVFVAACVVTSLLHWACPGGPAWGRYWWTRRGGLGIVRAAIPGPRGLPVVGSMGLMTGLAHRKLAAAAVSQGSSRRRRLMALSLGETRAVVTGDPDVARELLGSAAFADRPVKESAYGLLFHRAIGFAPHGAYWRALRRVASAHLFSPRQVAASSAQRAVIARQMVDAVTTTTTTTAPAVVVARRFLKRASLHNVMWSVFGRRYDLLLAADGEELKALVDEGYDLLGQLNWSDHLPWLARFDLQRTRARCSALVPRVNRFVGNIIDEHRARLGDTGVTDFTDVLLSLQGVDKLSDADMVAVLWEMIFRGTDTVAVLMEWVLARLVLHQDVQSKVQEELDRVVGPPGQAASVTESDTASLVYLQAVIKEVLRLHPPGPLLSWARLATSDARVGGYHVPAGTTAMVNMWAITHDPSVWAEPTEFRPERFVGAPAGAGAEDVPMIMGSDLRLAPFGSGRRSCPGKSLALATVGFWVATLLHEFKWLPPCRGVDLSEVLRLSCEMAAPLEARVVPRHAV

SEQ ID NO: 32 - DNA, 2026 bp, Zea mays
  misc_feature (1)..(2026): Ceres CLONE ID no.1601442
  misc_feature (1)..(2026): Encodes the peptide sequence at SEQ ID NO 33
gacttgaaccacgcaaccctctctggtctctggtcgtcctactttcttccacagcagaaggaaacttgagtcgtgagcgcagtggtgcatccaatccacaaagagctgaggttagtcagccatggcggcaccgccgaccgaggactgcggctggctgctgtacctctccctggccgccaaatgcggcgaccctagccgcctgctcggcttggcggcggtcttcgtcggcgcctgcgtcgtaacgtcgctcctgcactgggcgtgcccgggcggccccgcctgggggcggtactggtggaccaggcgaggcgggctgggcatcgtccgcgccgccatcccgggaccccggggcctgccagtggtcggcagcatggggctgatgaccggcctggcgcaccgcaagctcgcggcggcggcggcggcggccgggggtcagggcagcagcaggcgccgccgtctcatggcgctctccctcggcgagacccgggcggtggtgaccggcgacccggacgtcgcgagggagctgctcggcagcgccgccttcgccgaccgccccgtcaaggagtccgcgtacgggctcctcttccaccgcgccatcggcttcgccccgcacggcgcctactggcgcgcgctccgccgcgtggcgtcggcgcacctcttctcgccgcgccaggtcgcggcctcctccgcgcagcgcgcggtcatcgcgcgccagatggtggacgccgtgaccacggccgcccccgcccccgcccccgccgtcgtggtggcgcgccggttcctgaagcgcgcgtcgctgcacaacgtcatgtggtcggtgttcgggcgcaggtacgacctgctgctgctggcggcggacggcgaggagctgaaggcgctggtggacgaaggctacgacctcctcgggcagctgaactggtccgaccacctcccgtggctggcccgcttcgacctgcagaggacccgggccaggtgctccgcgctcgtcccgcgggtgaaccgcttcgttggcaacatcatcgacgagcaccgtgcgcgcctcggcctcggcgacaccggcggcgtcacggacttcaccgacgtcctgctctccctccagggcgtcgacaagctctccgacgccgacatggtcgccgttctctgggagatgatcttccgaggcacggacacggtggccgtcctaatggagtgggtgctggcgcgtctcgtgctgcaccaggacgtgcagagcaaggtccaggaggagctggaccgggtggtggggccaccgggccaggccgcatccgtgacggagtcggacaccgcctcgctcgtctacctccaggcggtcatcaaggaagtgctgcgcctgcacccgccaggcccgctgctctcctgggcgcgcctggccacgtcggacgcgcgcgtaggcgggtaccacgtgcccgcgggcaccaccgccatggtgaacatgtgggccataacgcatgaccccagcgtgtgggccgagccgacggagttcaggcccgagaggttcgtgggcgcctctgctggtgctggtgctggtgctggtgccgaggacgttccgatgataatgggctcggatctccggctcgcgcccttcgggtccggcaggcggagctgccccggcaagtcgctcgcgctggctaccgtcgggttctgggtggccaccctgctccacgagttcaaatggttgccgccgtgccgcggcgtcgacctgtccgaggtgctgaggctgtcgtgtgagatggctgcaccgctggaggcgagggtggttccacgtcacgcggtgtgagatgacgaggatgagacacgtggcctggggataggagaagttgcccgatcgtctgtctagattgtactgtactatatatcttatcttagctttccttaccttgtagcagagaacgtaacgtggcccggcggcgatggatgatgagaatgagatgtgtaaaagaagaaaaagagcatgcccgagtgccatatgctttagagtggactgtgtatatatgatgatgctattgct

SEQ ID NO: 33 - protein, 557 aa, Zea mays
  misc_feature (1)..(557): Ceres CLONE ID no.1601442
  misc_feature (1)..(557): Bit score of 1208.6 for HMM based on sequences of FIGURE 01.
  misc_feature (116)..(527): Pfam Name: p450 Pfam Description: Cytochrome P450
  misc_feature (1)..(557): Functional Homolog Of Ceres SEEDLINE ID no. ME00919 at SEQ ID NO: 3
MAAPPTEDCGWLLYLSLAAKCGDPSRLLGLAAVFVGACVVTSLLHWACPGGPAWGRYWWTRRGGLGIVRAAIPGPRGLPVVGSMGLMTGLAHRKLAAAAAAAGGQGSSRRRRLMALSLGETRAVVTGDPDVARELLGSAAFADRPVKESAYGLLFHRAIGFAPHGAYWRALRRVASAHLFSPRQVAASSAQRAVIARQMVDAVTTAAPAPAPAVVVARRFLKRASLHNVMWSVFGRRYDLLLLAADGEELKALVDEGYDLLGQLNWSDHLPWLARFDLQRTRARCSALVPRVNRFVGNIIDEHRARLGLGDTGGVTDFTDVLLSLQGVDKLSDADMVAVLWEMIFRGTDTVAVLMEWVLARLVLHQDVQSKVQEELDRVVGPPGQAASVTESDTASLVYLQAVIKEVLRLHPPGPLLSWARLATSDARVGGYHVPAGTTAMVNMWAITHDPSVWAEPTEFRPERFVGASAGAGAGAGAEDVPMIMGSDLRLAPFGSGRRSCPGKSLALATVGFWVATLLHEFKWLPPCRGVDLSEVLRLSCEMAAPLEARVVPRHAV

SEQ ID NO: 34 - DNA, 1953 bp, Zea mays
  misc_feature (1)..(1953): Ceres CLONE ID no.1593072
  misc_feature (1)..(1953): Encodes the peptide sequence at SEQ ID NO 35
aaaaaaaaaaaaaacagcacaaacgcaacgcgacgcaccaagctctgagagtcgcaatggagagatcagctgagagctggtgggtgcttcccatgaccttgatcccggccatctccggcgagcaacacggtaacatggctaccgtagccactagcttcgcctacctcgccatcttcgcgtgcctcgcatgggtgggcgcgtccctgctctactgggctcacccaggcggccctgcgtggggcaagtactggagggcgagggggaagaagccgtcggcggcgatcccagggcctaaggggctcccggtggtcggcagcctcggcctcatgtccgggctggcgcaccgctcgctggccgacgaggcgtcgcgccgcccgggggccaagcggctcatggcgctgtcgctcggccccgtccgcgcggtcgtcacgtcccacccggacgtggccaaggagatcctcgacagcccggcgttcgccgcccgccccctgaaccacgccgcgtacggcctcatgttccaccgctccatcggcttcgccgagcacggcccgtactggcgcgcgctccggcgcgtcgccgcgggccacctgttcggcccgaggcaggtcgaagccttcgcgccgtaccgcgcggccgtcgccgagggcatcgtcgcggccctgatgcgcgccggctccggcggcgccgtcgtccaggtgcgcggcctcctgcggcgggcgtcgctctactacatcatgcggttcgtgttcggcaaggagtacgacgtgtcacgcgtgttgccgccgtccggcggggaggaggtggagaagctgctcgagatggtgcacgaggggtacgagctcctgggcatggagaacctgtgcgactacttcccggggctcgccgccctcgacccgcagggcgtgggcacacgatgcgccgagctcatgccgcgggtgaaccggttcgtgcacggcgtcatccaggagcaccgtgccaaggcggtcgccggtggagacgcgcgtgacttcgtcgacatcttgctctccctgcaggagagtgaggggctcgccgacgccgacatagcctctgtgctctgggagatgatcttcagaggaacggacgccatggcggtgctcatggagtggaccctagctcgcctcgtcctccaccgcgacgtccaagccaaggcgcaccgtgagctcgacaaggtcgtcggcgcggacagccagaccaccgagtccgcggcgccgtacctgcaggcgttgctaaaggaggctctccggatgcacccgccggggcccctcctgtcgtggcgccacagggccatatccgacacgtacgtcgacggccacctcgtcccggcgggcaccacggccatggtgaaccagtgggccatcagccgcgaccccgaggtgtgggacgcgccgctcgagttccggcccgagcggttcctccccggcggcgagggccaggacgtgtccgtgctcggcgccgacggccgcctcgtgccgttcgggtccggcaggaggagctgccccggaaagtccctggccatgaccaccgtgacctcctggatggccacgctgctgcacgagttcgagtggctgccagcgtcagacgacacaggcgacgtcgacttctcggaggtgctccgtctgtcctgcgagatggcagtgccgctggaggtccgcgtgcgcccgaggagcagcgtgtgaatgaagtgctgcctgccgatagccatgacacacgccccattgtgcaatgtgtagcagtgagcctaagcgttctgttagtgaactgtgaataagcagctggtgaggactgtgcacaccagctcagctcagcctttggttcagggtttcaacttgccagtgtatatcgtatatttagtgtgaccgtgagtattaagttatccgcaaaaggtgtacaaatcacaaaagctatcgaatgaagattgtgtgaagtggtgtc

SEQ ID NO: 35 - protein, 546 aa, Zea mays
  misc_feature (1)..(546): Ceres CLONE ID no.1593072
  misc_feature (1)..(546): Bit score of 926.3 for HMM based on sequences of FIGURE 01.
  misc_feature (76)..(536): Pfam Name: p450 Pfam Description: Cytochrome P450
  misc_feature (1)..(546): Functional Homolog Of Ceres SEEDLINE ID no. ME00919 at SEQ ID NO: 3
MERSAESWWVLPMTLIPAISGEQHGNMATVATSFAYLAIFACLAWVGASLLYWAHPGGPAWGKYWRARGKKPSAAIPGPKGLPVVGSLGLMSGLAHRSLADEASRRPGAKRLMALSLGPVRAVVTSHPDVAKEILDSPAFAARPLNHAAYGLMFHRSIGFAEHGPYWRALRRVAAGHLFGPRQVEAFAPYRAAVAEGIVAALMRAGSGGAVVQVRGLLRRASLYYIMRFVFGKEYDVSRVLPPSGGEEVEKLLEMVHEGYELLGMENLCDYFPGLAALDPQGVGTRCAELMPRVNRFVHGVIQEHRAKAVAGGDARDFVDILLSLQESEGLADADIASVLWEMIFRGTDAMAVLMEWTLARLVLHRDVQAKAHRELDKVVGADSQTTESAAPYLQALLKEALRMHPPGPLLSWRHRAISDTYVDGHLVPAGTTAMVNQWAISRDPEVWDAPLEFRPERFLPGGEGQDVSVLGADGRLVPFGSGRRSCPGKSLAMTTVTSWMATLLHEFEWLPASDDTGDVDFSEVLRLSCEMAVPLEVRVRPRSSV

SEQ ID NO: 36 - protein, 509 aa, Vitis vinifera
  misc_feature (1)..(509): Public GI ID no.78183420
  misc_feature (1)..(509): Bit score of 1058.3 for HMM based on sequences of FIGURE 01.
  misc_feature (29)..(474): Pfam Name: p450 Pfam Description: Cytochrome P450
  misc_feature (1)..(509): Functional Homolog Of Ceres SEEDLINE ID no. ME00919 at SEQ ID NO: 3
MNPLALIFCTALFCILLYHFLTRRSVRLPPGPKPWPIVGNLPHLGPVPHHSIAALAKTYGPLMHLRMGFVDVVVAASASVAAQFLKTHDANFSNRPPNSGAKHIAYNYQDLVFAPYGPRWRMLRKICSVHLFSGQALDDFRHIRQEEVLALMRALAREGQTPVKLGQLLNVCTTNALGRVMLGRRVFGDGSGGEDPKADEFKEMVVELMVLAGVFNIGDFVPALEWLDLQGVASKMKKLHARFDAFLGAIVEEHKISGSAGSERHVDLLSTLISLKDNADGEGGKLTDVEIKALLLNLFTAGTDTSSSTVEWAIAELIRHPEMMAQAQQELDAVVGRGRLVTDLDLPKLTYLQAIVKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKLNMDEAYGLTLQRAAPLMVHPRPRLSPQVFGK

SEQ ID NO: 37 - DNA, 2130 bp, Panicum virgatum
  misc_feature (1)..(2130): Ceres CLONE ID no.1877346
  misc_feature (1)..(2130): Encodes the peptide sequence at SEQ ID NO 38
gactccaaccagcagaccgatcgagctcgctcgccttttgagaagaacaaacgcgtcctctctggtcttcttcccacttcgttccacaatcaccctatccacacgtacgtacgtacgagaaggagcacccgtgtcgtgactcgtgagccgccggtgcgacgacgtacgacacacccatggcgccgtccgaggactgcggctggctgctgtacctctccctggccgccaaatgcggcgacccccaccgcctgctcggcttcgccgcggtcttggccaccgccttcgtcgtcacggcgctgctgcactgggcgtcccccggcggccccgcgtggggccggtactggtggaccaggagggccggcctgggcattggcgccgccatcccggggccccgcgggctgccggtgctcggcagcatggggctcatgacgggcctggcgcaccggaagctcgcggcggcggctggcaaggcccggcgccgcctcatggccttctccctcggcgagacccgcgtcgtggtgaccgccgacccggacgtggcgcgggagctcctcgccagcgccaccttcgccgaccgccccgtgaaggagtccgcgtacgggctcctcttccaccgcgccatcggcttcgccccgcacggcgcctactggcgcgcgctccgccgcgtcgcgtccgcgcacctcttctcgccgcgccagatcgccgcctccgccgcgcagcgcgcggtgatcgcgcgccagatggtggacgccatgatgatggagcagggcgccgccgctccaggagtcgtgacggcgcggcggttcctgaagcgcgcgtcgctgcacagcgtgatgtggtcggtgttcgggcggaggtacgagctgctgcaggcggcggacggcggcgaggaggcggcggagctccagagcctggtggaccagggctacgacctcctcgggcagctcaactggtccgaccacctcccctggctcgcccgcttcgacctgcagaggacccgggccaggtgcgccgccctcgtcccccgggtcaaccgcttcgtcggccgcatcatcgacgagcaccgcgccgcccgcctccacctcggcggcgacggcgccgccgccgtcgtggacttcaccgacgtcctgctctccctgcagggcagcgacaggctctccgacgccgacatgatcgccgttctctgggagatgatctttcgaggcacggacacggtggcggttctgatggagtgggtgctggcccggctggtgctgcaccaggacgtgcagcgcagggtccaggaggagctggaccgggtggtcgggccggggcgggccgtgaccgagccggacggcgcctcgctcgcctacctccacgcggtcatcagggaggtgctgcgcctgcacccgccgggcccgctgctctcctgggcacgcctcgccacgtcggacgtccacgtcggcgggtacctcgtacccgcggggaccaccgccatggtgaacatgtgggccatcacccacgacccggccgtctggcccgacccggccgagttcaaacccgagaggttcgcggccggctcgccgggcgacgaggcgttcccggtgatgggctcggatctcaggctggcgcctttcgggtccggccggcgggtctgccccggcaagtcgctggcgatggccaccgtcgcgttctgggtcgccaccctcctgcacgagttcgagtggctgccggcgtcgtccgacgagccgccgcgtggcgtcgacctgtccgaggtgctgaggctgtcgtgcgagatggccgctccgctggaggcgaggctggtgccacgtcgcgcggtgtgatgacgtggcgccgatccaagtggcagtgggagtaccttctagtagtagagtaacataattaacgcgtgcacggtgggctgtgtaaaaaaaaatgtaaagtgtccatgctagtgctgctagtgtgccatgcatcaagccggtttgcttatgtgtgtacctgtaaacctgctatgtacctgcatgtataatagtatctgaaagtaagttaatgtaggtggagggtcggtagtgtacctgctgcatatatagaccttgagtgagacagccatatatatttatatatatcttttgcctagagctactagcc

SEQ ID NO: 38 - protein, 548 aa, Panicum virgatum
  misc_feature (1)..(548): Ceres CLONE ID no.1877346
  misc_feature (1)..(548): Bit score of 1270.0 for HMM based on sequences of FIGURE 01.
  misc_feature (69)..(519): Pfam Name: p450 Pfam Description: Cytochrome P450
  misc_feature (1)..(548): Functional Homolog Of Ceres SEEDLINE ID no. ME00919 at SEQ ID NO: 3
MAPSEDCGWLLYLSLAAKCGDPHRLLGFAAVLATAFVVTALLHWASPGGPAWGRYWWTRRAGLGIGAAIPGPRGLPVLGSMGLMTGLAHRKLAAAAGKARRRLMAFSLGETRVVVTADPDVARELLASATFADRPVKESAYGLLFHRAIGFAPHGAYWRALRRVASAHLFSPRQIAASAAQRAVIARQMVDAMMMEQGAAAPGVVTARRFLKRASLHSVMWSVFGRRYELLQAADGGEEAAELQSLVDQGYDLLGQLNWSDHLPWLARFDLQRTRARCAALVPRVNRFVGRIIDEHRAARLHLGGDGAAAVVDFTDVLLSLQGSDRLSDADMIAVLWEMIFRGTDTVAVLMEWVLARLVLHQDVQRRVQEELDRVVGPGRAVTEPDGASLAYLHAVIREVLRLHPPGPLLSWARLATSDVHVGGYLVPAGTTAMVNMWAITHDPAVWPDPAEFKPERFAAGSPGDEAFPVMGSDLRLAPFGSGRRVCPGKSLAMATVAFWVATLLHEFEWLPASSDEPPRGVDLSEVLRLSCEMAAPLEARLVPRRAV

SEQ ID NO: 39 - protein, 552 aa, Oryza sativa subsp. indica
  misc_feature (1)..(552): Public GI ID no.125562440
  misc_feature (1)..(552): Bit score of 1301.6 for HMM based on sequences of FIGURE 01.
  misc_feature (113)..(519): Pfam Name: p450 Pfam Description: Cytochrome P450
  misc_feature (1)..(552): Functional Homolog Of Ceres SEEDLINE ID no. ME00919 at SEQ ID NO: 3
MDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLQKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQAAEFPIMGSDLRLAPFGSGRRSCPGKSLAIATVGFWVATLLHEFDWLPLSDKSRGVDLSEVLKLSCEMATPLEARLRPRRKVMSV

SEQ ID NO: 40 - protein, 551 aa, Oryza sativa subsp. japonica
  misc_feature (1)..(551): Public GI ID no.115477665
  misc_feature (1)..(551): Bit score of 1297.0 for HMM based on sequences of FIGURE 01.
  misc_feature (115)..(521): Pfam Name: p450 Pfam Description: Cytochrome P450
  misc_feature (1)..(551): Functional Homolog Of Ceres SEEDLINE ID no. ME00919 at SEQ ID NO: 3
MDMDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKV

SEQ ID NO: 41 - protein, 553 aa, Oryza sativa subsp. japonica
  misc_feature (1)..(553): Public GI ID no.115480289
  misc_feature (1)..(553): Bit score of 1165.9 for HMM based on sequences of FIGURE 01.
  misc_feature (78)..(522): Pfam Name: p450 Pfam Description: Cytochrome P450
  misc_feature (1)..(553): Functional Homolog Of Ceres SEEDLINE ID no. ME00919 at SEQ ID NO: 3
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLMTGLAHRKLAAAAEAAGAGRLMALSLGETRVVVAAHPDVAREILHGAAFADRPVKESAYGLLFHRAIGFAPHGAYWRALRRVASTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 42 - protein, 536 aa, Oryza sativa subsp. japonica
  misc_feature (1)..(536): Public GI ID no.125604232
  misc_feature (1)..(536): Bit score of 1139.7 for HMM based on sequences of FIGURE 01.
  misc_feature (175)..(502): Pfam Name: p450 Pfam Description: Cytochrome P450
  misc_feature (1)..(536): Functional Homolog Of Ceres SEEDLINE ID no. ME00919 at SEQ ID NO: 3
MDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFANWPGEGVRVRDAVPPRHRHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKVMSVE

SEQ ID NO: 43 - protein, 515 aa, Oryza sativa subsp. japonica
  misc_feature (1)..(515): Public GI ID no.115450563
  misc_feature (1)..(515): Bit score of 915.4 for HMM based on sequences of FIGURE 01.
  misc_feature (47)..(487): Pfam Name: p450 Pfam Description: Cytochrome P450
  misc_feature (1)..(515): Functional Homolog Of Ceres SEEDLINE ID no. ME00919 at SEQ ID NO: 3
MATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPYWRALRRVAAGHLFGPRQVDAFAPYRARVAGGVVAALRGAGGEAAVQVRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 44 - protein, 553 aa, Oryza sativa subsp. japonica
  misc_feature (1)..(553): Public GI ID no.125606403
  misc_feature (1)..(553): Bit score of 979.1 for HMM based on sequences of FIGURE 01.
  misc_feature (216)..(522): Pfam Name: p450 Pfam Description: Cytochrome P450
  misc_feature (1)..(553): Functional Homolog Of Ceres SEEDLINE ID no. ME00919 at SEQ ID NO: 3
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLMTGLAHRKLAAAAEAAGAGRLMALSLGETRVVVAAHPGRGEGDPARRGVRRPPREGVRVRAAVPPRHRVRAPRRVLARAAAGGVTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 45 - protein, 516 aa, Oryza sativa subsp. japonica
  misc_feature (1)..(516): Public GI ID no.125584822
  misc_feature (1)..(516): Bit score of 807.6 for HMM based on sequences of FIGURE 01.
  misc_feature (197)..(488): Pfam Name: p450 Pfam Description: Cytochrome P450
  misc_feature (1)..(516): Functional Homolog Of Ceres SEEDLINE ID no. ME00919 at SEQ ID NO: 3
MATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPVLARAPARRRGPPCSARGRWTRSPRTARASRGAWSPRCAARPGKPAFQLRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 46 - protein, 426 aa, Phalaenopsis sp. SM9108
  misc_feature (1)..(426): Public GI ID no.1173624
  misc_feature (1)..(426): Bit score of 867.8 for HMM based on sequences of FIGURE 01.
  misc_feature (8)..(420): Pfam Name: p450 Pfam Description: Cytochrome P450
  misc_feature (1)..(426): Functional Homolog Of Ceres SEEDLINE ID no. ME00919 at SEQ ID NO: 3
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 47 - protein, 510 aa, Trifolium pratense
  misc_feature (1)..(510): Public GI ID no.84468276
  misc_feature (1)..(510): Bit score of 1050.1 for HMM based on sequences of FIGURE 01.
  misc_feature (32)..(471): Pfam Name: p450 Pfam Description: Cytochrome P450
  misc_feature (1)..(510): Functional Homolog Of Ceres SEEDLINE ID no. ME00919 at SEQ ID NO: 3
MSLWIIVFVTIVAAILINRLLNLIKKPTLPLPPGPSPWPIVGNLPHMGPVPHHALAALALKHGPLMHLQLGFVDVIVAASASVAEQFLKVHDANFSSRPPNSGAKYIAYNYQDLVFAPYGPRWRLLRKISYVHMFSSKALDDFRHIRQDEVARLIRNLSNSGSKAANLGQMLNVCTTNALARVMIGRRVFNEGNGGCECDPRADEFKSMVVELMVLAGVFNIGDFVPSLEWLDIQGVQSKMKKLHKRFDSFLTSIIEDHMVSKSEKHNDLLSTLLSLKEKVDEDGDKLNDTEIKALLLNMFTAGTDTSSSTTEWAIAELIKNPKLMIRIQNELDTVVGRDRLVTEQDLTHLPYLEAVIKETFRLHPSTPLSLPRVATNSCEIFNYHIPKGATLLVNVWAISRDPKEWTNPLEFKPERFLPGGEKFDVDIRGNDFEVIPFGAGRRICAGMSLGLRMVQLLTATLAHAYDWELENGLSPEKLNMDEAYGLTLQRAVPILAHPRPRLSPHLYL

SEQ ID NO: 48 - DNA, 870 bp, Arabidopsis thaliana
  misc_feature (1)..(870): Ceres SEEDLINE ID no.ME01312
  misc_feature (1)..(870): Ceres CLONE ID no.251343
  misc_feature (1)..(870): Encodes the peptide sequence at SEQ ID NO. 49
gacatacccagttggaaaaattcaatcttttatccctaagattcgatctttcttcttgggaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtctcggaggaggagggatcatgcttgacgggtcgggttgggatcatccgggtatgggtttgggtttgaggagaaccgaaccgggtaataataataataacccatggaccgatctggctatgaacagagcggagaaaaactgaagaagaaaagaagagaggggtattttggtaaattacagcaaactgattttgggtgacttgagccatcacgtagacactgaacagtttcgatcatgtttatgtcattttggtaatattattattattcctccc

SEQ ID NO: 49 - protein, 204 aa, Arabidopsis thaliana
  misc_feature (1)..(204): Ceres SEEDLINE ID no.ME01312
  misc_feature (1)..(204): Ceres CLONE ID no.251343
  misc_feature (1)..(204): Bit score of 394.2 for HMM based on sequences of FIGURE 02.
  misc_feature (24)..(86): Pfam Name: zf-Dof Pfam Description: Dof domain, zinc finger
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 50 - DNA, 1354 bp, Gossypium hirsutum
  misc_feature (1)..(1354): Ceres CLONE ID no.1869410
  misc_feature (1)..(1354): Encodes the peptide sequence at SEQ ID NO 51
acacatagatgttcagcctcttcttcttacagggttttcagactgcaaatatcttctaagtattggaatccttgatgttgaaaaaaacaaaaccagctttgacaaattttaggttgctgtttgtctcctctatatctaatttcaagtttccttgattcaaaactgaaagctacaactctttcttttggttgtttagaattgatttttgtaaaaggcttcatatttcttattattatcttcgtcttccagttccaatatatttgtgtgaaaacagaaaagaagaagaagaaaataaccttccttttttgtcttgtttcaaagtttaaccaaccacccttttcgccacttcacaaactttatcagcttttcaattccttgaagaagaagaaaaaagcctcaaaattcaacccaaattctccatagaaacgaaactttatcttcaaattcaatcaagcagtgagggtttgaggtgtggagtatttaaaatgcaagacccaacgggctttcaccaaatgaaagcgccggcttttcaagagcaagagcagcagcagctgaaatgcccccgctgtgactcaaccaacaccaaattctgttactacaacaactataacttgtctcagccccgccatttctgcaagaactgccgccgttactggactaaaggcggcgccctccgtaacatacccgtcggtggcggcacccgtaagggcaccaaacgctcctcctcctccaccaacaaacctaagcgccaacccaacccctctccagaccccaccccaaaccaaaaaatccctgatccctctccgccgccgccgaaatcatcatcatcatcgatgtttccccagcagattgttttgaactcgggggctcagaattcggactcggatatcgactcgacccggatgtatctgttgccggttgatcatcaagatgggaagatgatggatatcggcgggagcttcagctcgctgttggcttcgactgggcagtttggaaacctcctagaagggtttaattcaaatgggtcgggtttaaaaacgctgaatcattttggagggaatttcgattcgggttgtgaaatggatcagaattcgggtcgggacccgctattcggagagagcagtaaaaacggagagagttatttggatgtacagggcggtagggatacaagttgttggagtggcgatagcaatggctggccagatctttctatttacactccaggttcaagtttacggagatagaaattacattcgcctattttaaaattttataaataaattaaatctttattgtactcacacatagattttcatatttaatttgtgcaccaataaaaagtttactatttcag

SEQ ID NO: 51 - protein, 252 aa, Gossypium hirsutum
  misc_feature (1)..(252): Ceres CLONE ID no.1869410
  misc_feature (1)..(252): Bit score of 455.7 for HMM based on sequences of FIGURE 02.
  misc_feature (18)..(80): Pfam Name: zf-Dof Pfam Description: Dof domain, zinc finger
  misc_feature (1)..(252): Functional Homolog Of Ceres SEEDLINE ID no. ME01312 at SEQ ID NO: 49
MQDPTGFHQMKAPAFQEQEQQQLKCPRCDSTNTKFCYYNNYNLSQPRHFCKNCRRYWTKGGALRNIPVGGGTRKGTKRSSSSTNKPKRQPNPSPDPTPNQKIPDPSPPPPKSSSSSMFPQQIVLNSGAQNSDSDIDSTRMYLLPVDHQDGKMMDIGGSFSSLLASTGQFGNLLEGFNSNGSGLKTLNHFGGNFDSGCEMDQNSGRDPLFGESSKNGESYLDVQGGRDTSCWSGDSNGWPDLSIYTPGSSLRR

SEQ ID NO: 52 - DNA, 708 bp, Populus balsamifera subsp. trichocarpa
  misc_feature (1)..(708): Ceres ANNOT ID no.1540549
  misc_feature (1)..(708): Encodes the peptide sequence at SEQ ID NO 53
atgcaagatccatcgacagcattccatacaataaagcctcagtttccagagcaagagcaactcaaatgcccccgctgtgattccaacaacaccaagttctgctactacaacaactacaacctctctcagccccgtcatttctgcaagaactgcaagagatactggaccaaaggtggcgctttgagaaacatccccgtcggtggtggcagccgcaagaacactaaacgttcctcaaacaccaaacgcgccaatcccgaccccaatcccgaccccgttaagccaacccgccgggttgcggactcctcctcctcctcagcgacctcgtcaacatcgggacagcagctggcgggtaatgggaatcaggatccgacccgcgtatatggggtggaagcggatccggacaggaagatactggatatgggagggagcttcagctcgttgttggcatcaagcgggcagtttgggagtatttttgaagggctggattcaggcgggtcgggcttgaaaatggtgcggatgggtgggtttggggaggatttgaatgcgggtccaagtagaaacccgggtttggatttgcaagggagcagtaacaataacactactaatgatggtggtggcgagagttacttgcaaggtggggagtggggaaatagtaataatgggtggcctggtcttgctatttacactccaggttctagcttccaatag

SEQ ID NO: 53 - protein, 235 aa, Populus balsamifera subsp. trichocarpa
  misc_feature (1)..(235): Ceres ANNOT ID no.1540549
  misc_feature (1)..(235): Bit score of 391.0 for HMM based on sequences of FIGURE 02.
  misc_feature (16)..(78): Pfam Name: zf-Dof Pfam Description: Dof domain, zinc finger
  misc_feature (1)..(235): Functional Homolog Of Ceres SEEDLINE ID no. ME01312 at SEQ ID NO: 49
MQDPSTAFHTIKPQFPEQEQLKCPRCDSNNTKFCYYNNYNLSQPRHFCKNCKRYWTKGGALRNIPVGGGSRKNTKRSSNTKRANPDPNPDPVKPTRRVADSSSSSATSSTSGQQLAGNGNQDPTRVYGVEADPDRKILDMGGSFSSLLASSGQFGSIFEGLDSGGSGLKMVRMGGFGEDLNAGPSRNPGLDLQGSSNNNTTNDGGGESYLQGGEWGNSNNGWPGLAIYTPGSSFQ

SEQ ID NO: 54 - DNA, 819 bp, Populus balsamifera subsp. trichocarpa
  misc_feature (1)..(819): Ceres ANNOT ID no.1487152
  misc_feature (1)..(819): Encodes the peptide sequence at SEQ ID NO 55
atgcaagatccatcgacagcattccatacaataaagcctcagtttccagagcaagagcaactcaaatgcccccgctgtgattccaacaacaccaagttctgctactacaacaactacaacctctctcagccccgtcatttctgcaagaactgcaagagatactggaccaaaggtggcgctttgagaaacatccccgtcggtggtggcagccgcaagaacactaaacgttcctcaaacaccaaacgcgccaatcccgaccccaatcccgaccccgttaagccaacccgccgggttgcggactcctcctcctcctcagcgacctcgtcaacatcgggacagcagctggcgggtaatgggaatcaggatccgacccgcgtatatggggtggaagcggatccggacaggaagatactggatatgggagggagcttcagctcgttgttggcatcaagcgggcagtttgggagtatttttgaagggctggattcaggcgggtcgggcttgaaaatggtgcggatgggtgggtttggggaggatttgaatgcgggtccaagtagaaacccgggtttggatttgcaagggagcagtaacaataacactactaatgatggtggtggcgagagttacttgcaaggtggggagtggggaaatagtaataatgggtggcctggtcttgctatttacactccaggcggtagctatgaagctcctacgagtcaatttgctccacttggctgcaaatgtcttgcggtggtgggggtagtggtggaggtcgcagcagaagaaataactacaccgtcccaaatcacacaaccgtga

SEQ ID NO: 55 - protein, 272 aa, Populus balsamifera subsp. trichocarpa
  misc_feature (1)..(272): Ceres ANNOT ID no.1487152
  misc_feature (1)..(272): Bit score of 386.0 for HMM based on sequences of FIGURE 02.
  misc_feature (16)..(78): Pfam Name: zf-Dof Pfam Description: Dof domain, zinc finger
  misc_feature (1)..(272): Functional Homolog Of Ceres SEEDLINE ID no. ME01312 at SEQ ID NO: 49
MQDPSTAFHTIKPQFPEQEQLKCPRCDSNNTKFCYYNNYNLSQPRHFCKNCKRYWTKGGALRNIPVGGGSRKNTKRSSNTKRANPDPNPDPVKPTRRVADSSSSSATSSTSGQQLAGNGNQDPTRVYGVEADPDRKILDMGGSFSSLLASSGQFGSIFEGLDSGGSGLKMVRMGGFGEDLNAGPSRNPGLDLQGSSNNNTTNDGGGESYLQGGEWGNSNNGWPGLAIYTPGGSYEAPTSQFAPLGCKCLAVVGVVVEVAAEEITTPSQITQP

SEQ ID NO: 56 - protein, 204 aa, Arabidopsis thaliana
  misc_feature (1)..(204): Public GI ID no.15027981
  misc_feature (1)..(204): Bit score of 392.6 for HMM based on sequences of FIGURE 02.
  misc_feature (24)..(86): Pfam Name: zf-Dof Pfam Description: Dof domain, zinc finger
  misc_feature (1)..(204): Functional Homolog Of Ceres SEEDLINE ID no. ME01312 at SEQ ID NO: 49
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPTNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 57 - DNA, 930 bp, Brassica napus
  misc_feature (1)..(930): Ceres CLONE ID no.978708
  misc_feature (1)..(930): Encodes the peptide sequence at SEQ ID NO 58
atctctctttctcacttacccattcatactgaaagagccctaagaccgacgtcaaaatgcaggaggatctgacgtcagcagcagcgtattaccaccaccaatcgatgatcatgacggcgaagcagcagcagcagccggagttaccggagcaagagcagctaaactgcccgcgctgtgcctcacccaacaccaagttctgttactacaacaactacaacctctcacagccacgtcacttctgcaaaaactgccgtcgttactggaccaaaggcggttccctccgtaacatccccgtcggcggcggaactcgcaagaacagcagcaaacgatcctctgtcggatcgtcttcttcggctccgtcgagcagcagtcccaagagtaaaacggtcgctgtttccgaccaagagagtagaaccacggggaattcgggtcaggaaatggatccgacccggatgttatacgggttaccggttggagatccgagtggtgggaggttcagttccctgttggtttcgaatatgcagcagattagaggggttaactacgagaccgggtcgggttggtatccgggtatggagttgggtttgggctcgggtattcggaggaatgatgacgccgcgttgactgatctagctatgaacagagtggagaagaattgaagaatctggagggtaatttggtaaattccgtatagatgtatattttagtcgtgccgtagtccaatataaacgacaaatgatgtcggtccatataagtgatactattctcacttattttctttattttcctgattggcttttgggtagtgttatatgatttcatctttaatgaaattatagaatgcgactgataaattgattttacatttatctgattagtctgtcattgcttaattatctaatttatggtatcaactaccaatgtatttgc

SEQ ID NO: 58 - protein, 200 aa, Brassica napus
  misc_feature (1)..(200): Ceres CLONE ID no.978708
  misc_feature (1)..(200): Bit score of 351.5 for HMM based on sequences of FIGURE 02.
  misc_feature (30)..(92): Pfam Name: zf-Dof Pfam Description: Dof domain, zinc finger
  misc_feature (1)..(200): Functional Homolog Of Ceres SEEDLINE ID no. ME01312 at SEQ ID NO: 49
MQEDLTSAAAYYHHQSMIMTAKQQQQPELPEQEQLNCPRCASPNTKFCYYNNYNLSQPRHFCKNCRRYWTKGGSLRNIPVGGGTRKNSSKRSSVGSSSSAPSSSSPKSKTVAVSDQESRTTGNSGQEMDPTRMLYGLPVGDPSGGRFSSLLVSNMQQIRGVNYETGSGWYPGMELGLGSGIRRNDDAALTDLAMNRVEKN

SEQ ID NO: 59 - DNA, 1413 bp, Glycine max
  misc_feature (1)..(1413): Ceres CLONE ID no.1623097
  misc_feature (1)..(1413): Encodes the peptide sequence at SEQ ID NO 60
atcactcgttacaaactctgtttagatcatttcatctccatcaacctctccaacaaaataaatatccctttaccctattttctcgaatcttgtttgctatctcctgagtccggctaaatccttgccttttcagccagtttcctccgtcttcccaacctcaatcacacttatccatcacaccccatgtaacaactttctgtctctagctttgagctttttctttttcttttttcttcaaacacaaaacaactttctggaattagttacttctactctcaataaagttttttttttttttttatcatcagcttcatttattagtattttggtcggttctatatccttcctttttctttttgtcttctttccactttcccctcactttgttgtgagatcttgacaacaaagtgcgtgcttgaaaactgaagtcccttttaggaatacgagaatgcaggatccaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttccccatcacccccagtttcctctgcacccgctccagaacccgaccctacccggattggccccaccccggttgttggtggcgggagtttcagttcccttttggcatcaagtggccatttgggcctggggaacctcttggagggtctgaattcaagtgggtctaatctgaaaactgtgcaaatggaagagtttggggagaatgttagttcgggtccggttgcggatccggattcgggtcggaatcccgggttggagatgcaaagcaatgggaacgcagagaattttctgagtttgcaaaatggtgattcaagctgttggaatggtactagtggttggtctcaccttgctattttcactcctgggtcaagctttcagtaatgacaaattaatgaatatgattactctgatctgtatatttagacatatgtcgtactattatggaggatcacaaaccagaaggccactgctataggatcattaggtaaagtttctcctgttttggatttttatatttgtgaattgtggttggtgttcttcagctatatcaatgatggaagagaaatggaaagcaagtcatattttagggcagggtatggggggtatatgaatgttgttgtagtgagattgttttcagtctcatcacgtagaggaagtgttgccatggcttggagattctaatttatttaatctatatatgtgtattttac

SEQ ID NO: 60 - protein, 211 aa, Glycine max
  misc_feature (1)..(211): Ceres CLONE ID no.1623097
  misc_feature (1)..(211): Bit score of 393.5 for HMM based on sequences of FIGURE 02.
  misc_feature (15)..(77): Pfam Name: zf-Dof Pfam Description: Dof domain, zinc finger
  misc_feature (1)..(211): Functional Homolog Of Ceres SEEDLINE ID no. ME01312 at SEQ ID NO: 49
MQDPTLFQPMKPHFPEQEQLKCPRCDSTNTKFCYYNNYNLSQPRHFCKNCRRYWTKGGALRNIPVGGGSRKNTKRSSSSNNNTKRASPSPPVSSAPAPEPDPTRIGPTPVVGGGSFSSLLASSGHLGLGNLLEGLNSSGSNLKTVQMEEFGENVSSGPVADPDSGRNPGLEMQSNGNAENFLSLQNGDSSCWNGTSGWSHLAIFTPGSSFQ

SEQ ID NO: 61 - DNA, 1280 bp, Glycine max
  misc_feature (1)..(1280): Ceres CLONE ID no.1120474
  misc_feature (1)..(1280): Encodes the peptide sequence at SEQ ID NO 62
atagatcaagattgaagccaaaacttggagcagagaggggggggattttttctctctatttgaaggctgcggagtgtggtagagttatcactcgtcacgctcacgcggacaaactcagtttgatcatctccatcaacatttttccatattcactctccaacaaataaaaaaaatatccctttaccctattttctcgaatcttgtttgctatctcctgagtccggttaaatccgtgcctcttttaattcctccgtcgacaaggcaacttcccaacttcaatctcacacttatccatcacaccccatgtgacaactttctgtctctctttgagctttttcttcaaacacacaacaacaactttctggaattagttagctagttctactcccaaaaagggcttcatttattagtattttggtcggttctatatccttccttttcttattttgtcttctttccatttccctcctcacttgttctgagatcttgaaaaaaaaaaaaaaaaagtgtttgaaaactgaagacccttttaggaataggagaatgcaggatccaacgttgttccaacccatgaaaccccactttcccgaacaggaacaacttaaatgcccgcgctgtgactccaccaacaccaagttctgctactacaacaactacaacctctcgcagccacgccatttttgcaagaactgcagaaggtattggaccaaaggtggcgccttgagaaacatccccgttggtggtggaagcagaaagaacacaaagcgatcatcttcatccaacaacaacaccaaacacgcttctccatcacccccagtttcttctgcacccgctccagaaatcgacccgacccgaactgaccccaacccggttggtggtggtgggtctttccgttcccttttggcatcgagtggccatttgggcctagggaacctcttggagggtctgaattcaagtgggtctaatctcaaaagtgtgcaaatggaagagtttggggagaatgttagttcgggtactccagtggcggttccgggttcgggtcagaatcccgggttggagatgcaaagcaatgggaatgctgagagttttctgagtttgcaaaatggtgattcaggctgttgtaatggtactaatggctggtctaaccttgctattttcactcctgggtcaagctatcagtaatgacaaattaatgaatatgattaccctgatctgtatatttagacatgttgtgaaaatagttatatatataattatattactggcttaagtttaagcat

SEQ ID NO: 62 - protein, 212 aa, Glycine max
  misc_feature (1)..(212): Ceres CLONE ID no.1120474
  misc_feature (1)..(212): Bit score of 346.2 for HMM based on sequences of FIGURE 02.
  misc_feature (15)..(77): Pfam Name: zf-Dof Pfam Description: Dof domain, zinc finger
  misc_feature (1)..(212): Functional Homolog Of Ceres SEEDLINE ID no. ME01312 at SEQ ID NO: 49
MQDPTLFQPMKPHFPEQEQLKCPRCDSTNTKFCYYNNYNLSQPRHFCKNCRRYWTKGGALRNIPVGGGSRKNTKRSSSSNNNTKHASPSPPVSSAPAPEIDPTRTDPNPVGGGGSFRSLLASSGHLGLGNLLEGLNSSGSNLKSVQMEEFGENVSSGTPVAVPGSGQNPGLEMQSNGNAESFLSLQNGDSGCCNGTNGWSNLAIFTPGSSYQ

SEQ ID NO: 63 - protein, 289 aa, Medicago truncatula
  misc_feature (1)..(289): Public GI ID no.92873064
  misc_feature (1)..(289): Bit score of 563.5 for HMM based on sequences of FIGURE 02.
  misc_feature (36)..(98): Pfam Name: zf-Dof Pfam Description: Dof domain, zinc finger
  misc_feature (1)..(289): Functional Homolog Of Ceres SEEDLINE ID no. ME01312 at SEQ ID NO: 49
MGMDSSSGQQQQMSNQSLESMLTCSKGEQDKKPKPPQPEALKCPRCDSNNTKFCYYNNYSLSQPRYFCKSCRRYWTKGGTLRNVPVGGGCRKNKRSSSASSKRSQDQPFQTNPNPLTCFPSLSYDSNDLTLALARLQKGHLGFDHEHDFSILGNQTNTSCGILNNHGMNHSSNNQGFFEALMGSQNNVQNLYYMGEVDNGNANGNGNGEMMLPYDHEMSIATTQAVTVTTMKQEMCNVREQNENRVLLGFPWQFNNGDTNMAEMDHLGRAGWNGLTSSWGHGLLNSPLM

SEQ ID NO: 64 - protein, 234 aa, Pisum sativum
  misc_feature (1)..(234): Public GI ID no.37051131
  misc_feature (1)..(234): Bit score of 363.8 for HMM based on sequences of FIGURE 02.
  misc_feature (24)..(86): Pfam Name: zf-Dof Pfam Description: Dof domain, zinc finger
  misc_feature (1)..(234): Functional Homolog Of Ceres SEEDLINE ID no. ME01312 at SEQ ID NO: 49
MPSSDSGESRRSIKPQNRPGAPAPEQENLPCPRCDSTNTKFCYYNNYNYSQPRHLCKACRRYWTHGGTLRDIPVGGGTRKNAKRSRTHHVAVTSSSSSSAVTSAPEQNYPSMTPIQGGSFPYGGVDGEGKQNMSVCGSFTSLLNNNPQQNSGFLALGGFGLGLGHGLGDMGFGIGREWSFPGMMDGSNMGVPVVSSGIGNSWQLEGGETGFVGGGGDCFSWPGLAISTPGNGLK

SEQ ID NO: 65 - protein, 262 aa, Nicotiana tabacum
  misc_feature (1)..(262): Public GI ID no.3341468
  misc_feature (1)..(262): Bit score of 333.6 for HMM based on sequences of FIGURE 02.
  misc_feature (31)..(93): Pfam Name: zf-Dof Pfam Description: Dof domain, zinc finger
  misc_feature (1)..(262): Functional Homolog Of Ceres SEEDLINE ID no. ME01312 at SEQ ID NO: 49
  misc_feature (218)..(218): Xaa is any aa, unknown or other
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 66 - DNA, 1244 bp, Triticum aestivum
  misc_feature (1)..(1244): Ceres CLONE ID no.937560
  misc_feature (1)..(1244): Encodes the peptide sequence at SEQ ID NO 67
agcaaaactcaccggtatctagccaagttagctcgagctccattgtcacaatacgagcgtctacacacccacattgcacctccagggccaggccaacctcgaacgccatggaagcccctctgcaccagctggcccccatgcagcaagcactgctcgcccgtcctcagaactgcaagcacgacgccgcggcgaccatggccgcgacggacatggcgtgcctccagcagcagcagcagctgatgcagctgcagccggcggtggcgaacccgaacacgccctcgggcgcggcacgggagcagtgcccgcggtgcgcgtctcacgacaccaagttctgctactacaacaactacaacacgtcgcagccgcgccacttctgccgcgcctgccgccgctactggacgctcgggggctccctccgcaacgtccccatcgggggctccacccgcaagcgcctgcgcccggcgccgcagcagacgatgcgccgcccgcccgtccacttcggtgcgcctccgccgccgccgatgccggcgcagtcgcactcccagcaggctccgcagggcggccttctcagctcgctgttcgcgttcggcgcggcgccgctgttcgagggccgcgtcgggttcgacctcggcctcggcctgcccgggctgagccaggtggggctcggcggcggcgccggggagttcggcctgcactccctcgggctccggggcggccatgcagggacgtcggcgccgatgctctggccgacagcgttcttggacaacggcaatgtggacacgtggaaggtgtccggcggcggggcggctgccatgtgggcgccggagttctctcccgcgccgacggtagcacaggtcggcggcaatggcatgtttcatggcggggcccagataatgggacaactgtgagagtggtcagtagttgtgtgcgtagcgtacgtgatggctcatgcatgtgcctgctggattatgtgtgtgtaggtcttaatttgttgtgcaagtgcatggctcgtgtcgtgtcttgtttacgtagtacgtagtggtacaaggaggggcctgtctagtttacagttttggttccacaggggtagaatggtctctcatgtgtcttatagcgtgcgtctctacaggtctgatggtgttatttgttgggtacttgggttacatgcatgttgatgttatgattgtataatttacattattatctatagattgggtttgctctcgttttcttttttgagagac

SEQ ID NO: 67 - protein, 222 aa, Triticum aestivum
  misc_feature (1)..(222): Ceres CLONE ID no.937560
  misc_feature (1)..(222): Bit score of 369.8 for HMM based on sequences of FIGURE 02.
  misc_feature (14)..(76): Pfam Name: zf-Dof Pfam Description: Dof domain, zinc finger
  misc_feature (1)..(222): Functional Homolog Of Ceres SEEDLINE ID no. ME01312 at SEQ ID NO: 49
MQLQPAVANPNTPSGAAREQCPRCASHDTKFCYYNNYNTSQPRHFCRACRRYWTLGGSLRNVPIGGSTRKRLRPAPQQTMRRPPVHFGAPPPPPMPAQSHSQQAPQGGLLSSLFAFGAAPLFEGRVGFDLGLGLPGLSQVGLGGGAGEFGLHSLGLRGGHAGTSAPMLWPTAFLDNGNVDTWKVSGGGAAAMWAPEFSPAPTVAQVGGNGMFHGGAQIMGQL

SEQ ID NO: 68 - DNA, 1092 bp, Zea mays
  misc_feature (1)..(1092): Ceres CLONE ID no.456844
  misc_feature (1)..(1092): Encodes the peptide sequence at SEQ ID NO 69
agctagcagctgaaactgaaacagcccgtcacctaccattcgacccgccgcgacgctccctgctcggaacagcctgcgttgctcgcccacacgacgccacgcatgcaggaggagccagggcgtcgtcccgtgccgccgttcgcgggcgtggacctccgccgccccaagggctaccccgtggcggttgccaaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacccgcaagagcagcagcagctcctcatcatcctcggcggcggcggcggcgacgacgacgacgacgtcaacctcgcccggcgccgcgcccaaggccacgaagcggtcgaagaactccaagcgccgccgcgtcgcgcctgccccggaccccgcggcgcccggcacggacgcctccaccgccgacgtcgcgagcacggcaccttcgacggtggctgcctcggagaagccgagcgcgacggagcacgcagcggcggctgtcgccactgagaagccgccggccgcgcctccggtgtccgtcggcgctttcgcggacacgtccccggcgccagatgctgggagcggcggcgttagggagctgctgccgcacccgagccgcttcgagtggccgtcgggctgcaacctggggccgccctactggggctggggcaccagcgtgttcgccgacaccgacccggcgctgttcctcaacctgccgtgagtgacccgtgacaacgccatggcgcccatggttaactaatcaaccatgatcacacggtcgacgagatgagaggaacagagcacgcagtgcgtcgggctcttgaagctaggcgctgtagtagtctcctaagcttactgttgtctagaccgatagtctcgcgtacttgtgtagttgtgttgatggtttttaatcgccgctttgtactgcaattctagtaaaaaggctaacatatgggatagccgggctctgcat

SEQ ID NO: 69 - protein, 245 aa, Zea mays
  misc_feature (1)..(245): Ceres CLONE ID no.456844
  misc_feature (1)..(245): Bit score of 366.1 for HMM based on sequences of FIGURE 02.
  misc_feature (34)..(96): Pfam Name: zf-Dof Pfam Description: Dof domain, zinc finger
  misc_feature (1)..(245): Functional Homolog Of Ceres SEEDLINE ID no. ME01312 at SEQ ID NO: 49
MQEEPGRRPVPPFAGVDLRRPKGYPVAVAKEERPAPGGDPCPRCGSRDTKFCYYNNYNTSQPRHLCKSCRRYWTKGGSLRNVPVGGGTRKSSSSSSSSSAAAAATTTTTSTSPGAAPKATKRSKNSKRRRVAPAPDPAAPGTDASTADVASTAPSTVAASEKPSATEHAAAAVATEKPPAAPPVSVGAFADTSPAPDAGSGGVRELLPHPSRFEWPSGCNLGPPYWGWGTSVFADTDPALFLNLP

SEQ ID NO: 70 - protein, 231 aa, Oryza sativa subsp. indica
  misc_feature (1)..(231): Public GI ID no.125564100
  misc_feature (1)..(231): Bit score of 397.1 for HMM based on sequences of FIGURE 02.
  misc_feature (37)..(99): Pfam Name: zf-Dof Pfam Description: Dof domain, zinc finger
  misc_feature (1)..(231): Functional Homolog Of Ceres SEEDLINE ID no. ME01312 at SEQ ID NO: 49
MQEAGRRPAPQFAGVDLRRPKGYPAAAQLTPAAEEAAAGVGDPCPRCESRDTKFCYYNNYNTSQPRHFCKSCRRYWTKGGSLRNVPVGGGSRKSSTSSSSSSSAAAASSSSSPSSPAKSPKRSKNSKRRRVSPPPPQPAPAPPPPTTADAADVAAPTAPEDTTKKAPEDLTAAAATQPAVALGLGVADGGGGGKEHLDTSPFEWPSGCDLGPYWPTGVFADTDPSLFLNLP

SEQ ID NO: 71 - protein, 230 aa, Oryza sativa subsp. japonica
  misc_feature (1)..(230): Public GI ID no.52077334
  misc_feature (1)..(230): Bit score of 388.7 for HMM based on sequences of FIGURE 02.
  misc_feature (37)..(99): Pfam Name: zf-Dof Pfam Description: Dof domain, zinc finger
  misc_feature (1)..(230): Functional Homolog Of Ceres SEEDLINE ID no. ME01312 at SEQ ID NO: 49
MQEAGRRPAPQFAGVDLRRPKGYPAAAQLTPAAEEAAAGVGDPCPRCESRDTKFCYYNNYNTSQPRHFCKSCRRYWTKGGSLRNVPVGGGSRKSSTSSSSAAAAAASSSSSPSSPAKSPKRSKNSKRRRVSPPPPQPVPAPPPPTTADAADVAAPTAPEATTKKAPEDLTAAAATQPAVALGLGVADGGGGGKEHLDTSPFEWPSGCDLGPYWPTGVFADTDPSLFLNLP

SEQ ID NO: 72 - protein, 215 aa, Oryza sativa subsp. japonica
  misc_feature (1)..(215): Public GI ID no.9988442
  misc_feature (1)..(215): Bit score of 152.6 for HMM based on sequences of FIGURE 02.
  misc_feature (25)..(87): Pfam Name: zf-Dof Pfam Description: Dof domain, zinc finger
  misc_feature (1)..(215): Functional Homolog Of Ceres SEEDLINE ID no. ME01312 at SEQ ID NO: 49
MEVAEGRTVAAAAAGGGGLGGGARTEAEGLACPRCESTNTKFCYYNNYNLAQPRHFCKACRRYWTRGGALRNVPVGGGTRNKVAPAPCTGRRKRAAHAAHAAAPPPTTTASSAPLPLMPPAVAYELPFLPPPPPLPLAAVDPDRRLLDLGGSFTSLLAPAQLHNGHFTTGFLLGTMSSAPPPPPPPATSTPSPAPAAHPPVSDSIWAMGWPHLSI

SEQ ID NO: 73 - protein, 299 aa, Solanum demissum
  misc_feature (1)..(299): Public GI ID no.113205234
  misc_feature (1)..(299): Bit score of 593.0 for HMM based on sequences of FIGURE 02.
  misc_feature (32)..(94): Pfam Name: zf-Dof Pfam Description: Dof domain, zinc finger
  misc_feature (1)..(299): Functional Homolog Of Ceres SEEDLINE ID no. ME01312 at SEQ ID NO: 49
MDQQQQEMSSQTLESMLVCTKPDQDQKKPRPAEQQPQKCPRCDSANTKFCYYNNYSLTQPRYFCKSCRRYWTKGGTLRNVPVGGGCRKNKKLSSTTSAKRSSQDNISPNISNPIPSYDSSTDLSLAFARLQKQTNAHLEIDQEHDNNNMSMMYNTGNNCTSTTFLDALRGGFLENAPNHPGLFHHNMYNYANMGQLVENGEMGMSYDQDQMSIGTSTTMMTTIVKQEMCNMARSTEGHDLNNSNNNNKVLCGFPWQQMNGDHHVNNMNTNDFEYSTNKQSWNGFGGSSNWHGLINSPLM

SEQ ID NO: 74 - DNA, 687 bp, Sorghum bicolor
  misc_feature (1)..(687): Ceres ANNOT ID no.6100272
  misc_feature (1)..(687): Encodes the peptide sequence at SEQ ID NO 75
atggaggcgggccaggtaccggacgggagggctctgatggcggccgtcaccaccacaggcggcggtgggcgggagccggagggcctgccgtgcccgcgctgcgagtccgtcaacaccaagttctgctactacaacaactacaacctctcccagccgcgctacttctgcaagacgtgccgccgctactggacgcgcgggggcgcgctccgcaacgtccccgtcggcggcaacacccgcaaggccacgcccgcaaccggccgccgcaagcgctccactccagctcccgtcaacgtcaccgtgccggcgcccgcgaccgcgtcgcctccgcctccgccggcgctccacggcggctcgctgctgcgcccgtacggcggcggcggcggcagcggcctcctgtcgttcgccgcgccggccctggcgtcgccgctcgccgccgcggacccggaccgccggctgctcgacttcggcggcagcttcacctcgctgatcgcgcccggggtggcggacgtcggtgtccacttctccgccgggttcctgatgggcgggctcgcgccggcggccctgcctcgcgcgcctggctctgtcgctgctctgccgccaccgccaccgcagcagcagcccacggtgtcccaggcgttgcccgagggcatggtctggagcatggggtggccggacctgtccatctaa

SEQ ID NO: 75 - protein, 228 aa, Sorghum bicolor
  misc_feature (1)..(228): Ceres ANNOT ID no.6100272
  misc_feature (1)..(228): Bit score of 369.1 for HMM based on sequences of FIGURE 02.
  misc_feature (24)..(86): Pfam Name: zf-Dof Pfam Description: Dof domain, zinc finger
  misc_feature (1)..(228): Functional Homolog Of Ceres SEEDLINE ID no. ME01312 at SEQ ID NO: 49
MEAGQVPDGRALMAAVTTTGGGGREPEGLPCPRCESVNTKFCYYNNYNLSQPRYFCKTCRRYWTRGGALRNVPVGGNTRKATPATGRRKRSTPAPVNVTVPAPATASPPPPPALHGGSLLRPYGGGGGSGLLSFAAPALASPLAAADPDRRLLDFGGSFTSLIAPGVADVGVHFSAGFLMGGLAPAALPRAPGSVAALPPPPPQQQPTVSQALPEGMVWSMGWPDLSI

SEQ ID NO: 76 - DNA, 1522 bp, Arabidopsis thaliana
  misc_feature (1)..(1522): Ceres SEEDLINE ID no.ME01463
  misc_feature (1)..(1522): Ceres CLONE ID no.19586
  misc_feature (1)..(1522): Inplanta Sequence
  misc_feature (1)..(1522): Encodes the peptide sequence at SEQ ID NO. 77
acacgaaaatggcgtctcttggccaaatcaccctgccacgcgcgccgtcgtcggagattggcctcttacgccgtcgatttgagcggccgatcatcagaacccggatcggattcaacggccggattgcgagcgtattgactaacgcaggggaccaagcggtgtcggtaaaagcgagtgtgagccagaaggtgattgaagaggaagccaaagttattgtgggtacctacgcgcgggctccagtggttctctcgagtgggaaaggttgtaaattgttcgaccctgaaggaaaagagtatctggattgtgcatctggaatcgctgtgaatgctcttggtcatggagatcctgattggcttcgagctgtcactgagcaagctggtgttcttgcccatgtcagcaatgtttattacacgatccctcagatagagctcgcaaaacgcttggtggcgagttcttttgcggaccgtgtattcttttgtaactcgggaacggaagccaatgaagcagccattaagttttcaagaaaattccagagattcacccatccagaagacaaagaagtcgcgacaggtttcatcgcctttacaaacagcttccatggaagaaccttaggagctcttgccttgacaagcaaagaacaatacagaactcctttcgaacccatcatgcctggtgtaaccttcttagaatatggtaacattcaagcagccacagaccttatccgctcaggtaaaatagctgcagtttttgtggaaccaattcaaggagaaggcgggatttactctgctacaaaagagtttctacaatctctgcgctctgcttgtgatgccgctggatctcttctcgtcttcgatgaggttcaatgtggtttgggtcgaacgggtctcatgtgggcttatgaagccttcggtgtgactcctgacataatgacggttgcaaagcctttagctggtggtttacctattggagcggtgctggtgactgaaaaggttgcagagaccataaactacggagatcatggaagtacatttgcaggcagccctcttgtgtgcagtgcagccattgcagttatggataaagtatcgaaaccctctttcttgtccagtgtctcaaataaaggtcgatactttagagacctgttggtgaaaaaacttggaggaaactcgtacgtgaaggaagtgagaggcgaagggcttatcataggagtggagctcgatgtgccggcaagttcactggtcgatgcttgccgagattctggtcttctgatcttgacagcggggaaaggaaatgtcgtcaggattgttcctccgttggttatatcggaggaggaaatcgaacgtgcggttgagatcatggcccaaaatttgactgcgcttgattgaagctcttggaagagaaatgatgtggtgttgaagaagaacaaatgtttcatattcgatcttgtcttaaattagcctcaagtgtaccggtaaagatgctctgcacaattgaaaagaaataaaatttgacacaaaacttgatg

SEQ ID NO: 77 - protein, 457 aa, Arabidopsis thaliana
  misc_feature (1)..(457): Ceres SEEDLINE ID no.ME01463
  misc_feature (1)..(457): Ceres CLONE ID no.19586
  misc_feature (1)..(457): Bit score of 1040.1 for HMM based on sequences of FIGURE 03.
  misc_feature (79)..(404): Pfam Name: Aminotran_3 Pfam Description: Aminotransferase class-III
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 78 - protein, 451 aa, Alnus glutinosa
  misc_feature (1)..(451): Public GI ID no.2811029
  misc_feature (1)..(451): Bit score of 1090.0 for HMM based on sequences of FIGURE 03.
  misc_feature (70)..(395): Pfam Name: Aminotran_3 Pfam Description: Aminotransferase class-III
  misc_feature (1)..(451): Functional Homolog Of Ceres SEEDLINE ID no. ME01463 at SEQ ID NO: 77
MTSLQYFSLNRPVFPATHLHRPGIRHLQVSACANVEVQAPSSVKKQGVSKEVMEAAGRVLVGTYARVPVVLSRGKGCKLYDPEGREYLDLSAGIAVNVLGHADSDWLRAVTEQAATLTHVSNVFYSIPQVELAKRLVASSFADRVFFSNSGTEANEAAIKFARKFQRFTRPDEKQPATEFVSFSNSFHGRTMGSLALTSKENYRSPFEPVMPGVTFLEYGNIEAATQLIQRRKIAAVFVEPIQGEGGVYSATKEFLYALRKACDDSGTLLVFDEVQCGLGRTGYLWAHEIYDVFPDIMTLAKPLAGGLPIGAVLVTERVASAITYGDHGTTFAGGPLVCKAALTVLDKILRPGFLASVSKKGHYFKEMLINKLGGNSHVREVRGVGLIVGIELDVSASPLVNACLNSGLLVLTAGKGNVVRIVPPLIITEQELEKAAEILLQCLPALDRHG

SEQ ID NO: 79 - DNA, 1750 bp, Gossypium hirsutum
  misc_feature (1)..(1750): Ceres CLONE ID no.1853284
  misc_feature (1)..(1750): Encodes the peptide sequence at SEQ ID NO 80
aaatccaaatttgcttttttccttctgtaaatcatttattgattagcaatcattcaacatttctctctcaaaccccattcttttacgttctcaaattcattattcctgcttttgtataaacccaaagaaaaagatcaaagcttttaccggaaaagaataaaaaagctaaaaaaatgggttctcttaagctatttcccagcttttcgctttcagtttctccggcgaccaatctccgccgcccgttaaacaatgggagagtgaatgcatctctaaacatggacgtagaagcacctaatccattgaaattgaagtcgaatggaagcaatgaagtgatagagaaagatgcgaagtttattgttggaacgtatgcaagagctccggtggtgctttccagtgggaagggctgtaaattgtatgatcccgaagggcgagagtttcttgattgtgcagctgggattgctgtgaatgcgcttggtcatggggatcccgattggctcagggctgttacagaacaagccagtattcttactcatgttagtaatgcctactatagcattcctcaggttcaatgcggattgggtcggactggttatctctgggcacacgaagcatacggcgtattcccggatatgatgacacttgcaaagccacttgcaggaggacttccaataggtgcgactttggtatctgaaagagttgcttctgccatagcccatggggaccatggaagtacttttgcaggttcaccttttgtttgcagtgctgcaatttgtgttttcaataaaatatcaaaccccagtttcttgtccagcgtcttgaagaaaggtgattacatgaaagagttgttgaaccagaagctcggagggaatccgcacgtgaaagaaatacgaggatggggtcttatgattgggatagagctggacgtgtctgcttcgccccttgtagatgcgtgccgaaattctggacttcttgtattgactgcagggaaaggaaatgtggtgagactggtgccaccactgatcatctcagaggaagaattgaaacatgcagctgagattcttcatgaatgtttaccagcacttgataacagtaactgagtttaagacacttgataacatattatttttcatactcttttcatgatagtaaattttgtgattttttaattgtacttgcagcgtcacacacgatcccgtaccaaaaaatgcaggcagccttgagcttggcaccttcacctctctccatagttacaactacaaaaccctttccgccatgtaaatccatgctaaaattgcagactccaagaggtttcaaagcaacacctgttggacaggataactcaacagttgattacagctccacggcctcagtatttccagctgaggcatgcgatacacttggaggagaagcctgtgatgttgagatgttccctgaagtgaagctaaagccagatcaaacacaaagcaataagggtaagacaggttcagagcaggttgacagagaatacttggagtacaacagtcccaagacggtgttcataggagaggcttgtgatgatcttggaggagaattctgtgagcctgagtatcagaaaggagttcaatgattttaccagataaacctcaaaacagtaactgcaaataaataatggggtggtcaccttctttgtaacctgcatactgccttgtgtttcttgtgtaatagtctaaattttaagctatttatcaacttttatttttccagcagatcg

SEQ ID NO: 80 - protein, 307 aa, Gossypium hirsutum
  misc_feature (1)..(307): Ceres CLONE ID no.1853284
  misc_feature (1)..(307): Bit score of 545.6 for HMM based on sequences of FIGURE 03.
  misc_feature (131)..(251): Pfam Name: Aminotran_3 Pfam Description: Aminotransferase class-III
  misc_feature (1)..(307): Functional Homolog Of Ceres SEEDLINE ID no. ME01463 at SEQ ID NO: 77
MGSLKLFPSFSLSVSPATNLRRPLNNGRVNASLNMDVEAPNPLKLKSNGSNEVIEKDAKFIVGTYARAPVVLSSGKGCKLYDPEGREFLDCAAGIAVNALGHGDPDWLRAVTEQASILTHVSNAYYSIPQVQCGLGRTGYLWAHEAYGVFPDMMTLAKPLAGGLPIGATLVSERVASAIAHGDHGSTFAGSPFVCSAAICVFNKISNPSFLSSVLKKGDYMKELLNQKLGGNPHVKEIRGWGLMIGIELDVSASPLVDACRNSGLLVLTAGKGNVVRLVPPLIISEEELKHAAEILHECLPALDNSN

SEQ ID NO: 81 - DNA, 1356 bp, Populus balsamifera subsp. trichocarpa
  misc_feature (1)..(1356): Ceres ANNOT ID no.1476446
  misc_feature (1)..(1356): Encodes the peptide sequence at SEQ ID NO 82
atgggttctctccagcacttcctcaacagtccgatctcggtccccttttctccaaatctcaatcatcgccgttcttttttcttacgagcatgccttaacctggacgtgcatgcaccggattcagtgaaacccaaaacccatttgaaaagtcgagaggttatggagatggaagggaaggtgttagttgggacatatgcaagaaacccagttgtgatttcgagtggaaaaggttgtaaattgtatgatcccgaagggagagagtacttggattgtacttctggtattgctgttaatgctcttggtcatggggatcctgattgggtcaaagctgttgttgagcaagctaatttgctcactcatgtcagcaatgttttctattcagttcctcaggtagagcttgctaaacgtcttgtggcttgttcatttgccgatcgtgtttttttcacgaactctggtacggaagcaaatgaagctgctataaagtttgcacggaagtatcaacgatttacaaatcctgagaagcagcaagcgacagagtttatttcatttagtaatagcttccatgggaggacaatgggggctctggcattgacaagcaaggagcagtatcgatttccttttgagcctgtcatgcctggagttaatttcctggaatatggtgacgtacaggctgcaacagaactgattaagtctggcaggattgctgctgtatttgtagaacctatacagggtgaaggtggtatttatagtgcaacaaaggaattcttacagtccttacgtagtgcttgtgatgatgctgggtctctcctggtttttgacgaggtccaatgtggcttaggtcgaactggttatctttgggcacacgaggcatatggtgtggtcccagatataatgacacttgccaagcctctcgcaggaggtctacctataggagctgcattggtgagtgaaaaagttgcagctgccataaaatatggagaccacgggagcacttttgctggtgggcctcttgtctgtaacgctgccattgctgttttagataaaatatcaaagccaggtttcttggccagtgtctctgagaaaggtcaatacttcaaagaacttttaattcacaaactaggaggaaattcacatgtgagagaagtacgaggtttgggacttataattgggatagagctggatgtatccgcttcacccctcgtagatgcctgccgagattccagtcttctaatattaactgctggaaaaggaaatgttgtcaggctggtccccccgttgatcatctcagaacaagaactggagcgtgctgctgagattatactggaatgtcttccagcacttgacaagactagttga

SEQ ID NO: 82 - protein, 451 aa, Populus balsamifera subsp. trichocarpa
  misc_feature (1)..(451): Ceres ANNOT ID no.1476446
  misc_feature (1)..(451): Bit score of 1098.3 for HMM based on sequences of FIGURE 03.
  misc_feature (71)..(395): Pfam Name: Aminotran_3 Pfam Description: Aminotransferase class-III
  misc_feature (1)..(451): Functional Homolog Of Ceres SEEDLINE ID no. ME01463 at SEQ ID NO: 77
MGSLQHFLNSPISVPFSPNLNHRRSFFLRACLNLDVHAPDSVKPKTHLKSREVMEMEGKVLVGTYARNPVVISSGKGCKLYDPEGREYLDCTSGIAVNALGHGDPDWVKAVVEQANLLTHVSNVFYSVPQVELAKRLVACSFADRVFFTNSGTEANEAAIKFARKYQRFTNPEKQQATEFISFSNSFHGRTMGALALTSKEQYRFPFEPVMPGVNFLEYGDVQAATELIKSGRIAAVFVEPIQGEGGIYSATKEFLQSLRSACDDAGSLLVFDEVQCGLGRTGYLWAHEAYGVVPDIMTLAKPLAGGLPIGAALVSEKVAAAIKYGDHGSTFAGGPLVCNAAIAVLDKISKPGFLASVSEKGQYFKELLIHKLGGNSHVREVRGLGLIIGIELDVSASPLVDACRDSSLLILTAGKGNVVRLVPPLIISEQELERAAEIILECLPALDKTS

SEQ ID NO: 83 - DNA, 1407 bp, Populus balsamifera subsp. trichocarpa
  misc_feature (1)..(1407): Ceres ANNOT ID no.1451126
  misc_feature (1)..(1407): Encodes the peptide sequence at SEQ ID NO 84
atgaattctattcacatttcatcaaatcccattgtttctcactcactcactcaccaccgttggctctccacttcacacaaactctatccccaagtgatcaaaatcaacggcagaaaatcactgacaacatcatgcctcaatgtagacgtgaatgcgccagatatttcaagaaaagtaacagcccaaaacagcaaagaagtgatagagctagaagggaaggtaatggtagggacttacgggagagcgcctgttgttttggtgagtggcaaaggttgtaaattgtatgatgttgaagggcgtgagtatttggacatgacttcagggattgctgttaatgctttaggacactgtgatcctgattgggttaaggctgttgctgatcaagctcatgttttgactcatgttagcaatgtctactattctgttcctcaggtagagcttgctaagcgtctagtggattgctcgtttgctgatcgagtgttttttacaaattctggagcagaggcaaatgaagcagctatcaaatttgctaggaagttccaaagacactcaaaccctgacgtgaaagacccagctacagaattcatatctttcactaatagcttccatggcaggacaatgggtgcacttgctttaacaagcaaagaacaatatagaacaccttttgaacctgttatgcctggagtcacttttgtagaatatggaaatataaaggctacacaagaattaattcggcgtgggaaaactgctgcagtttttgtggaacccatccaaggtgaaggaggcatttatagtgcaacaaaggcgtttttggagttcttgcgaactgcttgtgatgatgctggggcactcctggtgtttgatgaggtgcaatgtggtttaggtagaactggatacctctgggcccatgaagcttatgggatcttcccagatataatgacactcgcaaaaccacttgctggaggtctacctattggtgccgctttggtgactgaaagagttgcttcatctataaattatggtgaccatggaagtacatttgctggtggttcccttgtttgcaatgcagcccttactgttctggagaaaatctcaaaaccagaatttttgtctagtgtatctaagaaagggctgtacttaaaagaaattttgcagcaaaagcttggcaggaactcacatgtgaaagaaatccgaggtcttgggtttattattggaattgagttggatgtcccagcctcaccactagtttctgcttgtcgaaattctggccttcttgtgttaactgctggaaaaggaaatgtcgtgagacttgtgcctccattgactgtaactaagcaggaacttcgtcttgcatctgatattctacaaaatgcaatgtctgtacttgatgagaataattcagagtag

SEQ ID NO: 84 - protein, 468 aa, Populus balsamifera subsp. trichocarpa
  misc_feature (1)..(468): Ceres ANNOT ID no.1451126
  misc_feature (1)..(468): Bit score of 975.5 for HMM based on sequences of FIGURE 03.
  misc_feature (85)..(410): Pfam Name: Aminotran_3 Pfam Description: Aminotransferase class-III
  misc_feature (1)..(468): Functional Homolog Of Ceres SEEDLINE ID no. ME01463 at SEQ ID NO: 77
MNSIHISSNPIVSHSLTHHRWLSTSHKLYPQVIKINGRKSLTTSCLNVDVNAPDISRKVTAQNSKEVIELEGKVMVGTYGRAPVVLVSGKGCKLYDVEGREYLDMTSGIAVNALGHCDPDWVKAVADQAHVLTHVSNVYYSVPQVELAKRLVDCSFADRVFFTNSGAEANEAAIKFARKFQRHSNPDVKDPATEFISFTNSFHGRTMGALALTSKEQYRTPFEPVMPGVTFVEYGNIKATQELIRRGKTAAVFVEPIQGEGGIYSATKAFLEFLRTACDDAGALLVFDEVQCGLGRTGYLWAHEAYGIFPDIMTLAKPLAGGLPIGAALVTERVASSINYGDHGSTFAGGSLVCNAALTVLEKISKPEFLSSVSKKGLYLKEILQQKLGRNSHVKEIRGLGFIIGIELDVPASPLVSACRNSGLLVLTAGKGNVVRLVPPLTVTKQELRLASDILQNAMSVLDENNSE

SEQ ID NO: 85 - protein, 457 aa, Arabidopsis thaliana
  misc_feature (1)..(457): Public GI ID no.15220176
  misc_feature (1)..(457): Bit score of 1041.8 for HMM based on sequences of FIGURE 03.
  misc_feature (79)..(404): Pfam Name: Aminotran_3 Pfam Description: Aminotransferase class-III
  misc_feature (1)..(457): Functional Homolog Of Ceres SEEDLINE ID no. ME01463 at SEQ ID NO: 77
MASLSQITLPRAPSSEIGLLRRRLERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSHVKEVRGEGLIIGVELDVPASSLVDACRDSGLLILTAGKGNVVRIVPPLVISEEEIERAVEIMSQNLTALD

SEQ ID NO: 86 - DNA, 1641 bp, Glycine max
  misc_feature (1)..(1641): Ceres CLONE ID no.527024
  misc_feature (1)..(1641): Encodes the peptide sequence at SEQ ID NO 87
tcttgcgaagataggcaaggaagtaaggaagcgtacgtaattccactcacactcggtttagcgaagcgaggaaagccccaatttgcttcattatcagcaaaacgaaaaagtgcaatgggtgcagtttacttttctcaatcatgttacaaacctaggcaaattttcaatttggagagagaaagcactttggtgggaagatgtcctgttgttcagattagatgccggagggttgtgagtgcgtgtcttaacgtggatgttgatgcacctaatacagggaatacaacatcggagaagaagaaaactaaggatgtgatcgagatggaagggatgtatttggttgggacatatgcaagaacaccagtggtacttgagaggggggaaggttgtaagttgtatgatgttgaagggaatgaatatttagatttgagtgctgggattgctgtcaatgcactaggccatggggatgcagactggttgaaagctgttgttgagcaagccggcacccttactcataccagcaatatattccacacaattcctcaggtagaacttgcaaagcgtcttgtggcttcttcttttgctgatcgtgtattctttgcaaattctggaactgaggcaaatgaagcagctatcaaatttgcaagaaagtatcagaggcacacaacttctaacgggaaagttccagcaacagagttcatagcttttagtaactgcttccatggaagaaccctgggtgcacttgctttgactagtaaagtgcaatacagaatgccttttgaacctgttatgcctggagtgacctttttagagtatggaaatgctcaggctgcagttgaattaattaagcagggcaagattgctgcagtttttgttgagcccatccaaggagaaggtggaatttacagtgctacaaaagaatttctacagtctctacgtaatgcttgtgatgaaactggggcacttcttgtgtttgatgaggttcaatgtggtttaggtagatcagggtttctctgggcccatgaggcatatggtgtcttcccggatatgatgacccttgcgaagcctcttgctggaggcctacctattggagcactcttagtgactgagagagttgcttctgctataaattatggtgatcatggaagcacttttgctggaagccctctagtttgtagtgctgctcttgctgttttggataaaatatcaaaacctgatttcctgtcatctgtatctaagaaaggcctctacttcaaagaactacttagggaaaagttaggagaaaaccggcatgtgaaagaaattcgtggtgttgggctaatcataggaatagatttagatgtacctgcatcacccctcgtagatgcatgccggagttctggcctcctagtgttaactgctggaaaaggaaatgttgtcaggctagtcccgccattgatcataacagagaaggagctagagcaagcggctggcattttgtgccaaactttaccagttcttgataactaggagtgtaggagaaagagtattggccttactttgctagcgaaatagaacatatttggtggtgtattgttgagtagctgagtcacagatggtgttgcctaacttaccagattctgtggataaaataaggcttctaat

SEQ ID NO: 87 - protein, 463 aa, Glycine max
  misc_feature (1)..(463): Ceres CLONE ID no.527024
  misc_feature (1)..(463): Bit score of 1058.6 for HMM based on sequences of FIGURE 03.
  misc_feature (84)..(409): Pfam Name: Aminotran_3 Pfam Description: Aminotransferase class-III
  misc_feature (1)..(463): Functional Homolog Of Ceres SEEDLINE ID no. ME01463 at SEQ ID NO: 77
MGAVYFSQSCYKPRQIFNLERESTLVGRCPVVQIRCRRVVSACLNVDVDAPNTGNTTSEKKKTKDVIEMEGMYLVGTYARTPVVLERGEGCKLYDVEGNEYLDLSAGIAVNALGHGDADWLKAVVEQAGTLTHTSNIFHTIPQVELAKRLVASSFADRVFFANSGTEANEAAIKFARKYQRHTTSNGKVPATEFIAFSNCFHGRTLGALALTSKVQYRMPFEPVMPGVTFLEYGNAQAAVELIKQGKIAAVFVEPIQGEGGIYSATKEFLQSLRNACDETGALLVFDEVQCGLGRSGFLWAHEAYGVFPDMMTLAKPLAGGLPIGALLVTERVASAINYGDHGSTFAGSPLVCSAALAVLDKISKPDFLSSVSKKGLYFKELLREKLGENRHVKEIRGVGLIIGIDLDVPASPLVDACRSSGLLVLTAGKGNVVRLVPPLIITEKELEQAAGILCQTLPVLDN

SEQ ID NO: 88 - protein, 469 aa, Medicago truncatula
  misc_feature (1)..(469): Public GI ID no.27527063
  misc_feature (1)..(469): Bit score of 884.7 for HMM based on sequences of FIGURE 03.
  misc_feature (54)..(382): Pfam Name: Aminotran_3 Pfam Description: Aminotransferase class-III
  misc_feature (1)..(469): Functional Homolog Of Ceres SEEDLINE ID no. ME01463 at SEQ ID NO: 77
MASTRRVQCLMRRFYRGSRTFGVATQPNASSSSQTIIDKEFQHSAHNYHPLPIVFAHAKGSAVWDPEGNKYIDFLSGYSAVNQGHCHPKILKALKNQAGRLTVSSRAFYNDRFPVFAEYSTALFGYDMVLPINTGAEGVETALKLARKWGYDKKKIPNDEALIVSCCGCFNGRTLGVISMSCDNEATRGFGPLIPGHLKVDFGDAEALEKILKEKGDAIAAFILEPIQGEAGVKIPPDGYLKAVRDLCSKYNVLMIADEIQTGLARTGKMLACEWEEVRPDVVVLGKALGGGIIPVSAVLADKEVMLCIKPGQHGSTFGGNPLASAVAIASLEVIKEERLAERSTKLGGELLGLLEKIQKQYPDHVKEVRGRGLFIGVELNSESLSPVSFFELSEKLKDRGVLAKSTHDTIIRFTPPLCISADEIQQGSKALADVLEIDLPMLKKMKPKDAAPPAGPSACDRCGRVVYG

SEQ ID NO: 89 - DNA, 1588 bp, Triticum aestivum
  misc_feature (1)..(1588): Ceres CLONE ID no.913632
  misc_feature (1)..(1588): Encodes the peptide sequence at SEQ ID NO 90
agcgtgaccagatttttcttttaacttcatccaaccccgaccccaatccgtatttaactccgaaacccctccactccctctcgcccaccccgaatccgtccgccatgaactcgctccaatccttcctcgccgtcgcgcccgtcaagccggccgcggccgccgcgaggctcccgtcgtcccggcgggcgcgcgtctccgcctgcctcgcgaccccggcgcccgcgccgaccgcccccgcggcggcgcggcgggagctgtccgcggcgagccgggccgtcatggcggacgaggccaagtacatcgtgggcacctacaagcgcgcccaggtcgtcttcgtggcggggcgcggctgcaagctctacgacatcgatgggcgtgagtaccttgacatggccgccggcatcgccgtcaacgccctcggccacggcgaccccgacgtggacgccgccgccgcggaccagcgcggacgcctggtccacgccagcaacgtcggctacaccgtgccccaggtggagctcgccaagcggctcgtggaggcctcctttgctgaccgcgccttctttgccaactccggcactgaggccaatgaggcggccatcaaattcgccaggaagtaccagagggtcgcgcaccccaacggtgatgcgcctacggagttcatgtccttcaccaactgcttccatggccggaccattggctcgctcgcgctgactagcaaggtgcagtacagggagccctttgaacctgtcatgcccggctcaacatttgtcgagtatggcaatttggaggaggccaagaaggtgatacagtcggggaagattgctgctgtgtttgtcgagcccgtgcagggtgagggtgggattcacagtgccaccaacgagttcttgcagggactgcgggatgcttgtgatgaggcaggggctctcttggtctttgacgaggtgcaatgtggtctggggcgcacaggttacctctgggcccatgaggtttatggtgtattacctgacataatgaccttggcgaagccactggccaacggccttcccattggtgtggccttggtcaccgaaaaggttgcggcagccatacactacggtgaccatggtaccacattcggcggaggcccttttgtgtgccatgctgcattagccacattggacaagatccagaaacctggctttctagcagaggtgaccaagaaaggagaatacttcaagcagctgctcaaaactaagctgggtggaaaccctcatgtcaaagagatccggggggccggtctcatcgttggcattgagctcgacgtaccggctgggcctttggtcgatgcgtgcttggatgctggtgtctttctgctgacggccgggaaaggcaatgtggtgaggcttgtgcctgcgctcatcgtgtcggagaaggagctggagcaagctgcagaggtgataagggaatgtctacctgctcttgaagcctctacctcttagtgtaaacaagatctcttaagatctacatgttgaagtttctttcgaaatttggaagggaataaaatgtcatgttggactattgtgatgttgaagttcttttcaaagtttgg

SEQ ID NO: 90 - protein, 457 aa, Triticum aestivum
  misc_feature (1)..(457): Ceres CLONE ID no.913632
  misc_feature (1)..(457): Bit score of 1058.4 for HMM based on sequences of FIGURE 03.
  misc_feature (76)..(400): Pfam Name: Aminotran_3 Pfam Description: Aminotransferase class-III
  misc_feature (1)..(457): Functional Homolog Of Ceres SEEDLINE ID no. ME01463 at SEQ ID NO: 77
MNSLQSFLAVAPVKPAAAAARLPSSRRARVSACLATPAPAPTAPAAARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATNEFLQGLRDACDEAGALLVFDEVQCGLGRTGYLWAHEVYGVLPDIMTLAKPLANGLPIGVALVTEKVAAAIHYGDHGTTFGGGPFVCHAALATLDKIQKPGFLAEVTKKGEYFKQLLKTKLGGNPHVKEIRGAGLIVGIELDVPAGPLVDACLDAGVFLLTAGKGNVVRLVPALIVSEKELEQAAEVIRECLPALEASTS

SEQ ID NO: 91 - DNA, 1575 bp, Zea mays
  misc_feature (1)..(1575): Ceres CLONE ID no.1386710
  misc_feature (1)..(1575): Encodes the peptide sequence at SEQ ID NO 92
aagttttagtttcagcttcactgtcttttttaacgactctgttccttctccgaccaaaagcgagaaaaaaaatggcgtctcttggccaaatcaccctcccgcgagcgccatcgttgcagaaaggcctcctacgccgtccgatcagaaccccaatcagattcaacggccggatcgcgagtgtattgactaacgcgggttcggtgaaagcaagtgtgagccagaaggtgattgaagaggaggcgaaagttctggtgggtacctacgcgcgtgctccagtggtgctctcgagtgggaaaggttgtaaattgatggacgcagaagggaaagagtatcttgattgtgcatctggaatcgctgtgaatgctctgggccatggagatcctgattggcttcaagctgtcactgaccaagcttctgttctttcccacgtcagcaatgtctattacaccattcctcagatagaactagcgaaacgccttgtggcaagttctttcgcagaccgtgtattcttctgtaactctggaacagaagccaacgaagcagccatcaagttttctagaaagttccagagattcacccatcctgaagacaaggaagtcgccacaagcttcatcgcctttacgaatagtttccatggtagaaccttaggagctcttgcattaacaagcaaagaacagtacagaactcctttcgaacctatcatgccaggcgttacgttcttggaatatggtaacactcaagcagccactgatcttatccgctccggtaaaatagctgctgtgtttgtggagcctattcaaggagaaggtggggtttactctgctacaaaagagtttctccagtctcttcgctcagcttgtgatgctgcaggatctcttctcgtcttcgatgaggttcagtgtggtttgggtcgaaccggtaacctatgggcatatgaagcatttggtgtaacacctgacataatgacagttgcaaagcctttagcaggtggtttaccaattggagcggtgcttgtaactgaaaaagttgctgagaccatcaaatatggagatcatggaagcacatttgcagggaaccctcttgtgtgtagtgcagccatcgctgtttttgataaagtatctaaatcctctttcttggccagtgtctcgagcaaaggtttatactttaaggatctgttggtgaagaaactaggaggaaacttgcacgtgaaggaagtgagaggagaagggcttattattggagtggagctggacgtgcccgcaggtccgttggtcgatgcttgtcgtgattctggtcttctgatcttgacggcagggaaagggaatgtcgtcaggattgttccgccgttgattatatcggaggaggaaatcgaacgtgccgttgagattattttccatgatttaactgcgcttgactgaatattgttgttgaacataaatgttcatcgactatgaactgtgtttttaaaattctgtactttacttaaataagctcaagtataacagtaaatgtgcctgttacagttcataactgctgtttcttggttctgtttttttgaaacatttttcttggttc

SEQ ID NO: 92 - protein, 448 aa, Zea mays
  misc_feature (1)..(448): Ceres CLONE ID no.1386710
  misc_feature (1)..(448): Bit score of 1030.0 for HMM based on sequences of FIGURE 03.
  misc_feature (70)..(395): Pfam Name: Aminotran_3 Pfam Description: Aminotransferase class-III
  misc_feature (1)..(448): Functional Homolog Of Ceres SEEDLINE ID no. ME01463 at SEQ ID NO: 77
MASLGQITLPRAPSLQKGLLRRPIRTPIRFNGRIASVLTNAGSVKASVSQKVIEEEAKVLVGTYARAPVVLSSGKGCKLMDAEGKEYLDCASGIAVNALGHGDPDWLQAVTDQASVLSHVSNVYYTIPQIELAKRLVASSFADRVFFCNSGTEANEAAIKFSRKFQRFTHPEDKEVATSFIAFTNSFHGRTLGALALTSKEQYRTPFEPIMPGVTFLEYGNTQAATDLIRSGKIAAVFVEPIQGEGGVYSATKEFLQSLRSACDAAGSLLVFDEVQCGLGRTGNLWAYEAFGVTPDIMTVAKPLAGGLPIGAVLVTEKVAETIKYGDHGSTFAGNPLVCSAAIAVFDKVSKSSFLASVSSKGLYFKDLLVKKLGGNLHVKEVRGEGLIIGVELDVPAGPLVDACRDSGLLILTAGKGNVVRIVPPLIISEEEIERAVEIIFHDLTALD

SEQ ID NO: 93 - protein, 465 aa, Oryza sativa subsp. japonica
  misc_feature (1)..(465): Public GI ID no.115461885
  misc_feature (1)..(465): Bit score of 1061.8 for HMM based on sequences of FIGURE 03.
  misc_feature (84)..(408): Pfam Name: Aminotran_3 Pfam Description: Aminotransferase class-III
  misc_feature (1)..(465): Functional Homolog Of Ceres SEEDLINE ID no. ME01463 at SEQ ID NO: 77
MNSLQSFLALNPPAAAAALGGARLRPSRVTACLATPTPTPPPPTSAPLAPAAAAARRELSAASRAVVEDEARYIVGTYNRSRVVLVAGRGCKLYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 94 - DNA, 1401 bp, Sorghum bicolor
  misc_feature (1)..(1401): Ceres ANNOT ID no.6054519
  misc_feature (1)..(1401): Encodes the peptide sequence at SEQ ID NO 95
atgacctcgctccagtccttcctcgccatcaagccggccgccgccggctgggccgcgggcgcgcggcccgccgccgctccgcagtcccgccgcgcgcgcgtctcggcttgcctcgcggcgccgccgccgccgccgaccaccgcggcctctgccgtggggccggcgcggcgggagctgtcggccgcgagccgcgccgtcatggacgacgaggcgcggtacctcgtcggcacatacaagcggtcccgcgtcgtcttcgagtacgggcgcgggtgcaagctctacgacgtcgacggccgcgagtacctcgacatgtccgctggcatcgccgtcacggcgctcggccacgcggatcccgacgtgtgcgctaccatcgcggagcagagcggtaaaatcgtccacgtcagcaacgtcttctacactacaccccaggtggagctcgcgaagcggctcgtggaggtgtcgttcgcggaccgcgctttcttcgctagcactggcacggaggccaacgaggcggccatcaaattctcccgcaagttccagcgggtcgcccacccggacagtgacgatccgcccatggagttcttggcgttcagcagcagcttccatggccgaaccatgggcgcggtcgcgctcaccagcaagtcgcagtaccgggagcccttcgcgcccgtcatgcccggagtgaccttcgtggattacggcgatttggaggcggccaagaagttcatacagtccggtagggtcgctgctgtgttcgtcgagcccgtgcagggtgagggtggtattcacagcgccacacaggagttcttgcaggggctgcgggaggcctgtgatgaggcgggagccctcttggtctttgatgaggtgcaatgtggtttcgggcgcacaggttacctttgggcccatgaggcgtatggagtagaaccagacatcatgaccttagcaaagccattggccaacggtattccgataggtgttgtcttggtcaaggagaaggttgctgcagccataaactatggcgaccatggtacaacgttcggcggcggccctcttgcctgccagactgcgataaccgtgtttgacaaaatcatgaaacctgggttcttggctgaggtgtccaagaaaggggaaaacttcaagcagctcctccgcactaagctgagtggaaacccacacgtaaaggaggtccgtggggttggtcttcttgttggcattgagctagatgtaccagctggtcctctggtcgacgcatgcttggacgctggcgtcatagtgctgacggccggcaaaggcaatgttgtgaggctggtgccaccactcatcatctcagaaaaggagctggagcatgccgcggatgttataagggattgtctaccggtgcttgatgttgctgctgcttaa

SEQ ID NO: 95 - protein, 466 aa, Sorghum bicolor
  misc_feature (1)..(466): Ceres ANNOT ID no.6054519
  misc_feature (1)..(466): Bit score of 1048.9 for HMM based on sequences of FIGURE 03.
  misc_feature (84)..(409): Pfam Name: Aminotran_3 Pfam Description: Aminotransferase class-III
  misc_feature (1)..(466): Functional Homolog Of Ceres SEEDLINE ID no. ME01463 at SEQ ID NO: 77
MTSLQSFLAIKPAAAGWAAGARPAAAPQSRRARVSACLAAPPPPPTTAASAVGPARRELSAASRAVMDDEARYLVGTYKRSRVVFEYGRGCKLYDVDGREYLDMSAGIAVTALGHADPDVCATIAEQSGKIVHVSNVFYTTPQVELAKRLVEVSFADRAFFASTGTEANEAAIKFSRKFQRVAHPDSDDPPMEFLAFSSSFHGRTMGAVALTSKSQYREPFAPVMPGVTFVDYGDLEAAKKFIQSGRVAAVFVEPVQGEGGIHSATQEFLQGLREACDEAGALLVFDEVQCGFGRTGYLWAHEAYGVEPDIMTLAKPLANGIPIGVVLVKEKVAAAINYGDHGTTFGGGPLACQTAITVFDKIMKPGFLAEVSKKGENFKQLLRTKLSGNPHVKEVRGVGLLVGIELDVPAGPLVDACLDAGVIVLTAGKGNVVRLVPPLIISEKELEHAADVIRDCLPVLDVAAA

SEQ ID NO: 96 - DNA, 446 bp, Arabidopsis thaliana
  misc_feature (1)..(446): Ceres SEEDLINE ID no.ME01821
  misc_feature (1)..(446): Ceres CLONE ID no.25136
  misc_feature (1)..(446): Encodes the peptide sequence at SEQ ID NO. 97
aaaacgcaactaaggagaaaatgggtatgaagtctccaaatattgctgcatttatgttaccactgcttcttatacttttcacgctttcctctcagcttaaagtcgtggaatctacaggccgcaaacttgcgtgggggttttcgggaacacctatcgtgtacacaccaccttcaaggtcatgtggaacttctccagcagtattcacttcgaagtggaggagaccccgaccatgcaggcttcctccaggcagttatattcctgcttctgaccaatctccttaactacgtacttctgtgtctttgtgtcagagttttgaagttctatgcaataataaagtgtatgtggttttaagatttggtttacacatctaaaaacatgtgctcctttcaaatgatgtaaacaaaaagtattgtgtttaattaaaactaaaaataatattgttgatc

SEQ ID NO: 97 - protein, 86 aa, Arabidopsis thaliana
  misc_feature (1)..(86): Ceres SEEDLINE ID no.ME01821
  misc_feature (1)..(86): Ceres CLONE ID no.25136
MGLKSPNIAAFLLPLLLILFTLSSQLEVVESTGRKLAWEFSGTPIVYTPPSRSCGTSPAVFNSKWRRPRPCRLPPGSYIPASDQSP

SEQ ID NO: 98 - DNA, 1107 bp, Arabidopsis thaliana
  misc_feature (1)..(1107): Ceres SEEDLINE ID no.ME01910
  misc_feature (1)..(1107): Ceres CLONE ID no.1820
cttctcctcatcgcaaaattctccgacgcattacattttcttccgatcaatacagagagatcagtttctgagagagaagaagatgtctatagaggaagaaaacgttccaacgactgttgactcaggagctgccgatacaacggtgaaatctccggagaagaaaccggcggcgaaaggtggtaaatctaagaagacgacgacggctaaagcaacgaagaagcctgtgaaagctgctgctccaacgaagaagaaaacaacttcctctcaccctacctatgaagagatgattaaagatgcgattgtaacgttgaaggagagaactggatctagtcaatacgcgattcagaaattcatagaggagaaacataaatcactgcctcctacttttaggaagcttttgcttgtgaatctcaagagacttgttgcttctgagaaattggttaaagtcaaagcttcttttaagattccttctgctagatccgcagcaacacctaaaccggctgctccggttaagaagaaggcaactgtagtagctaaacctaagggtaaggttgctgctgctgttgctcctgctaaagctaaagcggcggctaaaggaactaagaagcctgcggctaaagttgttgctaaggctaaggttactgctaaacctaaggctaaggttactgctgctaaacctaagtctaagtctgttgctgctgtttccaagactaaagctgttgctgctaagcctaaggctaaggagagaccagctaaagcttctaggacttcgactagaacatctccagggaaaaaagttgctgctcctgctaagaaagtggctgtgactaagaaggctccggctaagagtgtgaaggtgaagtctccggcgaagagagcttcgactaggaaggctaagaagtgaagaagattggtttaggataggttttggggggagattgaatacatggtggtggttagcttctatagggtagtcttgtataattgaatcatccttgaaggagcttgctttccaaagttttttacttgtttctttggtttcttcttgaaacttttttttttcttctttgtaagttttggtttgtttgaattttaagctttttgacc

SEQ ID NO: 99 - DNA, 1107 bp, Arabidopsis thaliana
  misc_feature (1)..(1107): Ceres SEEDLINE ID no.ME01910
  misc_feature (1)..(1107): Ceres CLONE ID no.1820
  misc_feature (1)..(1107): Inplanta Sequence
  misc_feature (1)..(1107): Encodes the peptide sequence at SEQ ID NO. 100
cttctcctcatcgcaaaattctccgacgcattacattttcttccgatcaatacagagagatcagtttctgagagagaagaagatgtctatagaggaagaaaacgttccaacgactgttgactcaggagctgccgatacaacggtgaaatctccggagaagaaaccggcggcgaaaggtggtaaatctaagaagacgacgacggctaaagcaacgaagaagcctgtgaaagctgctgctccaacgaagaagaaaacaacttcctctcaccctacctatgaagagatgattaaagatgcgattgtaacgttgaaggagagaactggatctagtcaatacgcgattcagaaattcatagaggagaaacataaatcactgcctcctacttttaggaagcttttgcttgtgaatctcaagagacttgttgcttctgagaaattggttaaagtcaaagcttcttttaagattccttctgctagatccgcagcaacacctaaaccggctgctccggttaagaagaaggcaactgtagtagctaaacctaagggtaaggttgctgctgctgttgctcctgctaaagctaaagcggcggctaaaggaactaagaagcctgcggctaaagttgttgctaaggctaaggttactgctaaacctaaggctaaggttactgctgctaaacctaagtctaagtctgttgctgctgtttccaagactaaagctgttgctgctaagcctaaggctaaggagagaccagctaaagcttctaggacttcgactagaacatctccagggaaaaaagttgctgctcctgctaagaaagtggctgtgactaagaaggctccggctaagagtgcgaaggtgaagtctccggcgaagagagcttcgactaggaaggctaagaagtgaagaagattggtttaggataggttttggggggagattgaatacatggtggtggttagcttctatagggtagtcttgtataattgaatcatccttgaaggagcttgctttccaaagttttttacttgtttctttggtttcttcttgaaacttttttttttcttctttgtaagttttggtttgtttgaattttaagctttttgacc

SEQ ID NO: 100 - protein, 273 aa, Arabidopsis thaliana
  misc_feature (1)..(273): Ceres SEEDLINE ID no.ME01910
  misc_feature (1)..(273): Ceres CLONE ID no.1820
  misc_feature (1)..(273): Bit score of 421.0 for HMM based on sequences of FIGURE 04.
  misc_feature (61)..(130): Pfam Name: Linker_histone Pfam Description: linker histone H1 and H5 family
MSIEEENVPTTVDSGAADTTVKSPEKKPAAKGGKSKKTTTAKATKKPVKAAAPTKKKTTSSHPTYEEMIKDAIVTLKERTGSSQYAIQKFIEEKHKSLPPTFRKLLLVNLKRLVASEKLVKVKASFKIPSARSAATPKPAAPVKKKATVVAKPKGKVAAAVAPAKAKAAAKGTKKPAAKVVAKAKVTAKPKAKVTAAKPKSKSVAAVSKTKAVAAKPKAKERPAKASRTSTRTSPGKKVAAPAKKVAVTKKAPAKSAKVKSPAKRASTRKAKK

SEQ ID NO: 101 - protein, 261 aa, Volvox carteri
  misc_feature (1)..(261): Public GI ID no.585238
  misc_feature (1)..(261): Bit score of 255.7 for HMM based on sequences of FIGURE 04.
  misc_feature (58)..(129): Pfam Name: Linker_histone Pfam Description: linker histone H1 and H5 family
  misc_feature (1)..(261): Functional Homolog Of Ceres SEEDLINE ID no. ME01910 at SEQ ID NO: 100
MSETEAAPVVAPAAEAAPAAEAPKAKAPKAKAPKQPKAPKAPKEPKAPKEKKPKAAPTHPPYIEMVKDAITTLKERNGSSLPALKKFIENKYGKDIHDKNFAKTLSQVVKTFVKGGKLVKVKGSFKLSEALKAKAKKSTPKKAKADGEAKPKKSEAKPKKAEAVKKTKAPKEKVERPKKEKKEKVEKKKATPKAEKPKKAATPKSAGKKKATPKPKAAPKSPAKKDAKPKKATPSKKAAPKKAPAKKSTPKAKEAKSKGKK

SEQ ID NO: 102 - protein, 243 aa, Cryptomeria japonica
  misc_feature (1)..(243): Public GI ID no.90704789
  misc_feature (1)..(243): Bit score of 307.6 for HMM based on sequences of FIGURE 04.
  misc_feature (53)..(123): Pfam Name: Linker_histone Pfam Description: linker histone H1 and H5 family
  misc_feature (1)..(243): Functional Homolog Of Ceres SEEDLINE ID no. ME01910 at SEQ ID NO: 100
MATTEAVEEPVPVEATANEDAKPTEEKPAKEKKPKTPKEKKPRAAKGSKPPAAHPPYVQMIAEAITALKERGGSSPYAIAKFLGDKYKADLPPNFKKQLNVQLKNLTKSGKLTKVKASYKLTAPKAPAAPKPKKEKKTVAKKKAPKPKVPAAKPKAPAAKAAKPKAAKKAAPAKPAAPAPPKKEEKPAAAAPKKAAPAAKPKKPAAKPKKAATPKKPAPKPKPAKKAATPKKKAGRPAKKAKK

SEQ ID NO: 103 - DNA, 730 bp, Gossypium hirsutum
  misc_feature (1)..(730): Ceres CLONE ID no.1932398
  misc_feature (1)..(730): Encodes the peptide sequence at SEQ ID NO 104
aaatcatgctcgagttcaagtttttggtgccgtagcttgtctctcatgtcctattagggtcctgtttgcatccaaccagttgtttccaagagctaggctttgatacttaaaataagaaccactatgggtatttctagttatagtttctttctgtttttatttgttgtcataatcccaaccctagaagctcatatcgctgagtatgacgagtactggacggcacgagaattggaagccattgagaacctggacaaggcctatcactccaacccggaggaggtggtccgccattacaatgaccacttctctaggaccatgctcgagttttatatcaccaaaagggtgttggcagaatcaaaaaagggtccctgtgaggttaccaaccacgttgacagttgctggcgatgtgatcctgactgggaaaagaataggaagaagttggccaactgtgcccctggatttgctcgaggtactaccggtggaaaggatggtgagttttacgtggtcactgaccctattgataatgctgctgaccccaagcctggaactctgcgtcatgctgtcacccaaactggaccactttggatcactttcaaagggtccatgaccatcaagctgcaacaggagctcattgttacaagtgataagaccattgatgcgaggggagccaatgtggaaatttgtaatggtgctggtatcactatccaatttgtgaagaatatcattatcc

SEQ ID NO: 104 - protein, 280 aa, Gossypium hirsutum
  misc_feature (1)..(280): Ceres CLONE ID no.1932398
  misc_feature (1)..(280): Bit score of 453.0 for HMM based on sequences of FIGURE 04.
  misc_feature (55)..(124): Pfam Name: Linker_histone Pfam Description: linker histone H1 and H5 family
  misc_feature (1)..(280): Functional Homolog Of Ceres SEEDLINE ID no. ME01910 at SEQ ID NO: 100
MATEEPAVVADPAPETEEDKTAETKATSKSGRAKKTKEPKTKKAAAPRKPRAAPTHPPYEEMIKDAIVTLKERTGSSQYAIAKFIEEKQKNLPGNFKKLLLVHLKKLVAAGKLVKVKASYKLPSARSSKTATAASAPAKKKTATTKSKSKPASKPKEGKSTKATPKAKAKTKTTSKAKSKPAAKPKATSKAKAAPAKTKAVASVKPKTTAATKPKAAAKPKDKPVKASRTSTRTSPGKRAAAPKPAAKKAPAAKKAPAKSVKPKSVKSPAKKATSRRGKK

SEQ ID NO: 105 - DNA, 1237 bp, Gossypium hirsutum
  misc_feature (1)..(1237): Ceres CLONE ID no.1793790
  misc_feature (1)..(1237): Encodes the peptide sequence at SEQ ID NO 106
acaacgaaattaccagtacatcttcgctttgagattagatccaaaattctcctttcctcttatttccgattccccaatttttcctgaaaccctaatcctaatcccagattcctcctgtctacatcgtttagcaaatggcaaccgaggacccggcagtcgtggcagaccccgcacccgagacggaggaggacaagactgctgagaccaaagctacttcaaaatccggcagagcaaagaaagccaaagaacccaaaaccaagaaagctgcagctcctaggaaaccacgggctgctcctactcatcctccttacgaagagatgatcaaagatgcgatcgttactttgaaagagaggacaggttcaagtcagtacgccattgctaagttcattgaagagaagcagaagaatcttcctggaaatttcaagaagcttctgcttgtccatttgaagaagcttgtggctgctgggaagttggttaaagttaaggcttcgtataaacttccttctgctaggtcttcgaagacggctactgctgcttctgctcctgcaaaaaagaaaccggctactactaagtcgaagtctaagcctgcctcaaagcctaaggaagggaagagtacaaaaactactcctaaagcaaaggccaagacaaaaactacttcgaaggctaagagtaagccggcggctaagccaaagcctacttctaaggcgaaggctgctccagccaagactaaggcagtggcttctgtgaagccgaagactactgcagctacaaagtcaaaagctgcagccaagcctaaggacaagccggttaaggcttcgaggacttcaactaggacgtctcccggaaagagggctgctgctcccaagcctgctgcgaagaaggctcctgcggctaaaaaagctcctgcgaagagtgtaaagccgaagagtgtcaagtcaccggcgaagaaagccccgtcgaggaggggaaagaaatgagagaagagagggtggtcaacataggggtagttttgtaaattcgagtgaagcttagtggctgtatttgggtccatacccatgaaaatatgacatcggatcttatctgttcttgaacttttcttcgaggggttgtttttttttttgttgttgttgattgacgctaaatttctaaattccttagtttttaaagcagattttagatgtaatttttcagttgaatggattatgagatgaaatcagagctccctgatattttatcg

SEQ ID NO: 106 - protein, 280 aa, Gossypium hirsutum
  misc_feature (1)..(280): Ceres CLONE ID no.1793790
  misc_feature (1)..(280): Bit score of 447.6 for HMM based on sequences of FIGURE 04.
  misc_feature (55)..(124): Pfam Name: Linker_histone Pfam Description: linker histone H1 and H5 family
  misc_feature (1)..(280): Functional Homolog Of Ceres SEEDLINE ID no. ME01910 at SEQ ID NO: 100
MATEDPAVVADPAPETEEDKTAETKATSKSGRAKKAKEPKTKKAAAPRKPRAAPTHPPYEEMIKDAIVTLKERTGSSQYAIAKFIEEKQKNLPGNFKKLLLVHLKKLVAAGKLVKVKASYKLPSARSSKTATAASAPAKKKPATTKSKSKPASKPKEGKSTKTTPKAKAKTKTTSKAKSKPAAKPKPTSKAKAAPAKTKAVASVKPKTTAATKSKAAAKPKDKPVKASRTSTRTSPGKRAAAPKPAAKKAPAAKKAPAKSVKPKSVKSPAKKAPSRRGKK

SEQ ID NO: 107 - DNA, 861 bp, Populus balsamifera subsp. trichocarpa
  misc_feature (1)..(861): Ceres ANNOT ID no.1442808
  misc_feature (1)..(861): Encodes the peptide sequence at SEQ ID NO 108
atgtcatctgatgaacccaccgtcgccgtcgatggcagcaccgaaccaacatccgctgagccggctgatgataagccagccgccaaacccagcagagccaagaaaactaaagaacccaaagccaaaaaggctcctgccccaaaaaaaccccgtcatcgtaccccctcctctcaccctccttacgaagagatgattaaggatgctatagtgacattgaaggagaagacaggttcaagccagtacgcgattactaagtttctcgaggagaaacacaagcaacttccctcgaattttaagaaactcttgctgtttcatttgaagaagcttgtgatttctgataagattgttaaagtaaaaggatccttcaagcttccatcggcaaaatcatcggcaccagctaaaccagctgctgcttctccggctaaaaagaagacggcaactgctgccaagccaaaggctaaatctaagccagcttattccaaggcgaaggaaactaagtctgccaagtcgactgctaagtcaccagcaaagtctaaagcagctgccaagccgaaggctaagccaaaggctgcagctgccaagccgaaagttaccgctaaggcaaaaccaaaggctgctccagctaaggctaagacctctgttgcaaagcccaaggcagctccagctaagcctaaggctaaggagagaccggctaaagcttcgaggacttcaacgagaacatctcctgggaagaaagcggcagcaaccaaagtcgcgccgaagaaggcggcaaccccgaaaaaagccccagcgaagaccgtaaagctgaagagtgttaagactccgacgaagaaagcagcagtgaagaaaggaaagaaatga

SEQ ID NO: 108 - protein, 286 aa, Populus balsamifera subsp. trichocarpa
  misc_feature (1)..(286): Ceres ANNOT ID no.1442808
  misc_feature (1)..(286): Bit score of 473.8 for HMM based on sequences of FIGURE 04.
  misc_feature (57)..(126): Pfam Name: Linker_histone Pfam Description: linker histone H1 and H5 family
  misc_feature (1)..(286): Functional Homolog Of Ceres SEEDLINE ID no. ME01910 at SEQ ID NO: 100
MSSDEPTVAVDGSTEPTSAEPADDKPAAKPSRAKKTKEPKAKKAPAPKKPRHRTPSSHPPYEEMIKDAIVTLKEKTGSSQYAITKFLEEKHKQLPSNFKKLLLFHLKKLVISDKIVKVKGSFKLPSAKSSAPAKPAAASPAKKKTATAAKPKAKSKPAYSKAKETKSAKSTAKSPAKSKAAAKPKAKPKAAAAKPKVTAKAKPKAAPAKAKTSVAKPKAAPAKPKAKERPAKASRTSTRTSPGKKAAATKVAPKKAATPKKAPAKTVKLKSVKTPTKKAAVKKGKK

SEQ ID NO: 109 - DNA, 858 bp, Populus balsamifera subsp. trichocarpa
  misc_feature (1)..(858): Ceres ANNOT ID no.1452631
  misc_feature (1)..(858): Encodes the peptide sequence at SEQ ID NO 110
atgtcctctgacgaacccactgtcaccgtcgatggtagcaccgaaccgccaacttctgaaccagctgatggtaagccggccaccaaacccagcagagctagaaaagccaaggaatctaaagccaaaaaagctcctgcccctaaaaaactccgtcctcgttccccttccgctcaccctccttatgaagagatggtcaaggatgctatagtgacattgaaagagaagacaggttcgagccagtacgcgattaccaagtttctcgaagagaaacacaaacaactgccatcgaattttaagaagcttctgttgtttcatttgaagaagctcgtggctgccggtaagattgttaaagtcaaaggatccttcaagcttccatcggctaaatcatccgctccagctaaaccagctgctgcttctccggctaaaaagaagccggcaactgctgccaagccaaaggctaaatctaagccagctgctcccaaggctaaggaaactaagtctaccaagtcgacggttaagtcaccggcgaagtctaaagcagctgccaagccgaagcctaagccaaaagctgcagctgctaagccaaaggctaccgccaaggcaaaaccaaaggctgctccagctaaggctaaaaccgctgctgcaaagcctaagacgacaccggcaaagcccaaggccaaggagagaccggctaaagctttgaggacttcgtcgagaacatctcctggaaagaaagcggtgacaaccaaagccacgtcgaagaaggcaccggctaaaactgttaagccgaagagcgttggcgccccgaagaagaaagtagcagcgaagaaagtagcagcgaagaaaggaaagaagtga

SEQ ID NO: 110 - protein, 285 aa, Populus balsamifera subsp. trichocarpa
  misc_feature (1)..(285): Ceres ANNOT ID no.1452631
  misc_feature (1)..(285): Bit score of 393.3 for HMM based on sequences of FIGURE 04.
  misc_feature (57)..(126): Pfam Name: Linker_histone Pfam Description: linker histone H1 and H5 family
  misc_feature (1)..(285): Functional Homolog Of Ceres SEEDLINE ID no. ME01910 at SEQ ID NO: 100
MSSDEPTVTVDGSTEPPTSEPADGKPATKPSRARKAKESKAKKAPAPKKLRPRSPSAHPPYEEMVKDAIVTLKEKTGSSQYAITKFLEEKHKQLPSNFKKLLLFHLKKLVAAGKIVKVKGSFKLPSAKSSAPAKPAAASPAKKKPATAAKPKAKSKPAAPKAKETKSTKSTVKSPAKSKAAAKPKPKPKAAAAKPKATAKAKPKAAPAKAKTAAAKPKTTPAKPKAKERPAKALRTSSRTSPGKKAVTTKATSKKAPAKTVKPKSVGAPKKKVAAKKVAAKKGKK

SEQ ID NO: 111 - protein, 273 aa, Arabidopsis thaliana
  misc_feature (1)..(273): Public GI ID no.15224536
  misc_feature (1)..(273): Bit score of 422.1 for HMM based on sequences of FIGURE 04.
  misc_feature (61)..(130): Pfam Name: Linker_histone Pfam Description: linker histone H1 and H5 family
  misc_feature (1)..(273): Functional Homolog Of Ceres SEEDLINE ID no. ME01910 at SEQ ID NO: 100
MSIEEENVPTTVDSGAADTTVKSPEKKPAAKGGKSKKTTTAKATKKPVKAAAPTKKKTTSSHPTYEEMIKDAIVTLKERTGSSQYAIQKFIEEKHKSLPPTFRKLLLVNLKRLVASEKLVKVKASFKIPSARSAATPKPAAPVKKKATVVAKPKGKVAAAVAPAKAKAAAKGTKKPAAKVVAKAKVTAKPKAKVTAAKPKSKSVAAVSKTKAVAAKPKAKERPAKASRTSTRTSPGKKVAAPAKKVAVTKKAPAKSVKVKSPAKRASTRKAKK

SEQ ID NO: 112 - DNA, 982 bp, Glycine max
  misc_feature (1)..(982): Ceres CLONE ID no.1104700
  misc_feature (1)..(982): Encodes the peptide sequence at SEQ ID NO 113
tcaaaaaaaaaactttcaaatccctagaaagatgtcgacggaggaagaaaccaaggtggttgtcgagtcaggagacgccgaagcgacggtgacggagaagaagcctgctgcgaaaggcggcgctaaagctaagaagacgccggcgaagaagaagcctgctgctgctccgaggaagagaaccacttcgtctcaccctccttacgaagagatgatcaaagacgcgatcgtgacgctgaaggagagaaccggatctagccaatacgcgattcagaagttcatcgaggagaagcagaagtcgcttcctccaactttcaggaagcttctcctcgtcaatctcaggagactcgtcgcttccgggaagctagtcaaagtcaaagcctctttcaagattccgtctgcggctaaaccggcggctacgactaaaccggttaacaagaaaccagctgctgctgttactaaaccgaagggtaaagctcctgctaaggccaaaccggctgctaaaggagccaagaaacctgctgctgctgctaagcctaaggcaaagacaacagcatcaactaaagccgctgcgaagcccaaacctaagacgaagagtgtagctgctgtttcaaagaccaaggcggttgctgcgaagcctaaggcgaaggagagacctgttaaagcgtcgaggacttcgactaggacgtctccagggaagaaggcagcagctccggctaagaaagctgctgctgctgcgactaagaaggctccggctaagagtgtgaaggttaaatctccagcgaagagggcttcgacgaggaagaagtgattggttttagcttctcttagggttaaagtctttgtataattgaatcgtctatgaagggggcttgttttttcttcttccaaagtttatctttgtcttggtttcttctcgaaacccttttatcttgtaatttttggtttgtttgaaaattcaatagctatatgtgatggggtttgc

SEQ ID NO: 113 - protein, 258 aa, Glycine max
  misc_feature (1)..(258): Ceres CLONE ID no.1104700
  misc_feature (1)..(258): Bit score of 407.0 for HMM based on sequences of FIGURE 04.
  misc_feature (53)..(122): Pfam Name: Linker_histone Pfam Description: linker histone H1 and H5 family
  misc_feature (1)..(258): Functional Homolog Of Ceres SEEDLINE ID no. ME01910 at SEQ ID NO: 100
MSTEEETKVVVESGDAEATVTEKKPAAKGGAKAKKTPAKKKPAAAPRKRTTSSHPPYEEMIKDAIVTLKERTGSSQYAIQKFIEEKQKSLPPTFRKLLLVNLRRLVASGKLVKVKASFKIPSAAKPAATTKPVNKKPAAAVTKPKGKAPAKAKPAAKGAKKPAAAAKPKAKTTATTKAAAKPKPKTKSVAAVSKTKAVAAKPKAKERPVKASRTSTRTSPGKKAAAPAKKAAAAATKKAPAKSVKVKSPAKRASTRKK

SEQ ID NO: 114 - DNA, 1243 bp, Glycine max
  misc_feature (1)..(1243): Ceres CLONE ID no.482104
  misc_feature (1)..(1243): Encodes the peptide sequence at SEQ ID NO 115
  misc_feature (857)..(857): y is t/u or c
  misc_feature (1009)..(1009): y is t/u or c
atttccatggccacagaagagcccactgtcgcggtggaacccgctcccgaacctgcctccgccgatcctcccccggaggagaaggaggagaccaaacctgaagccaaggctaagaaaaccaaggagcccaaacctaaaaaggtttccagacctcgcaaccctcccactcatccttcctacgaagagatggttaaagatgcaattacctcgctgaaggagaaaaccggttcgagccaatacgcgattgcgaagttcatcgaggagaagcacaagcagcttccaccgaacttcaagaagcttcttctctaccatttgaagaagctcgtcgccgccggaaaactcgtcaaagtcaaaggctcgttcaagctcccacctaccagacctgctgcatcttcttcttcttcttcttcgccggcaaagaagaaaaagcccgcagctgccaagtccaagcctaagcctaagcccaagcccgctgcgaaagccaaggatactaaggcaactaaatcgaaggcaccagctaagcccaagccagctgctaagcctaaagccaaagctccagccaaggccaaacccgctgctaaaccaaaggcttctgctgctgccaagcccaagcctgctgccgccaagcccaaagccgctaaaccagctgccaagtccaagcctgctgctaaaacaaaggctgttcctgccaagcccgcggcaaagcccaaagccaagcccgtcaaggcttcaaggacgtcgacgaggacttcaccagggaagaaagcagctcctgctgctaagcccgcggcgaagaaagttgcggtggcagcgaagaaaacgccagtgaagagtgtgaaaccgaagagtgtaaagtytccggccaaaaaggctacggccaagagagggggtaggaagtgagaaagagtggtcggtggggtagggttgttttggggttggtgttgtgaagttctttgtcctcttggtgtagttgggggttacagatgatgttcctataacagatgaaatytgattttatgaaacctttgttatttccctttttagttttgatttttttttggttcgacctaggaagtagataaaaacaatgtttctagctatgcctttcagctaaatgagttaatcataaaatgtatcttagagtgtgaggtttctttgcgttatagtacctttgatggatcgatgtagtataagcacctttttcacatgaatggatttgtagtatatgctttctgtgtatttg

SEQ ID NO: 115 - protein, 297 aa, Glycine max
  misc_feature (1)..(297): Ceres CLONE ID no.482104
  misc_feature (1)..(297): Bit score of 377.3 for HMM based on sequences of FIGURE 04.
  misc_feature (54)..(123): Pfam Name: Linker_histone Pfam Description: linker histone H1 and H5 family
  misc_feature (1)..(297): Functional Homolog Of Ceres SEEDLINE ID no. ME01910 at SEQ ID NO: 100
  misc_feature (284)..(284): Xaa is any aa, unknown or other
MATEEPTVAVEPAPEPASADPPPEEKEETKPEAKAKKTKEPKPKKVSRPRNPPTHPSYEEMVKDAITSLKEKTGSSQYAIAKFIEEKHKQLPPNFKKLLLYHLKKLVAAGKLVKVKGSFKLPPTRPAASSSSSSSPAKKKKPAAAKSKPKPKPKPAAKAKDTKATKSKAPAKPKPAAKPKAKAPAKAKPAAKPKASAAAKPKPAAAKPKAAKPAAKSKPAAKTKAVPAKPAAKPKAKPVKASRTSTRTSPGKKAAPAAKPAAKKVAVAAKKTPVKSVKPKSVKXPAKKATAKRGGRK

SEQ ID NO: 116 - protein, 306 aa, Medicago truncatula
  misc_feature (1)..(306): Public GI ID no.32966575
  misc_feature (1)..(306): Bit score of 386.6 for HMM based on sequences of FIGURE 04.
  misc_feature (61)..(130): Pfam Name: Linker_histone Pfam Description: linker histone H1 and H5 family
  misc_feature (1)..(306): Functional Homolog Of Ceres SEEDLINE ID no. ME01910 at SEQ ID NO: 100
MTSSVEEPTVSAVEQTIVEEPAAVDPLPPVVNESDEPTAAKPKKAPKEPKPRKPASKNTRTHPTYEEMVTDAIVTLKEKNGSSQYALAKFIEEKHKNLPANFKKILLVQIKKLVASGKLVKVKGSYKLPAKSAAPAKKPAAAKPKPKPKAKAPVAKAPAAKSKAKAAPAKAKAKAKAKAAPAKAKPAAKAKPAAKAKPAAKAKPVAKAKPKAKAPVAKANAVPVAAKAKPAAKAKPAAKAKPAARPAKASRTSTRTSPGKRAAAAKPAVKKAATPVKKAVPAKKAATPVKKAAPARKAPAKRGGRK

SEQ ID NO: 117 - protein, 297 aa, Pisum sativum
  misc_feature (1)..(297): Public GI ID no.4996567
  misc_feature (1)..(297): Bit score of 429.4 for HMM based on sequences of FIGURE 04.
  misc_feature (57)..(126): Pfam Name: Linker_histone Pfam Description: linker histone H1 and H5 family
  misc_feature (1)..(297): Functional Homolog Of Ceres SEEDLINE ID no. ME01910 at SEQ ID NO: 100
MASEEPTTVAVEQPIVEEPEAVDTFPPVVNESEEPTAKPKKAPKEPKAKKAPAKPRTHPTYEEMVKEAIVALKERNGSSQYAIAKFIEEKHKQLPSNFKKLLLVQIRKLVASGKLVKVKASYKLPAKSSAAKPAKKPAAAKSKAKPKAKAATKSKAKPAAKAKPAAKAKPAAKAKPAAKAKPAAKAKPAAKAKPAAKPVKTAAAKPAAKAKPAAKPKAAAKAKPAAKAKPAAKAKPAAKPAKAARTSTRTSPAAAAAAPKPAAKKAAPVKKTPVKAAAKAKTAKSPAKKAAAKRGKK

SEQ ID NO: 118 - protein, 229 aa, Euphorbia esula
  misc_feature (1)..(229): Public GI ID no.62286644
  misc_feature (1)..(229): Bit score of 310.4 for HMM based on sequences of FIGURE 04.
  misc_feature (50)..(119): Pfam Name: Linker_histone Pfam Description: linker histone H1 and H5 family
  misc_feature (1)..(229): Functional Homolog Of Ceres SEEDLINE ID no. ME01910 at SEQ ID NO: 100
MADTPVSAPVVPEVTERKSKRGTKAAAVKVPKEKKKVIAAKKPKSKGTSSHPSFFEMISDAISTLKERTGSSQYAINKFVEDKHKQLPSNFRKLLLFHLKKLVASGKLVKVKNSFKLPSARAAPAPALAKKPTIPKPKVAAKPKTAKIGAKPKAKAKVAAKTKATTKTVAKKIPAAKPKAKTAGKPKTVAAKPAKVAKTAAVASPGKKKAVPVKKVKTVKSPAGKRTRK

SEQ ID NO: 119 - protein, 302 aa, Apium graveolens
  misc_feature (1)..(302): Public GI ID no.2623960
  misc_feature (1)..(302): Bit score of 421.5 for HMM based on sequences of FIGURE 04.
  misc_feature (60)..(129): Pfam Name: Linker_histone Pfam Description: linker histone H1 and H5 family
  misc_feature (1)..(302): Functional Homolog Of Ceres SEEDLINE ID no. ME01910 at SEQ ID NO: 100
MAAVEDPIVPMEGVEEEVPVTVTEAPEEAAPPAEDPAPKKGKELKPKKAAAPRKPRSAPAHPPYLEMITDAITSLKERTGSSQQAIQKFLEAKHKDLPAVFRKMLSNNLKKLVAAGKLVKVKASYKLPSAKSSAPAKKKPAAAPAKKKAAAAPAKKKTAAAPKKKAAAAPKKKAPVAKAKPAAKPKAKAVVKPKAKAAVKPKAKPAAKPAAKAKPAAKAKPAAKPKAKAKPAKVARTSTRTTPGKKAPAKPAAAPVKKATPVKKATATPVKKAAPVKKAAPAKGKSVKTPVKRTSARKAGKK

SEQ ID NO: 120 - protein, 287 aa, Solanum lycopersicum
  misc_feature (1)..(287): Public GI ID no.585241
  misc_feature (1)..(287): Bit score of 451.9 for HMM based on sequences of FIGURE 04.
  misc_feature (55)..(124): Pfam Name: Linker_histone Pfam Description: linker histone H1 and H5 family
  misc_feature (1)..(287): Functional Homolog Of Ceres SEEDLINE ID no. ME01910 at SEQ ID NO: 100
MATEEPVIVNEVVEEQAAPETVKDEANPPAKSGKAKKETKAKKPAAPRKRSATPTHPPYFEMIKDAIVTLKERTGSSQHAITKFIEEKQKSLPSNFKKLLLTQLKKFVASEKLVKVKNSYKLPSGSKPAAAAVPAKKKPAAAKSKPAAKPKAAVKPKAKPAAKAKPAAKAKPAAKAKPAAKAKPAAKAKPAAKAKPVAKAKPKAAAAAKPKAAVKPKAAPAKTKAAVKPNLKAKTTTAKVAKTATRTTPSRKAAPKATPAKKEPVKKAPAKNVKSPAKKATPKRGRK

SEQ ID NO: 121 - protein, 271 aa, Solanum lycopersicum
  misc_feature (1)..(271): Public GI ID no.3021487
  misc_feature (1)..(271): Bit score of 373.9 for HMM based on sequences of FIGURE 04.
  misc_feature (56)..(125): Pfam Name: Linker_histone Pfam Description: linker histone H1 and H5 family
  misc_feature (1)..(271): Functional Homolog Of Ceres SEEDLINE ID no. ME01910 at SEQ ID NO: 100
MATEEPVVAIEPVNEPMVVAEPATEENPPAETDEPKKEKEIKAKKSSAPRKRNPPTHPSYFEMIKEAIVTLKDKTGSSQYAITKFIEDKQKNLPSNFRKMLLAQLKKLVASGKLVKVKSSYKLPAPKAAAPALAKKKSIAKPKAAQAKKATKAKPKPKPKVAAPKAKTATKSKAKPKPVVAAKAKPAAKPKAVVAKPKAAVKPKAPVKAKAAVKPKAANEKPAKVARTSTRSTPSRKAAPKPAVKKAPVKSVKSKTVKSPAKKASARKAKK

SEQ ID NO: 122 - protein, 282 aa, Nicotiana tabacum
  misc_feature (1)..(282): Public GI ID no.790929
  misc_feature (1)..(282): Bit score of 447.6 for HMM based on sequences of FIGURE 04.
  misc_feature (58)..(127): Pfam Name: Linker_histone Pfam Description: linker histone H1 and H5 family
  misc_feature (1)..(282): Functional Homolog Of Ceres SEEDLINE ID no. ME01910 at SEQ ID NO: 100
MATEEPLVVTEIVTEAVVVEAEPAKEENSPAAEPDEPKKEKEIEAKKPAAPRKRNPPTHPSYFEMIKDAIVTLKDKTGSSQHAITKFIEDKQKNLPSNFRKLLLVQLKKLVASGKLVKVKSSYKLPAARSAAPKAAATAPAKKKPGAKPKATKAKPKPKPKTVAPKAKTATKPKAKQRQVKAKLVAKAKPAVKPKAAAVAMPKAAEKPKTPVKTKAAAKPKAKEKPAKVARTATRSTPSRKAAPKPVAKKVPVKKAAPAAKSVKAKTAKSPAKRASARKGRK

SEQ ID NO: 123 - protein, 279 aa, Nicotiana tabacum
  misc_feature (1)..(279): Public GI ID no.6681423
  misc_feature (1)..(279): Bit score of 433.5 for HMM based on sequences of FIGURE 04.
  misc_feature (58)..(127): Pfam Name: Linker_histone Pfam Description: linker histone H1 and H5 family
  misc_feature (1)..(279): Functional Homolog Of Ceres SEEDLINE ID no. ME01910 at SEQ ID NO: 100
MATEEPVVATEIVTEPAVVEAEPAKEDNPPAVESDEPKKEKETKAKKPAAPRKRNPPTHPSYFEMIKDAIVTLKDKTGSSQHAITKFIEDKQKNLPSNFRKLLLVQLKKLVASGKLVKVKSSYKLPAARSAAPKAAATAPVKKKPAAKPKATKAKPKPKPKTVAPKAKTATKPKAKPKPKAKLVAKAKPAVKPKAAAVAKPKAAEKPKTPVKTKAAAKPKEKPAKVARTATRSTPSRKAAPKPVAKKAPVKKAAPAAKSVKAKTAKSPAKRASARKGRK

SEQ ID NO: 124 - DNA, 1154 bp, Triticum aestivum
  misc_feature (1)..(1154): Ceres CLONE ID no.579112
  misc_feature (1)..(1154): Encodes the peptide sequence at SEQ ID NO 125
ctcacccaccaccgcgcctcagctcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagccctccgccccgaggaagccccgcgccacccccgcccacccgacctacgccgagatggtgtcggaggccatcaccgccctgaaggagcggacggggtcgagccagtacgccatcgccaagttcgtcgaggacaagcacaaggcgcacctcccggccaacttccgcaagattctgtcggtgcagctcaagaagctggtcgcctccggcaagctgaccaaggtcaaggcctcgtacaagctgtcggccgccgcggccaagcccaagccggcggcgaagaagaagcccgcggcgaagaagaaggcgccagccaagaagaccgccaccaagaccaaggccaaggcgcccgccaagaaggccgccgcgaagcccaaggccaaggcgcccgccaagcccaaggccgccgcgaagcccaaggccgccgcgaagcccaaggccaaggccgccgcgaagcccaaggctgccgccaagcccaagggccgccccgccaaggctgccaagacctcggccaaggacgcgccagggaagaaggcccctgccgccgcggcgcccaagaaggccgccgccaggaagccgcccaccaagagatccacgccggtgaagaaggccgcgcccgccaagaaggctgcgccggcgaagaaggccccggccgccaagaaggccaagaagtagatccttggagggagatcctagggcttggcgatagttttccagtagcagtttttcctgttctgtgctgttagtcgagatgtccgggctgtgtcgggggtgctaggctgtaaatttgaaatctgggttggggtgcactggtgatcctgtgcacccctttgtgtgtgttgtgagaaacggtggcgacgatcgcgttgtagcaagcttatgtatttgtgtaactgaattgggtaattgaatcttcattttagct

SEQ ID NO: 125 - protein, 270 aa, Triticum aestivum
  misc_feature (1)..(270): Ceres CLONE ID no.579112
  misc_feature (1)..(270): Bit score of 418.3 for HMM based on sequences of FIGURE 04.
  misc_feature (60)..(130): Pfam Name: Linker_histone Pfam Description: linker histone H1 and H5 family
  misc_feature (1)..(270): Functional Homolog Of Ceres SEEDLINE ID no. ME01910 at SEQ ID NO: 100
MSTDVAADVPAPEVEVAADPVVETTAEAAAGDAKPAKETKAKAAKAKKPSAPRKPRATPAHPTYAEMVSEAITALKERTGSSQYAIAKFVEDKHKAHLPANFRKILSVQLKKLVASGKLTKVKASYKLSAAAAKPKPAAKKKPAAKKKAPAKKTATKTKAKAPAKKAAAKPKAKAPAKPKAAAKPKAAAKPKAKAAAKPKAAAKPKGRPAKAAKTSAKDAPGKKAPAAAAPKKAAARKPPTKRSTPVKKAAPAKKAAPAKKAPAAKKAKK

SEQ ID NO: 126 - protein, 275 aa, Triticum aestivum
  misc_feature (1)..(275): Public GI ID no.5230785
  misc_feature (1)..(275): Bit score of 384.1 for HMM based on sequences of FIGURE 04.
  misc_feature (60)..(130): Pfam Name: Linker_histone Pfam Description: linker histone H1 and H5 family
  misc_feature (1)..(275): Functional Homolog Of Ceres SEEDLINE ID no. ME01910 at SEQ ID NO: 100
MSTDVVADVPAPEVAAAADPVVETTAEPAAGDANAAKETKAKAAKAKKPSAPRKPRAAPAHPTYAEMVSEAITALKERTGSSPYAIAKFVEDKHKAHLPANFRKILSVQLKKLVASGKLTKVKASYKLSAAAAKPKPAAKKKPAAKKKAPAKKTATKTKAKAPAKKSAAKPKAKAPAKTKAAAKPKAAAKPKAKAPAKTKAAAKPKAAAKPKGPPAKAAKTSAKDAPGKNAGAAAPKKPAARKPPTKRSTPVKKAAPAKKAAPAKKAPAAKKAKK

SEQ ID NO: 127 - DNA, 1265 bp, Triticum aestivum
  misc_feature (1)..(1265): Ceres CLONE ID no.1325589
  misc_feature (1)..(1265): Encodes the peptide sequence at SEQ ID NO 128
tcacccagctcacacgcatctctctcacctccggcgaaaacacaccagcgcgctcctctctcccctcgcttccccgccgcaatgtcgaccgacgccgctgccgccgacatcccggtgcctcaggtggaggcgaccgccgaccccgtcgcggagaccaccgctgccgccgccgccggcgacgcgaagccggccaaggcgaccaaggccaaggccgccaagacccccaaggcgcccaaggcgaagaagccctccgccccgaggaagcccaaggccacccccgcccacccgacctacgctgagatggtgtcggaggcgatcaccacgctgaaggagagaggcgggtcgagcaccgtggccatcggcaagttcatcgaggacaagcacaaggcgcacctcccggccaacttccgcaagatcatgctgacgcagatcaagaagctcgtcgccgccggcaagctgaccaaggtcaaggcctcctacaagctcgccaaggcccccgcagcgcccaagaagcccaagaccaaggtgccagccaagaagaagccggcggcgaagaagaaggccccggccaagaagcccgccgccaagtccccagccaagaagaaggccgccgccaagcccaaggccaaggccccagccaagaccaaggccgccgccaagcccaaggcggcagcgaagcccaaggcagccgccaagaccaaggctccagccaagaccaccaaggccgccgcgaagcccaagccggccgccaaggcgaaggcgcccgccaagccgaagggccgccccgccaaggccgccaagacctccgccaaggacgcgccagggaggaaggcgcccgccgccgccgccacccccaagaaggccgcccccaggaagccgcccaccaagcggtcggcgccggtgaagaaggccacgcccgccaagaaggcccccgccaagaaggccaagaagtagagcgtctccgtcctcccgcaacaagtttccattcccctgttctgtgtcggtggtagtccaggattctgtgttctagactgtaaattttatatccgggttgtgggtgctctggttcattccggcgtacccttggaggtgtatctgtgggtgaaacgatgacgacgacgacggcggtggcgagggctttgtcccccggcctccgcattaccgtagcagcttgatttgtcgaggttttttagcgtagcaagatccttgtggtggtgtcgaaaacaaatagtgcattgtttatctaattaattatgattatgatg

SEQ ID NO: 128 - protein, 290 aa, Triticum aestivum
  misc_feature (1)..(290): Ceres CLONE ID no.1325589
  misc_feature (1)..(290): Bit score of 335.6 for HMM based on sequences of FIGURE 04.
  misc_feature (67)..(137): Pfam Name: Linker_histone Pfam Description: linker histone H1 and H5 family
  misc_feature (1)..(290): Functional Homolog Of Ceres SEEDLINE ID no. ME01910 at SEQ ID NO: 100
MSTDAAAADIPVPQVEATADPVAETTAAAAAGDAKPAKATKAKAAKTPKAPKAKKPSAPRKPKATPAHPTYAEMVSEAITTLKERGGSSTVAIGKFIEDKHKAHLPANFRKIMLTQIKKLVAAGKLTKVKASYKLAKAPAAPKKPKTKVPAKKKPAAKKKAPAKKPAAKSPAKKKAAAKPKAKAPAKTKAAAKPKAAAKPKAAAKTKAPAKTTKAAAKPKPAAKAKAPAKPKGRPAKAAKTSAKDAPGRKAPAAAATPKKAAPRKPPTKRSAPVKKATPAKKAPAKKAKK

SEQ ID NO: 129 - protein, 288 aa, Triticum aestivum
  misc_feature (1)..(288): Public GI ID no.2980893
  misc_feature (1)..(288): Bit score of 330.9 for HMM based on sequences of FIGURE 04.
  misc_feature (66)..(136): Pfam Name: Linker_histone Pfam Description: linker histone H1 and H5 family
  misc_feature (1)..(288): Functional Homolog Of Ceres SEEDLINE ID no. ME01910 at SEQ ID NO: 100
MSTDAAAADIPVPQVEATADPVAETTAAAAGDAKPAKATKAKAAKTPKAPKAKKPSAPRKPKATPAHPTYAEMVSEAITALKERGGSSTVAIGKFIEDKHKAHLPANFRKIMLTQIKKLVAAGKLTKVKASYKLAKAPAAPKKPKTKAPAKKKPAAKKAPAKKPAAKSPAKKKAAAKPKAKAPAKTKAAAKPKAAAKPKAAAKTKAPAKTTKAAAKPKPAAKAKAPAKPRGRPAKAAKTSAKDAPGKKAPAAAATPKKAAPRKPPTKRSAPVKKATPAKKAPAKKAKK

SEQ ID NO: 130 - protein, 284 aa, Triticum aestivum
  misc_feature (1)..(284): Public GI ID no.2980891
  misc_feature (1)..(284): Bit score of 313.1 for HMM based on sequences of FIGURE 04.
  misc_feature (66)..(136): Pfam Name: Linker_histone Pfam Description: linker histone H1 and H5 family
  misc_feature (1)..(284): Functional Homolog Of Ceres SEEDLINE ID no. ME01910 at SEQ ID NO: 100
MSTDAAAADIPVPQVEATADPVVETTADAPAGDAKATKATKAKAKAAKTPKAKKPSAPRKPKATPAHPTYAEMVTEAIAALKERNGSSTVAIAKYIEDKHKAHLPANFRKFMLTQIKKLVAAGKLTKVKASYKLTKAPAAPKKPKTKAPAKKKPAAKKKAPAKKPAAKSPAKKKPAAKPKAKAPAKTTKAAAKPKAAAKAKAPAKTTKAAAKPKPAAKTKAPAKPRGRPRKAAKTSAKDAPGKKAPAAASTPKKAAPRKPPTKRSAPVKKATPAKKAPAKKAKK

SEQ ID NO: 131 - protein, 236 aa, Triticum aestivum
  misc_feature (1)..(236): Public GI ID no.5230781
  misc_feature (1)..(236): Bit score of 260.5 for HMM based on sequences of FIGURE 04.
  misc_feature (52)..(122): Pfam Name: Linker_histone Pfam Description: linker histone H1 and H5 family
  misc_feature (1)..(236): Functional Homolog Of Ceres SEEDLINE ID no. ME01910 at SEQ ID NO: 100
MSTDVAAADIPVPQVEVAADAAVDTPAANAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPAARKPPTKRATPVKKAAPAKKPAAKKAKK

SEQ ID NO: 132 - protein, 237 aa, Triticum aestivum
  misc_feature (1)..(237): Public GI ID no.11558848
  misc_feature (1)..(237): Bit score of 268.8 for HMM based on sequences of FIGURE 04.
  misc_feature (53)..(123): Pfam Name: Linker_histone Pfam Description: linker histone H1 and H5 family
  misc_feature (1)..(237): Functional Homolog Of Ceres SEEDLINE ID no. ME01910 at SEQ ID NO: 100
MSTDVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPAARKPPTKRATPVKKAAPAKKPAAKKAKK

SEQ ID NO: 133 - protein, 237 aa, Triticum aestivum
  misc_feature (1)..(237): Public GI ID no.5230783
  misc_feature (1)..(237): Bit score of 266.2 for HMM based on sequences of FIGURE 04.
  misc_feature (53)..(123): Pfam Name: Linker_histone Pfam Description: linker histone H1 and H5 family
  misc_feature (1)..(237): Functional Homolog Of Ceres SEEDLINE ID no. ME01910 at SEQ ID NO: 100
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPVARKPPTKRATPVKKAAPAKKPAAKKAKK

SEQ ID NO: 134 - protein, 238 aa, Triticum aestivum
  misc_feature (1)..(238): Public GI ID no.14916992
  misc_feature (1)..(238): Bit score of 260.8 for HMM based on sequences of FIGURE 04.
  misc_feature (54)..(124): Pfam Name: Linker_histone Pfam Description: linker histone H1 and H5 family
  misc_feature (1)..(238): Functional Homolog Of Ceres SEEDLINE ID no. ME01910 at SEQ ID NO: 100
MSTDVAAADIPVPQVEVAADAAVDTPAAKPAKAPKAAKAKKSTPGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPAARKPPTKRATPVKKAAPAKKPAAKKAKK

SEQ ID NO: 135 - protein, 238 aa, Triticum aestivum
  misc_feature (1)..(238): Public GI ID no.5230790
  misc_feature (1)..(238): Bit score of 258.7 for HMM based on sequences of FIGURE 04.
  misc_feature (53)..(123): Pfam Name: Linker_histone Pfam Description: linker histone H1 and H5 family
  misc_feature (1)..(238): Functional Homolog Of Ceres SEEDLINE ID no. ME01910 at SEQ ID NO: 100
MSTEVAAADIPVPQVEVAADAAVDTPAAKPAKAPKAAKAKKSTGPKKPRVTPAHPSYAEMVSEAIAALKERSGSSTIAIGKFIEDKHEAHLPANFRKILLTQIKKLVAGGKLTKVKGSYKLAKAPAAVKPKTATKKKPAAKPKAKAPAKKTAAKSPAKKAAAKPKAKAPAKAKAVAKPKAASKPKAAAKPKAKAAAKKAPAAATPKKPAAARKPPTKRATPVKKAAPAKKPAAKKAKK

SEQ ID NO: 136 - DNA, 1137 bp, Zea mays
  misc_feature (1)..(1137): Ceres CLONE ID no.244199
  misc_feature (1)..(1137): Encodes the peptide sequence at SEQ ID NO 137
acccagcaccgcagagctctcatctcctctctctctctctctctctctctctctcgcgctcgctttgcttcctcgtcgaggtccagttcctgcattgatggcgaccgaggtggctgagactcccgcgccgttggcggaggcggtccccgagacccccgcggaggcaccggcggcgcccgccgccgaggcgaattctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccgccggcaagctcaccaaggtgaagaactcctacaagctgcccgcacgcgccccggccgccgccaagccgaagcccaagtccaagaccgctgtgaagaagcccaaggccggggcgaagaagcccaaggccgccaccaagcccaagcccaaggccaaggccaagtcccccgctaaggcgaagcccgctgcaaagcccaaggcagccgcgaagccgaaacccgcagcagccaagcccaaggcggccgccaagccgaaggccaagccagctgccaaggctaagccgaaggctgtcgctgccaagccgaagccagctgccaagaaggccggccgccctgccaaggccgccaagacgtcagccaaggacacgcccgggaagaaagcggcgcccgccaagaagcccgctgctgcggccaagaaggcccctgccaagaaggccgccccagccaagaaggctcccaccccgtcgcggaaggtgccgtcgcgtaaggcgaagaagtagagcggtggtcttggcaggaatctagggtttcatgctccttcgattttagatgtttactcgtttttgctctagttgtgggtggtgtgcggggtgggttactaggttgtaaatttgatgccggaggctggggtacacatgggcattctgtaccagcggtggaagggcggaggcgccggcgacgatgacgaaccagtgtgtgttattattagaagacgaagttgtatttctgc

SEQ ID NO: 137 - protein, 269 aa, Zea mays
  misc_feature (1)..(269): Ceres CLONE ID no.244199
  misc_feature (1)..(269): Bit score of 404.0 for HMM based on sequences of FIGURE 04.
  misc_feature (49)..(119): Pfam Name: Linker_histone Pfam Description: linker histone H1 and H5 family
  misc_feature (1)..(269): Functional Homolog Of Ceres SEEDLINE ID no. ME01910 at SEQ ID NO: 100
MATEVAETPAPLAEAVPETPAEAPAAPAAEANSTKAKKASAPKKRANPTHPPYAEMISEAVTSLKERTGSSQYAIAKFVEDKHKDKLPPNFRKLLLGQLKKLVAAGKLTKVKNSYKLPARAPAAAKPKPKSKTAVKKPKAGAKKPKAATKPKPKAKAKSPAKAKPAAKPKAAAKPKPAAAKPKAAAKPKAKPAAKAKPKAVAAKPKPAAKKAGRPAKAAKTSAKDTPGKKAAPAKKPAAAAKKAPAKKAAPAKKAPTPSRKVPSRKAKK

SEQ ID NO: 138 - DNA, 1060 bp, Zea mays
  misc_feature (1)..(1060): Ceres CLONE ID no.985657
  misc_feature (1)..(1060): Encodes the peptide sequence at SEQ ID NO 139
acacataaccagcacacagctctcgccttctctctcccatcggcacacccgagctcgctccctccttccacgtcgaggtccgagtcctgctttgatggcgaccgacgtggctgagactcccgcgccgttggtggatgcggccccagaggctcccgctgacgccccggcggcgcctgctgcggacgcgaagccggccaaggccaagaaggccgccgcaccgaagaagcgcgccagcccgacccacccgccgtacgccgagatggtctcggaggcggtcacgtcactgaaggagaggacggggtccagcagctatgcgattgccaagttcgtagaggacaagcacaaggacaagctcccacccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggtgaagcccgccacaaagcccaagcccgccgcgaagccgaaagccgtagtgaaaccgaagacacccgccaagcccaaggccaagccagctgccaaggcgaagcccaagaccgccggcgctaagccgaagccacttgctaagaaggccggccgccccgccaaggcggcgaagacgtcggccaaggacacgccagggaagaaggcgccggtggccaagaagtccgctgctgccgcgaagaaggcccctgccaagaaggccgctccctcgaagaaggcggcgaccccggtgcggaaagcgccgtcccgtaaggccaagaagtaaagcggccaagaaggggggcgcgatgctgtaaatttgatatcggagaggctcgggtacactggtcattcagtatccgagaccgatagctgaggctagtggcgatggaggactgtgttattactactataaactggtggttgtgtttctgtaactggtgaatgatcaagttggaagcttttagcc

SEQ ID NO: 139 - protein, 260 aa, Zea mays
  misc_feature (1)..(260): Ceres CLONE ID no.985657
  misc_feature (1)..(260): Bit score of 363.3 for HMM based on sequences of FIGURE 04.
  misc_feature (49)..(119): Pfam Name: Linker_histone Pfam Description: linker histone H1 and H5 family
  misc_feature (1)..(260): Functional Homolog Of Ceres SEEDLINE ID no. ME01910 at SEQ ID NO: 100
MATDVAETPAPLVDAAPEAPADAPAAPAADAKPAKAKKAAAPKKRASPTHPPYAEMVSEAVTSLKERTGSSSYAIAKFVEDKHKDKLPPNFRKLLNVQLKKLVAGGKLTKVKNSYKLSSATKPNPKPKAAPKKPKTGAKKPKAAAKPKAKTPAKVKPATKPKPAAKPKAVVKPKTPAKPKAKPAAKAKPKTAGAKPKPLAKKAGRPAKAAKTSAKDTPGKKAPVAKKSAAAAKKAPAKKAAPSKKAATPVRKAPSRKAKK

SEQ ID NO: 140 - DNA, 1071 bp, Zea mays
  misc_feature (1)..(1071): Ceres CLONE ID no.217155
  misc_feature (1)..(1071): Encodes the peptide sequence at SEQ ID NO 141
acgtgccgtcgccacaatttaagcacggcttcctccgccacgacctccacacatcaccagcgcacagctctcctcatcggcgcacccgagctcgccctctccttcctcatcgaggcccgagtcctgctctgatggcgaccgacgtggctgagactcccgcgccgttggtggatgcggcccctgaggcgcccgcggacaccccggcggcgcctgctgttgacgcgaagccggccaaggccaagaaggccacagcgccgaagaagcgcgccagcccgacccatccgccgtacgccgagatggtctcggaggcgatcgcgtcgctcaaggagaggacggggtccagcagctttgctattgccaagttcttggaggacaagcacaaggacaagctcccgcccaacttccgcaagcttctgaacgttcagctcaagaagctcgtcgccggcggcaagctgaccaaggtgaagaactcgtacaagctgtcgtccgccaccaagccaaaggccgccccgaagaagaccaagaccggcgtgaagaagcccaaggccgctgccaaaccgaaggccaagtcccccgcgaagcccaagcccgccacaaagcccaaggcggccgcgaagcccgcttccaagccgaaagcagcagcaaaacccaaggcaccagccaagcccaaggccaagcctgctgccaaggcgaagcccaaggctgccggcgctaagccgaagccagctgccaagaaggccggccgccccgccaaggcggccaagacgtcggccaaggccacgccaggaaagaaggcgccggtggccaagaagcccgcggccgccgcgaagaaggcgccggtagccaagaaggccgctccggcgaagaaggcggctgcccctgcccgaaaagcgccgtctcggaaggcgaagaagtagaggaggggtaggcgtcggagaaatgtagggtttggttctcgtattacgctagatgtttgctctccctttagcctaggtggtgtctgtgtgtgcaatgttgtaaatttgatatcggatgctgggaacactaagtcaatctttcagtagctgttgt

SEQ ID NO: 141 - protein, 261 aa, Zea mays
  misc_feature (1)..(261): Ceres CLONE ID no.217155
  misc_feature (1)..(261): Bit score of 349.4 for HMM based on sequences of FIGURE 04.
  misc_feature (49)..(119): Pfam Name: Linker_histone Pfam Description: linker histone H1 and H5 family
  misc_feature (1)..(261): Functional Homolog Of Ceres SEEDLINE ID no. ME01910 at SEQ ID NO: 100
MATDVAETPAPLVDAAPEAPADTPAAPAVDAKPAKAKKATAPKKRASPTHPPYAEMVSEAIASLKERTGSSSFAIAKFLEDKHKDKLPPNFRKLLNVQLKKLVAGGKLTKVKNSYKLSSATKPKAAPKKTKTGVKKPKAAAKPKAKSPAKPKPATKPKAAAKPASKPKAAAKPKAPAKPKAKPAAKAKPKAAGAKPKPAAKKAGRPAKAAKTSAKATPGKKAPVAKKPAAAAKKAPVAKKAAPAKKAAAPARKAPSRKAKK

SEQ ID NO: 142 - protein, 246 aa, Zea mays
  misc_feature (1)..(246): Public GI ID no.121950
  misc_feature (1)..(246): Bit score of 315.5 for HMM based on sequences of FIGURE 04.
  misc_feature (49)..(119): Pfam Name: Linker_histone Pfam Description: linker histone H1 and H5 family
  misc_feature (1)..(246): Functional Homolog Of Ceres SEEDLINE ID no. ME01910 at SEQ ID NO: 100
MATDVTETPAPLVDAAPEAPADAPAAPAADANAAKAKKATAPKKRASPTHLPYAEMVSEAITSLKERTGSSSYAIAKFVEDKHKAKLPPNFRKLLNVQLKKLVAGGKLTKVKNSYKLSSATKPNPKPKAAPKKPKTGAKKPKAAAKPKAKTPAKAKPATKPKPAAKPKAVVKPKTPAKPKAKPAAKAKPKTAGAKPKPLAKKAGRAKAAKTSAKDTPGKKAPAKKAAPSKKAATPVRKAPSRKAKK

SEQ ID NO: 143 - DNA, 867 bp, Musa acuminata
  misc_feature (1)..(867): Ceres CLONE ID no.1725848
  misc_feature (1)..(867): Encodes the peptide sequence at SEQ ID NO 144
atctcgcctcccttccgactctcttccttcctatacgctgcgctcgagctcgggagaccttcgcgatggccaccgatgagaccactgatccgagaccggtggcgaagtcgaagaaggcgaaggcccccaaggaggccagggccaagaaggctgccgcccccaggaagccttccgcccatcctccctacgccgagatgattaaggaggcgatcacaacgctcaaggagagaactgggtcgagcccgtacgccatcgggaagttcatcgaggacaagcacaaggctcacctcccgtccaactttcgaaagatcctcttcctccagctgaagaagctcgccgccgccgggaagctcaccaaggtgaagagctcctacaagctctctaccatcgtgcatgccgcgccggctgagcccaagtcagcggcgggccccaagaaaccagccgcggtacagacgaagcttaaggctaaggcgaagcctgccgctgccgcttcgaaaaccaaggccaagatcgctaccactgcgaaggccaaatccaagcatgtagcatctacggtcaagcccaaaccgaaggcggccgcggcgaagccgagggtggccccgaagcgcaagtccccggtgaagcccaagcccaagcccaagcctaggccgaccagggccgcgaagaccgccgcgaaggattccccggggaagaaggcagcaaagagatcgtcgagtcggtcggcgcccacgaagaagccgaagccagcggtgaagaaagcggcggcggcggccaaaaaggcgaaaaagtagaaaaattctctttgtatgagaaaatatctctgtgtttgttaatattaatattaatatatatttttttcctcgcttc

SEQ ID NO: 144 - protein, 241 aa, Musa acuminata
  misc_feature (1)..(241): Ceres CLONE ID no.1725848
  misc_feature (1)..(241): Bit score of 348.3 for HMM based on sequences of FIGURE 04.
  misc_feature (37)..(107): Pfam Name: Linker_histone Pfam Description: linker histone H1 and H5 family
  misc_feature (1)..(241): Functional Homolog Of Ceres SEEDLINE ID no. ME01910 at SEQ ID NO: 100
MATDETTDPRPVAKSKKAKAPKEARAKKAAAPRKPSAHPPYAEMIKEAITTLKERTGSSPYAIGKFIEDKHKAHLPSNFRKILFLQLKKLAAAGKLTKVKSSYKLSTIVHAAPAEPKSAAGPKKPAAVQTKLKAKAKPAAAASKTKAKIATTAKAKSKHVASTVKPKPKAAAAKPRVAPKRKSPVKPKPKPKPRPTRAAKTAAKDSPGKKAAKRSSSRSAPTKKPKPAVKKAAAAAKKAKK

SEQ ID NO: 145 - protein, 231 aa, Lilium longiflorum
  misc_feature (1)..(231): Public GI ID no.6474950
  misc_feature (1)..(231): Bit score of 317.3 for HMM based on sequences of FIGURE 04.
  misc_feature (45)..(115): Pfam Name: Linker_histone Pfam Description: linker histone H1 and H5 family
  misc_feature (1)..(231): Functional Homolog Of Ceres SEEDLINE ID no. ME01910 at SEQ ID NO: 100
MATTVAIETPAFTPVAVDPPAAKPAKAKKAKVPKEKKASVAKPALHPTYLEMISEAIASLKERTGSSQIAISKFVENKHKAHLPANFKKLLLVQLRKLTAAGKLTKVKNSYKISAKPTTATKPKKTSAKSTTVAKPKSAAAKPKSTAAKVKKAAVKPKPKSAAVKPKAEPAAPKPKAVSKPKAVAPKPKTAGPAKKAKTSAKPSPSKKAAPVASKKAKPVKKATAPKKAKK

SEQ ID NO: 146 - protein, 293 aa, Oryza sativa subsp. indica
  misc_feature (1)..(293): Public GI ID no.125546057
  misc_feature (1)..(293): Bit score of 462.2 for HMM based on sequences of FIGURE 04.
  misc_feature (53)..(123): Pfam Name: Linker_histone Pfam Description: linker histone H1 and H5 family
  misc_feature (1)..(293): Functional Homolog Of Ceres SEEDLINE ID no. ME01910 at SEQ ID NO: 100
MATDVAATEPEVAAEEAAAAAPETTATAGDSKPAKEAKAKKAAAPRKARSTATHPPYAEMISEAIATLKERTGSSQYAIGKFLEDKHKDHLPSNFRKQLLVQIKKLVAAGKLTKVKNSYKLPPTRAPAAAKPKAKPAAAAKPKPKPKAAAKPKAAAKPKAKAPAKSKAAAKPKAAAKPAAKPKAAAKPKSPAKPAAKPKAAPKAKAKPAAKPKAKAAPKPKAAVVTKTKATSAPARRPAKAAKTSAKDTPSKKAAPAAKKPAAAAKKAPAKKAAPAKKAAAPARKVPARKAKK

SEQ ID NO: 147 - protein, 293 aa, Oryza sativa subsp. japonica
  misc_feature (1)..(293): Public GI ID no.115455945
  misc_feature (1)..(293): Bit score of 460.1 for HMM based on sequences of FIGURE 04.
  misc_feature (53)..(123): Pfam Name: Linker_histone Pfam Description: linker histone H1 and H5 family
  misc_feature (1)..(293): Functional Homolog Of Ceres SEEDLINE ID no. ME01910 at SEQ ID NO: 100
MATDVAATEPEVAAEEAAAAAPETTATAGDSKPAKEAKAKKAAAPRKARSTATHPPYAEMISEAIATLKERTGSSQYAIGKFLEDKHKDHLPSNFRKQLLVQIKKLVAAGKLTKVKNSYKLPPTRAPAAAKPKAKPAAAAKPKPKPKAAAKPKAAAKPKAKAPAKSKAAAKPKAAAKPAAKPKAAAKPKSPAKPAAKPKAAPKAKAKPAAKPKAKAAPKPKAAAVTKTKATSAPARRPAKAAKTSAKDTPSKKAAPAAKKPAAAAKKAPAKKAAPAKKAAAPARKVPARKAKK

SEQ ID NO: 148 - protein, 278 aa, Oryza sativa subsp. japonica
  misc_feature (1)..(278): Public GI ID no.115470923
  misc_feature (1)..(278): Bit score of 213.0 for HMM based on sequences of FIGURE 04.
  misc_feature (75)..(145): Pfam Name: Linker_histone Pfam Description: linker histone H1 and H5 family
  misc_feature (1)..(278): Functional Homolog Of Ceres SEEDLINE ID no. ME01910 at SEQ ID NO: 100
MATEEVVPEVPVTEVEAAAAEEAVEETTAAEEKAAKPAKEKKKAGRPPKEKKEAKPAKEKKVKEAKAKKPRVAAAHPPYAEMIMEAIVALKERTGSSSQAIGKHIHANHGANLPPNFRKLLSGNLKKLTAAGKLAKVKNSFKLSSTRPAAPAAADAKPKAAPATKPKVKTTKAAKPAAKAKAPATTKAAKPATKTKIKVAAAPAAKPKASPKAKAKTATSPVKPRGRPAKSAKTSAKDSPAKKAAPVAAKKKAAATKKKASVAAAPAARKGAARKSMK

SEQ ID NO: 149 - protein, 236 aa, Fritillaria agrestis
  misc_feature (1)..(236): Public GI ID no.2641211
  misc_feature (1)..(236): Bit score of 344.0 for HMM based on sequences of FIGURE 04.
  misc_feature (48)..(118): Pfam Name: Linker_histone Pfam Description: linker histone H1 and H5 family
  misc_feature (1)..(236): Functional Homolog Of Ceres SEEDLINE ID no. ME01910 at SEQ ID NO: 100
MSAAVAIETPAFAPVPVARDEPVAKPGKVTKAKAPKEKKASVAKKPALHPTYLEMISEAIASLKERTGSSQYAIAKFVEDKHKSHLPANFKKLLLVQLQKLTAAGKLTKVKNSYKISAKPTPAAKPKSAAVKPKSAATKLKSAAKKVKKAAVKPKPKSAAVKPKAPAVNMKSKPAALKPNTVTKSKTVALKGKTAGRPAKAAKTSVKAAPGKKAAPVALKKAKAGKKVTTPKKAKK

SEQ ID NO: 150 - protein, 245 aa, Pinus pinaster
  misc_feature (1)..(245): Public GI ID no.30024108
  misc_feature (1)..(245): Bit score of 317.0 for HMM based on sequences of FIGURE 04.
  misc_feature (56)..(126): Pfam Name: Linker_histone Pfam Description: linker histone H1 and H5 family
  misc_feature (1)..(245): Functional Homolog Of Ceres SEEDLINE ID no. ME01910 at SEQ ID NO: 100
MASTDPPADTVPAEPVANEDVKAAEEKPVKAPKEKKVKTPKEKKPKAAKGSKPPPAHPPYFQMISEAIVALKERGGSSPYAIAKFLSEKYKSDLPPVFKKKLNVQLRNLTNSGKLTKVKGSYKLAEKEKKADAPKPKTEKKPAAKKPKAPAAKAPAKAPSKASKPAAPKKAEKPVAPKKAAAPKKAAKPAAPKAAAPKAKKPAAAAKPAAPKRSSTRTAAKPAAPKAAKKPTPKKAGGAAKKAKK

SEQ ID NO: 151 - DNA, 597 bp, Arabidopsis thaliana
  misc_feature (1)..(597): Ceres SEEDLINE ID no.ME02538
  misc_feature (1)..(597): Ceres CLONE ID no.13102
  misc_feature (1)..(597): Encodes the peptide sequence at SEQ ID NO. 152
ctctttgtataatatatgatctgaaaaagaaaaaaaaactctttagctgtttatatttagagttgagactaattcggcgttgcgcaccaacctaacttcggttctacttcacacacaaaactcgtgtcgtctcttgttataaagggtctctttgtttcagtgtctttggtctcgtgtttgtgtagagatggagaacaagaccgataatggaaacgaggatggtccaataatacatagccaagttgagaagataaagaaagagtttgagaagataagacaaccgtcgctgcagcaaccggagatgaggagggttcttagcgagatcaaaaggcgtcaacgttcacgttctcctcttggtttaggggagagatctatttccgttgggaattgatccatgtttgactttatagtcgagagagatagataaaaaaaaagaggtagaggtggttatgtggttcctaatagttaacaggttttgttgtatatattatgctatataaatactctttcgtttgaaaatgaatacgtctcctctctttgcatagtatgatgatgtatgaatctcgatttacatgatatgtatgtgagagatatagt

SEQ ID NO: 152 - protein, 67 aa, Arabidopsis thaliana
  misc_feature (1)..(67): Ceres SEEDLINE ID no.ME02538
  misc_feature (1)..(67): Ceres CLONE ID no.13102
  misc_feature (1)..(67): Bit score of 166.2 for HMM based on sequences of FIGURE 05.
MENKTDNGNEDGPIIHSQVEKIKKEFEKIRQPSLQQPEMRRVLSEIKRRQRSRSPLGLGERSISVGN

SEQ ID NO: 153 - DNA, 681 bp, Gossypium hirsutum
  misc_feature (1)..(681): Ceres CLONE ID no.1843642
  misc_feature (1)..(681): Encodes the peptide sequence at SEQ ID NO 154
actttgcctaccagcttccgtttcctcactattcatgaagaaatcgtgtctttttcattattcccaccatatatataaacccttaaaactatccacaaaacaggtatgcaaggcctttggtgtgaaggattagcaatttttcaatcaggtttgagcttagctttagaagttgagaatatggagcaaaagaagatcagcagcagcagcagcagcaacaacaacgcagttataagagatgaggatgaatataaaggtgtaccaattcatagccaagtcatgaagataaagcaagagtttgagaagatcaagcatccatcactgcagcagccagatatgagaagggttctccgagagattaccaggcaacggtcccgatcccctctaggattagctgaaagacccatatcagttgggaattcataggagctaccataatacacctgtagaagagaagaaagagaaatggttactctcatggcagcaggtttttaggattagtcttgtttcaagttttttttttctccctgccagtttctggatctttgttctatctgcagtaggtatcctccaacatgtttatggagaaaaccttttctctttcttctcttcggcttcttcttcttttgccctgttcataatagtttttcttccattaatatctaaaagcttcttgtatagatt

SEQ ID NO: 154 - protein, 81 aa, Gossypium hirsutum
  misc_feature (1)..(81): Ceres CLONE ID no.1843642
  misc_feature (1)..(81): Bit score of 215.6 for HMM based on sequences of FIGURE 05.
  misc_feature (1)..(81): Functional Homolog Of Ceres SEEDLINE ID no. ME02538 at SEQ ID NO: 152
MEQKKISSSSSSNNNAVIRDEDEYKGVPIHSQVMKIKQEFEKIKHPSLQQPDMRRVLREITRQRSRSPLGLAERPISVGNS

SEQ ID NO: 155 - DNA, 481 bp, Gossypium hirsutum
  misc_feature (1)..(481): Ceres CLONE ID no.1916451
  misc_feature (1)..(481): Encodes the peptide sequence at SEQ ID NO 156
aattaggtttacaaatatggagcaaaagaagatcaaccatgaaaacaacaacaacaaagcagctataagagatgaagatggatataaaggcgtcccaattcatagccaagtgatgaagataaagcgagagtttgagaagatcaagcacccgtcattgcaacaagctgatatgagacgagtgcttcgggagatcaccaggcaacgctcccgttcccctctcggattagctgagagacctatagctgttggccattcctagaaccttccatcaccttgtagaagcaaaagtaagaggaaatagttactttcatgcccaccaacagctttttaggattagattggatttttcttttcttttttaattacgcccctgtttatggatctatctgttgtagatatgtttatggagaaaacacttcctctgtttcttccctatattaattaataacttaaaaggtcttgttgtttgaattaaacgttc

SEQ ID NO: 156 - protein, 80 aa, Gossypium hirsutum
  misc_feature (1)..(80): Ceres CLONE ID no.1916451
  misc_feature (1)..(80): Bit score of 193.0 for HMM based on sequences of FIGURE 05.
  misc_feature (1)..(80): Functional Homolog Of Ceres SEEDLINE ID no. ME02538 at SEQ ID NO: 152
MEQKKINHENNNNKAAIRDEDGYKGVPIHSQVMKIKREFEKIKHPSLQQADMRRVLREITRQRSRSPLGLAERPIAVGHS

SEQ ID NO: 157 - DNA, 237 bp, Populus balsamifera subsp. trichocarpa
  misc_feature (1)..(237): Ceres ANNOT ID no.1459112
  misc_feature (1)..(237): Encodes the peptide sequence at SEQ ID NO 158
atggagaacaatagcagcaacgacgacagcagaggcagaaatggagatggagatcatggatatgtggggtttccaattcacagtcaggttataaagatcaggcaagaatttgacaagatcaagcatccatctctacagcagctagaggtgagaggggttgtaaaatgcaggatcaacaggcagcgatcgcgttcaccactaggtctagctgagagacccatctcagtaggcaactaa

SEQ ID NO: 158 - protein, 78 aa, Populus balsamifera subsp. trichocarpa
  misc_feature (1)..(78): Ceres ANNOT ID no.1459112
  misc_feature (1)..(78): Bit score of 204.1 for HMM based on sequences of FIGURE 05.
  misc_feature (1)..(78): Functional Homolog Of Ceres SEEDLINE ID no. ME02538 at SEQ ID NO: 152
MENNSSNDDSRGRNGDGDHGYVGFPIHSQVIKIRQEFDKIKHPSLQQLEVRGVVKCRINRQRSRSPLGLAERPISVGN

SEQ ID NO: 159 - DNA, 249 bp, Populus balsamifera subsp. trichocarpa
  misc_feature (1)..(249): Ceres ANNOT ID no.1473448
  misc_feature (1)..(249): Encodes the peptide sequence at SEQ ID NO 160
atggagcatagaagaggagacagcgacaacaaggaagatgggattgaggaggagcagatgggatttccagttcataatcaagttaagaagataaagcaagaatcttgctacaaaatcttggattggccaccaggggggctgcctgagatgaaacctgttcttaaggagatcgccaccagatcatcacatcaactctctcgttcgcctctgggattagctggcagacccatctctgttggtgattcatag

SEQ ID NO: 160 - protein, 82 aa, Populus balsamifera subsp. trichocarpa
  misc_feature (1)..(82): Ceres ANNOT ID no.1473448
  misc_feature (1)..(82): Bit score of 94.6 for HMM based on sequences of FIGURE 05.
  misc_feature (1)..(82): Functional Homolog Of Ceres SEEDLINE ID no. ME02538 at SEQ ID NO: 152
MEHRRGDSDNKEDGIEEEQMGFPVHNQVKKIKQESCYKILDWPPGGLPEMKPVLKEIATRSSHQLSRSPLGLAGRPISVGDS

SEQ ID NO: 161 - DNA, 493 bp, Brassica napus
  misc_feature (1)..(493): Ceres CLONE ID no.953633
  misc_feature (1)..(493): Encodes the peptide sequence at SEQ ID NO 162
acaagtcgtctctttgtataatatttatttctcaaaccaatttggtgttgctcaccaacctgattttatcttctactttcacacacaactcgtgtcgtgtcttctggaacagagttggttgtataaagggttttctttgtgtgtcttaaggtttttttgtgtggtggaaatggagaacaagaccaataatggaaacgaggatggtccaaaacatagccaagtggtgaagataaagagagagtttgagaagataagccagccatcgctgaagcaaccggagatgagaagggtcctctccgagatcaccaggcgtcaacgttcacgttcacctctcggcttaggagagagatctatttccgttggacactgatgctagaagacgaagaagaagaggagcaggttcttaatagttgcagactttgttgtatatgtgtccatgtatgtaaataactctgtgtttgaatatgatgatgaatctcccttcgttcagagt

SEQ ID NO: 162 - protein, 66 aa, Brassica napus
  misc_feature (1)..(66): Ceres CLONE ID no.953633
  misc_feature (1)..(66): Bit score of 161.9 for HMM based on sequences of FIGURE 05.
  misc_feature (1)..(66): Functional Homolog Of Ceres SEEDLINE ID no. ME02538 at SEQ ID NO: 152
MENKTNNGNEDGPKHSQVVKIKREFEKISQPSLKQPEMRRVLSEITRRQRSRSPLGLGERSISVGH

SEQ ID NO: 163 - DNA, 591 bp, Glycine max
  misc_feature (1)..(591): Ceres CLONE ID no.587957
  misc_feature (1)..(591): Encodes the peptide sequence at SEQ ID NO 164
ccatttgtgctctcacgcacaaatatatataggcacacacgcgcttataatttatggtacatgagaagtgttttttgtccattgtagattgtcacatatagagaaacagaattagaagaagggtagctgggaaactttggcaattgaaacctttttttccattgagtgatagagagcatggagaacatgaagatgaacaacgatgaaaggtttgcacaaaagggtgtcccagttcatagccaggttatgaagatcaagcaagagtcagagaaaattgttgattggtcccctggcaagccagagataagatctgttcttcgcgaaataagccggcaaatttcccgatcgccgttggggatctccggccaaccgatttcagttggtgagtcataggttcagtatatggttaagggtttttggattagtgtgttgatgtacacaggtggaagagggaggttctgtttgcttcccctgctcctgttctgttttcctctgttttttggtcagagaatatttaggcatttagctatattctccactttttttcttttttctttttgttgtatataataataataatagtgttattgg

SEQ ID NO: 164 - protein, 71 aa, Glycine max
  misc_feature (1)..(71): Ceres CLONE ID no.587957
  misc_feature (1)..(71): Bit score of 174.5 for HMM based on sequences of FIGURE 05.
  misc_feature (1)..(71): Functional Homolog Of Ceres SEEDLINE ID no. ME02538 at SEQ ID NO: 152
MENMKMNNDERFAQKGVPVHSQVMKIKQESEKIVDWSPGKPEIRSVLREISRQISRSPLGISGQPISVGES

SEQ ID NO: 165 - DNA, 628 bp, Arabidopsis thaliana
  misc_feature (1)..(628): Ceres SEEDLINE ID no.ME02603
  misc_feature (1)..(628): Ceres CLONE ID no.15457
  misc_feature (1)..(628): Inplanta Sequence
  misc_feature (1)..(628): Encodes the peptide sequence at SEQ ID NO. 166
attaaaagatgcgtttgctagtagcagaagcagcttcaccattgtcctctgctgcaactccaacatgtaactctcatacttgcagatggaagccttactcaaactctactgacttcacagctaatgcatcagtccttctcatccttgtcatctctgctctcatttgtgctctctctctttacgctgcaattcgttgctttctccgaccaaccctcgagactgaagacgaccacaagcctgaccctgaagcagctgcttcatccactccaacaactcctacacttgtctactcctccgaccttgaactcgcaggagctgaagcagagtgtgccatttgcttgtcggaatttgaacaaggagaaagcattcaagtgctggagaaatgtcagcatggtttccatgttaagtgtatccacaaatggctctctactcgctcctcctgtcccacttgcagaacttctatcttctcacaacactctgaaactccttcaagccacatcaatgcttagcttctttttttaatcttgtttttccaaaagctttagagttgtatcatgttttgcttgagattaccctgtatctgctctgtattattaggtaacgtagaccaaccaaagtatttacttac

SEQ ID NO: 166 - protein, 166 aa, Arabidopsis thaliana
  misc_feature (1)..(166): Ceres SEEDLINE ID no.ME02603
  misc_feature (1)..(166): Ceres CLONE ID no.15457
  misc_feature (1)..(166): Bit score of 328.8 for HMM based on sequences of FIGURE 06.
  misc_feature (107)..(148): Pfam Name: zf-C3HC4 Pfam Description: Zinc finger, C3HC4 type (RING finger)
MRLLVAEAASPLSSAATPTCNSHTCRWKPYSNSTDFTANASVLLILVISALICALSLYAAIRCFLRPTLETEDDHKPDPEAAASSTPTTPTLVYSSDLELAGAEAECAICLSEFEQGESIQVLEKCQHGFHVKCIHKWLSTRSSCPTCRTSIFSQHSETPSSHINA

SEQ ID NO: 167 - DNA, 993 bp, Gossypium hirsutum
  misc_feature (1)..(993): Ceres CLONE ID no.1857256
  misc_feature (1)..(993): Encodes the peptide sequence at SEQ ID NO 168
tatttgtgttgtgtaaatttcatattatttttttatgttgagtcaaagatagaaattcaaattcccaccttttcctatatataaagccccctagtccaacaacctcctagaaagaatcccaatcttatattcacaattaaccctgccaaaactatgtccatatccatacccactcaagttcttcaaggtttgcttggagaattccactctagaaggttgttgcttacaccgactacagcatctcctccaagctctgagatccaccacaattcttcggatctgtacacccgtaataacagcttcgatgccaacattgttatggttctatcagtcctcttgtgtgcccttatttgctcacttggactcaattccatcatcaggtgtgcattaaggtgctcgagtttaatagcctcagaatccggagccaccacctctagtcggttagcaaacaaaggggtcaagagaaaagccttgaagacctttccaacagtaaactactctgcggacttgaagctgcccggcttggactctgagtgcatcatatgtctatccgattttacagcaggtgaccgcgtgcgacttctacctaagtgcaaccatgggttccatgtccggtgcattgataagtggctaagcgcccattcatcttgccccaaatgcaggcactgcctggtcgacacatgccaaaagattgttgggtgtactcaggcaagttcgtcggaacctcctccggtgcaagaaaccatattgtctataataactccggtagatcgcgaaggtttcatacatagctataggtgaattagcttagtagttattctttgcttttctttcttttactctttttttttttttaattgtatcatatgcaagccaaaatttagctctttgccttgaaaattagcattagaaggctacaagctagaatacaatttcatgtgcagttgtgaaattcgttccttgttttaatcttcttctttttcacctacccag

SEQ ID NO: 168 - protein, 215 aa, Gossypium hirsutum
  misc_feature (1)..(215): Ceres CLONE ID no.1857256
  misc_feature (1)..(215): Bit score of 437.6 for HMM based on sequences of FIGURE 06.
  misc_feature (128)..(169): Pfam Name: zf-C3HC4 Pfam Description: Zinc finger, C3HC4 type (RING finger)
  misc_feature (1)..(215): Functional Homolog Of Ceres SEEDLINE ID no. ME02603 at SEQ ID NO: 166
MSISIPTQVLQGLLGEFHSRRLLLTPTTASPPSSEIHHNSSDLYTRNNSFDANIVMVLSVLLCALICSLGLNSIIRCALRCSSLIASESGATTSSRLANKGVKRKALKTFPTVNYSADLKLPGLDSECIICLSDFTAGDRVRLLPKCNHGFHVRCIDKWLSAHSSCPKCRHCLVDTCQKIVGCTQASSSEPPPVQETILSIITPVDREGFIHSYR

SEQ ID NO: 169 - DNA, 651 bp, Populus balsamifera subsp. trichocarpa
  misc_feature (1)..(651): Ceres ANNOT ID no.1442042
  misc_feature (1)..(651): Encodes the peptide sequence at SEQ ID NO 170
atgagaccagcaccactagaagcagaagcagcagcagcgaacatcagtcatctatctccaccaccactccattctagagctccatcatgtgatcctcaagttcatagctgcaaatggtggccttactcaaactcgaatgattttggagccaacacagctatgatcctcatcattctcctctgtgcactcatttgtgctttggttctcaacacagctattcgatggttcttgcgaagcaataacaataactcatcagaccgccttggggaacttgaggagcagaggaaacccaaagatgaggcagacatggcaacgctagtgctggctacgacacaggtgtattctgctggaatgaagcttggtggggtggaggcagattgcgctatttgcttgtcagaattcgtggagggtgaggggattcgggtgttagggagatgtgaccatggattccatgtcctttgtatagaaaaatggttgtcttctcattcttcctgtcctacttgccgccgtagctgtcttgcttcctccccctcttcaccagaacctgacaattgtagcgcaggaaatggccacgacagcaactcttctcaatcagcagaacctgaaagagctgcagacaatctgagcactaatggaaacataccagtgtag

SEQ ID NO: 170 - protein, 216 aa, Populus balsamifera subsp. trichocarpa
  misc_feature (1)..(216): Ceres ANNOT ID no.1442042
  misc_feature (1)..(216): Bit score of 435.9 for HMM based on sequences of FIGURE 06.
  misc_feature (127)..(168): Pfam Name: zf-C3HC4 Pfam Description: Zinc finger, C3HC4 type (RING finger)
  misc_feature (1)..(216): Functional Homolog Of Ceres SEEDLINE ID no. ME02603 at SEQ ID NO: 166
MRPAPLEAEAAAANISHLSPPPLHSRAPSCDPQVHSCKWWPYSNSNDFGANTAMILIILLCALICALVLNTAIRWFLRSNNNNSSDRLGELEEQRKPKDEADMATLVLATTQVYSAGMKLGGVEADCAICLSEFVEGEGIRVLGRCDHGFHVLCIEKWLSSHSSCPTCRRSCLASSPSSPEPDNCSAGNGHDSNSSQSAEPERAADNLSTNGNIPV

SEQ ID NO: 171 - DNA, 858 bp, Populus balsamifera subsp. trichocarpa
  misc_feature (1)..(858): Ceres ANNOT ID no.1467094
  misc_feature (1)..(858): Encodes the peptide sequence at SEQ ID NO 172
atgaaaactggctggggaatatccgatcgtcagaaaaagttgtggaatcccttgatgcctataaattcacttcagtctgaacttccacgcaatctttctctttctcactctgtggagctgataaacctatcgcaggacacgagcataaccggcaagaaccaagaatcgcacattacaaaaaacacaagaaagttttcaagtcccaaaatgagaccagcaccattagaaacaacagcagcagcagacatcagccatctatccccaccaccaccactcccttctagacctccatcatgtgaccctcaagttcacagctgcaaatggtggccttactcaaactcaaatgatgctggagccaacacagctacgatcctcatgattctcctctgtgcactcatttgtgcactggcttttaatacagccattcgttggttcttgcgaagcgacaatgatagctcatcggaccaccttcgcgaactcgaggagcagaggaaacccaacaaggagtcagacatggcattactagtactggctacaacacaggtgtattatgctggaatgaagcttgctggggcggaggctgattgcgcaatttgcttgtcagaattcgtggaaggcgaggggattcgggtgttagggagatgtaaccatggattccatgtccactgtgtagaaaagtggttggctagtcattcttcctgtcctacttgccgctgtagttgtcttgcttcctccctttcctcaccagaacctgccaattgctgcgcaaggaatggcctcgacaacaactcttctcaatcagcagaacctcaaagagctccagccaatctcagtgctaatgaaaacatacccgtgtag

SEQ ID NO: 172 - protein, 216 aa, Populus balsamifera subsp. trichocarpa
  misc_feature (1)..(216): Ceres ANNOT ID no.1467094
  misc_feature (1)..(216): Bit score of 338.7 for HMM based on sequences of FIGURE 06.
  misc_feature (127)..(168): Pfam Name: zf-C3HC4 Pfam Description: Zinc finger, C3HC4 type (RING finger)
  misc_feature (1)..(216): Functional Homolog Of Ceres SEEDLINE ID no. ME02603 at SEQ ID NO: 166
MRPAPLETTAAADISHLSPPPPLPSRPPSCDPQVHSCKWWPYSNSNDAGANTATILMILLCALICALAFNTAIRWFLRSDNDSSSDHLRELEEQRKPNKESDMALLVLATTQVYYAGMKLAGAEADCAICLSEFVEGEGIRVLGRCNHGFHVHCVEKWLASHSSCPTCRCSCLASSLSSPEPANCCARNGLDNNSSQSAEPQRAPANLSANENIPV

SEQ ID NO: 173 - protein, 525 aa, Glycine max
  misc_feature (1)..(525): Public GI ID no.113367236
  misc_feature (1)..(525): Bit score of 1367.0 for HMM based on sequences of FIGURE 56.
  misc_feature (371)..(425): Pfam Name: bZIP_2 Pfam Description: Basic region leucine zipper
  misc_feature (1)..(525): Functional Homolog Of Ceres SEEDLINE ID no. ME20628 at SEQ ID NO: 1437
MEDTEAASSFKMNNHMEQLTIPQFNASSQSQMRTVTRNHHHNQRGGGIPPSHPHQIPPISPYSHMNNQIPVSRPQMPSHSTSPTPSHTRSLSQPSFFSLDSLPPLSPCTFRESSSTSDHADVSMEDRDVTSHSPLPPFAARNPSLPPRKSHRRSNSDIPFGFSTVLQSSPPLIPLRGREGVKPNSSVVKRETNWEHGNVEGSGEKKSPEGEVVDDLFSAYMNLDSFDTLNSSGTDDKNGGENRDDLDSRACGTKTNGGDSSDNEAESSVNESGHGGSEKREGMKRSAGGEIAPTTRHYRSVSMDSFIGKLNFGDESPKLPPSPGQRGRLMSPAGGIDGNSAAFSLEFGSGEFSGPELKKIMANEKLAEIALTDPKRAKRILANRQSAARSKERKMRYISELEHKVQTLQTEATTLSAQLTLLQRDSAGLTNQNSELKFRLQSMEQQAKLRDALNEALTAEVQRLKIATAELSSDSHGSSCLIPQHSVNPLMFQQQPPSASQQNIHLQQQQHRQNGNANSNSDLKQ

SEQ ID NO: 174 - protein, 218 aa, Brassica oleracea
  misc_feature (1)..(218): Public GI ID no.89257469
  misc_feature (1)..(218): Bit score of 362.0 for HMM based on sequences of FIGURE 06.
  misc_feature (151)..(192): Pfam Name: zf-C3HC4 Pfam Description: Zinc finger, C3HC4 type (RING finger)
  misc_feature (1)..(218): Functional Homolog Of Ceres SEEDLINE ID no. ME02603 at SEQ ID NO: 166
MWMMISQEGQRSNPIIYHNNIHLLCEVDQKREKASVIVLKIQTKHPNPESFKTSLEPSPPLSPHSLCIRWKPYSNSSEFQANASVLLILFVSALICGLSLCAAIRCFLRPNLQTDDNEHKPDPEEDVSSTVPTPTLVYSSDLELAGAQAECAICLSEFEPGESIHVLEKCHHGFHIKCIHKWLSSRSSCPTCRTSIFSQNTLDSATSAVAPSTNEINA

SEQ ID NO: 175 - DNA, 2140 bp, Arabidopsis thaliana
  misc_feature (1)..(2140): Ceres SEEDLINE ID no.ME20628
  misc_feature (1)..(2140): Ceres ANNOT ID no.859276
  misc_feature (1)..(2140): Genomic Sequence
  misc_feature (1)..(2140): Inplanta Sequence
  misc_feature (1)..(2140): Encodes the peptide sequence at SEQ ID NO. 1437
atgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgggagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaaggtaataaaatagtgatgcttcattagacattttgatgttgttgttgttgtgacttgactgttttgatttaaccatctcgttagaatcttggcgaaccgcgtatctgctgcacgttcaaaggagcggaagacgcgatacatggcagagttggaacacaaggtgcagacacttcagactgaagctactacattatcggctcagctcacacatttgcaggtgcgagacaaaacaacaaactatcatgtttgaataagtctgtagtcttatattgtttcctttggtggctcagagagattctatggggttgacaaaccagaacagtgagctgaagtttcgtcttcaagctatggagcagcaagcacaactccgcgatggtatgcacattatcaaaagtattcattctcaaaattagggttgctgagtcgctttaggattgttttgtattcgaactcgatggaaccaagtcagtgtcttgtccttatccgaatgctttgttttactttccatagacgattttcttctaccgtaagaactttcccttttcggtttccccagccttgagtaggaacaatgtttgtgtattctatgtatggaaaaacctgaaccttgtccttgattatttagctcatggccgcaagattgcacccgaattttatccatccttaccgctaaatatgtctcttgtttaacttactctattaaaagatttgatctctccggagaatttagctaccacgtttcttgattttttgtaagttctcctagagaggtaacattttgatattccttgtttggcagctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactag

SEQ ID NO: 176 - DNA, 883 bp, Zea mays
  misc_feature (1)..(883): Ceres CLONE ID no.389818
  misc_feature (1)..(883): Encodes the peptide sequence at SEQ ID NO 177
acatgaggcagactaaaaacaagaacatacctacgcaactagcagagcttacagatttgcacccacaggactctgaataaagctggggctttttgcagcacaaggacatggagtacccaagaaggacactgctgcacacccctttctccgggcatccctctggtccaagccagccaatagatggagccacggccacagacggaagcaacttcgacgcgaacgtggtcatgatcctggctgtcctcctgtgcgcgctgatctgcgctctcgggctcaactccatcgtccggtgcgcgctgcggtgctcgagccgggtggtggtgggtcctgaaccgaaccaggtgacgcggcttgtccagagcgggctgaggaggaaggcgctccgagccatgccggtcctggtctactcgcctgggctgaggatcaatgctgccaacccgacatgcgcgatctgcctctcggacttcgaggcaggggagcatgtcagggtcctccccaaatgcaaccacggcttccatgtcaggtgcatcgaccggtggctgctggcgcggtcgacgtgcccgacgtgccggcagtccctgttcggagtgccgcagaaggcctccggctgctccgaggcgagccgggctgccgagccagagcctgcgcctgcgcctgcgcctgctcgctctgtccttgtgccgctcagacctgaaggtttggtcactcattatgatttttagaatgttcggttgcttcttagtcgttgcataaatgatgagagggaggctgagaaaaagtagaaacaaaaactgtgagcattagatcttactgccaatctggtttgtacattgttggttgctagagaaaaaaaagatgtgaaggttttctagttttttttttt

SEQ ID NO: 177 - protein, 204 aa, Zea mays
  misc_feature (1)..(204): Ceres CLONE ID no.389818
  misc_feature (1)..(204): Bit score of 423.3 for HMM based on sequences of FIGURE 06.
  misc_feature (113)..(154): Pfam Name: zf-C3HC4 Pfam Description: Zinc finger, C3HC4 type (RING finger)
  misc_feature (1)..(204): Functional Homolog Of Ceres SEEDLINE ID no. ME02603 at SEQ ID NO: 166
MEYPRRTLLHTPFSGHPSGPSQPIDGATATDGSNFDANVVMILAVLLCALICALGLNSIVRCALRCSSRVVVGPEPNQVTRLVQSGLRRKALRAMPVLVYSPGLRINAANPTCAICLSDFEAGEHVRVLPKCNHGFHVRCIDRWLLARSTCPTCRQSLFGVPQKASGCSEASRAAEPEPAPAPAPARSVLVPLRPEGLVTHYDF

SEQ ID NO: 178 - DNA, 673 bp, Zea mays
  misc_feature (1)..(673): Ceres CLONE ID no.455651
  misc_feature (1)..(673): Encodes the peptide sequence at SEQ ID NO 179
atagctaggcaagacagtcgagagtcgacaccatggccatggcgacgcaggggcaggccgaccagcagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgccgccgccgcgccggctctggtggtggccagggcaacggcagcggcgtgctgccgtcggacgacccggctgagaagccctctgtggaggtggagctgcaggcgccgccgcccgccctgctggtgtactccgccgccgggacgaagctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctcacgcaagtgaattactctaaataaataattgccgttttagtgttgctatttaccattgcttgtactgcctctgtaaatcaagaagaagaaataaaattataactctt

SEQ ID NO: 179 - protein, 185 aa, Zea mays
  misc_feature (1)..(185): Ceres CLONE ID no.455651
  misc_feature (1)..(185): Bit score of 232.9 for HMM based on sequences of FIGURE 06.
  misc_feature (126)..(169): Pfam Name: zf-C3HC4 Pfam Description: Zinc finger, C3HC4 type (RING finger)
  misc_feature (1)..(185): Functional Homolog Of Ceres SEEDLINE ID no. ME02603 at SEQ ID NO: 166
MAMATQGQADQQQQQHGRSEPTTSVAANRWGPYSGAGDFASNMAVILAALLAALALGLALNAAVRYLLRRRRRAGSGGGQGNGSGVLPSDDPAEKPSVEVELQAPPPALLVYSAAGTKLAGAAAECAICLAEFADGDAVRVMPACGHGFHARCIERWLAEGRRSSCPTCRAPAVQRSLTQVNYSK

SEQ ID NO: 180 - DNA, 920 bp, Panicum virgatum
  misc_feature (1)..(920): Ceres CLONE ID no.2019147
  misc_feature (1)..(920): Encodes the peptide sequence at SEQ ID NO 181
  misc_feature (616)..(616): m is a or c
atcacttggctgaggcctgagggcgctttctgtccatgcccatgccgtcccgtcctccgatgctgtggccgctccactccccttgcccgcttctcttttgcagcttctcaccgccgccgccgccgccggccggtctcaccagtgaccgcctccggccttgatttctttcgtcccatccatgggcacgccgctacggatgccccacatgtccacctgtagcaacgtcgcgcccgctcccgcgcccgaggcgccgcgcgcgccgccgtcgtcgccgctggactacgacgtggtggtgatcctggcggcgatgctgtgcgcgctggtgtgcgcgctggggctcaactcgatgctccagtgcgtggtgcggtgcacccgccgcgccgtggccgaccccgtcggctgggtcgcgcaccgccgcgccagcgccgggctcaagcgcgaggacgtcgtcgcgctgcccgtggtcacctactccgcctcgccgccggcggccgcggcggcggggtgcgccatctgcctgtcggacttcgccgacggggagaggatgcgggtgctccccgtgtgcgggcaccggttccacgtcgtgtgcatcgacaggtggctcgcctcgcacggmtcctgcccgacgtgccggcgccgcctctcctccgagtccggcggtggccaccgccacctgcaagttttgacggctgtttaaccgatcaatcggatagctatactgttttcctcttttttttttgttctcgagatcattgcttccggcatagtatgcgtgtatgtaacgtaaagatggcatgctcatcgcctcatccggtatagcttgtttgatgtggttcactttgccatcctgcatgagagttttttttcttcttctgtacgtgtacaccttaccaccatgagttatgagatgtttattgctc

SEQ ID NO: 181 - protein, 172 aa, Panicum virgatum
  misc_feature (1)..(172): Ceres CLONE ID no.2019147
  misc_feature (1)..(172): Bit score of 297.9 for HMM based on sequences of FIGURE 06.
  misc_feature (110)..(151): Pfam Name: zf-C3HC4 Pfam Description: Zinc finger, C3HC4 type (RING finger)
  misc_feature (1)..(172): Functional Homolog Of Ceres SEEDLINE ID no. ME02603 at SEQ ID NO: 166
  misc_feature (146)..(146): Xaa is any aa, unknown or other
MGTPLRMPHMSTCSNVAPAPAPEAPRAPPSSPLDYDVVVILAAMLCALVCALGLNSMLQCVVRCTRRAVADPVGWVAHRRASAGLKREDVVALPVVTYSASPPAAAAAGCAICLSDFADGERMRVLPVCGHRFHVVCIDRWLASHXSCPTCRRRLSSESGGGHRHLQVLTAV

SEQ ID NO: 182 - protein, 218 aa, Oryza sativa subsp. indica
  misc_feature (1)..(218): Public GI ID no.125537720
  misc_feature (1)..(218): Bit score of 324.3 for HMM based on sequences of FIGURE 06.
  misc_feature (125)..(184): Pfam Name: zf-C3HC4 Pfam Description: Zinc finger, C3HC4 type (RING finger)
  misc_feature (1)..(218): Functional Homolog Of Ceres SEEDLINE ID no. ME02603 at SEQ ID NO: 166
MAMSPHDQHEHEPDHAHRSPSNGTAATSTIATNRWGPYSGAGDFASNMAVILAALLAALALALALNAAVRYLLRRHRRARQQPAAAAAAAEDPEKPPVQEADPPPPPPALVYSAAGTKLAGAAECAICLAEFVDGDTVRVMPCWCQEIPLESGLRFAQIKVYQTGPFNVEAANLLPTPGICTTCRFVYRGVVKHLHFLYGDWRDILACFVKGKKNTNS

SEQ ID NO: 183 - protein, 188 aa, Oryza sativa subsp. japonica
  misc_feature (1)..(188): Public GI ID no.115443697
  misc_feature (1)..(188): Bit score of 375.3 for HMM based on sequences of FIGURE 06.
  misc_feature (125)..(168): Pfam Name: zf-C3HC4 Pfam Description: Zinc finger, C3HC4 type (RING finger)
  misc_feature (1)..(188): Functional Homolog Of Ceres SEEDLINE ID no. ME02603 at SEQ ID NO: 166
MAMSPHDQHEHEPDHAHRSPSNGTAATSTIATNRWGPYSGAGDFASNMAVILAALLAALALALALNAAVRYLLRRHRRARQQPAAAAAAAEDPEKPPVQEADPPPPPPALVYSAAGTKLAGAAECAICLAEFVDGDTVRVMPVCGHGFHARCIERWLAGGRRSSCPTCRAPAATPPGATATEPAAVAP

SEQ ID NO: 184 - protein, 164 aa, Thellungiella halophila
  misc_feature (1)..(164): Public GI ID no.20340241
  misc_feature (1)..(164): Bit score of 279.3 for HMM based on sequences of FIGURE 06.
  misc_feature (102)..(143): Pfam Name: zf-C3HC4 Pfam Description: Zinc finger, C3HC4 type (RING finger)
  misc_feature (1)..(164): Functional Homolog Of Ceres SEEDLINE ID no. ME02603 at SEQ ID NO: 166
MGLSSLPGPSEGMLCVILVNTALSISIFKGIVRSVLHVLGIRLSQSSSSPSSVTASSEIPASEPFDFRVSHPESFLEEFRNKTPTLRYESLCRCKKHEDNECSVCLSKFEEDSEINKLKCGHLFHKTCLEKWIDYWNITCPLCRTPLVVVAAAEDQKQLSSNVW

SEQ ID NO: 185 - DNA, 535 bp, Arabidopsis thaliana
  misc_feature (1)..(535): Ceres SEEDLINE ID no.ME02613
  misc_feature (1)..(535): Ceres CLONE ID no.17883
  misc_feature (1)..(535): Encodes the peptide sequence at SEQ ID NO. 186
gaccaaaactctcaaactcagccatggcgaattattacgaaccgccagcttctggaaaccgtcgagacgcagtgaaaggttacaacagcgggagcttcgacgattcagccggcgatcagagtcaaacgaacgattaccagttaaagataaagaaaagcaaaagcgttccaaacgcggatcgtgcggcgtcaagaagctggagtttcagcgatccagaatcgcggaggaagagaagagtcgctggctacaaagtttattccgttgaacagaagatgaagggatccattcgaaagagcttcaaatggttcaaagacattatcggtatttcttgatataccttctctcaactttcttaaaatctcttctttgtgctgtgagagttaaatatatctgtaacgaacaaaaaattgatagtattttctttctcttgcaactatatgtagaagaagagtctttgaacttgaatgagacagataatgaatgaaatcagttttcatatctacatgtgaatatgaccatacttcttcagttacaa

SEQ ID NO: 186 - protein, 102 aa, Arabidopsis thaliana
  misc_feature (1)..(102): Ceres SEEDLINE ID no.ME02613
  misc_feature (1)..(102): Ceres CLONE ID no.17883
  misc_feature (1)..(102): Bit score of 178.9 for HMM based on sequences of FIGURE 07.
MANYYEPPASGNRRDAVKGYNSGSFDDSSGDQSQTNDYQLKIKKSKSVPNADRAASRSWSFSDPESRRKRRVAGYKVYSVEQKMKGSIRKSFKWFKDIIGIS

SEQ ID NO: 187 - DNA, 351 bp, Populus balsamifera subsp. trichocarpa
  misc_feature (1)..(351): Ceres ANNOT ID no.1490274
  misc_feature (1)..(351): Encodes the peptide sequence at SEQ ID NO 188
atggagcatttcagatctaaatcgtgcagggaagggaggatagagatggagggatacgatgaagacaaagcagcaccgacaaacatgcaagatttgaggtcttatagtgtcagctacgcggtttctgtacagccaaatcaatcgggaaaagaagggaagatgaagaaagggaaaagtaatcttgagtcatcttcaaaaagctggagtttcaatgatcccgagctacaaaggaaaagaagggttgctaactacaaggtctatgcgatagagggcaagatgaaagggtccttaaggaagagctttagatggatcaaggacacttgcacccaagtggtctatggatggaggtga

SEQ ID NO: 188 - protein, 116 aa, Populus balsamifera subsp. trichocarpa
  misc_feature (1)..(116): Ceres ANNOT ID no.1490274
  misc_feature (1)..(116): Bit score of 262.0 for HMM based on sequences of FIGURE 07.
  misc_feature (1)..(116): Functional Homolog Of Ceres SEEDLINE ID no. ME02613 at SEQ ID NO: 186
MEHFRSKSCREGRIEMEGYDEDKAAPTNMQDLRSYSVSYAVSVQPNQSGKEGKMKKGKSNLESSSKSWSFNDPELQRKRRVANYKVYAIEGKMKGSLRKSFRWIKDTCTQVVYGWR

SEQ ID NO: 189 - DNA, 351 bp, Populus balsamifera subsp. trichocarpa
  misc_feature (1)..(351): Ceres ANNOT ID no.1499155
  misc_feature (1)..(351): Encodes the peptide sequence at SEQ ID NO 190
atggagcgtttcagatctaggtcatgcagggaagggaggatacagatggagggataccatggagacaaggcggcacctgcaaacatgaaagatttgaggtcttatagtgtcagcaacgcggtttctgcacagccaaatcaattgggcaacgaagtgaagatcaagaaagggaaaagcaatcttgggtcattttcaaaaagatggagtttcaatgatcctgagctgaaaaggaaaagaagggttgctaactacaaggtctatgcaatggagggcaagatgaaggggaccttaaggaagagcattaggtggatcaaggacacttgcacccaagtggttcatggatggaggtga

SEQ ID NO: 190 - protein, 101 aa, Populus balsamifera subsp. trichocarpa
  misc_feature (1)..(101): Ceres ANNOT ID no.1499155
  misc_feature (1)..(101): Bit score of 171.6 for HMM based on sequences of FIGURE 07.
  misc_feature (1)..(101): Functional Homolog Of Ceres SEEDLINE ID no. ME02613 at SEQ ID NO: 186
MEGYHGDKAAPANMKDLRSYSVSNAVSAQPNQLGNEVKIKKGKSNLGSFSKRWSFNDPELKRKRRVANYKVYAMEGKMKGTLRKSIRWIKDTCTQVVHGWR

SEQ ID NO: 191 - protein, 102 aa, Arabidopsis thaliana
  misc_feature (1)..(102): Public GI ID no.18400208
  misc_feature (1)..(102): Bit score of 177.7 for HMM based on sequences of FIGURE 07.
  misc_feature (1)..(102): Functional Homolog Of Ceres SEEDLINE ID no. ME02613 at SEQ ID NO: 186
MANYYEPPASGNRRDAVKGYNSGSFDDSAGDQSQTNDYQLKIKKSKSVPNADRAASRSWSFSDPESRRKRRVAGYKVYSVEQKMKGSIRKSFKWFKDIIGIS

SEQ ID NO: 192 - DNA, 660 bp, Brassica napus
  misc_feature (1)..(660): Ceres CLONE ID no.873093
  misc_feature (1)..(660): Encodes the peptide sequence at SEQ ID NO 193
  misc_feature (249)..(249): s is g or c
  misc_feature (284)..(284): w is a or t/u
  misc_feature (604)..(604): y is t/u or c
  misc_feature (607)..(607): y is t/u or c
  misc_feature (658)..(658): k is g or t/u
ataaatgtccgagagtggaattgagaccagctcaaaagaaacggcgttgcgtgacactattattctcctccctccctttttgtctcttcaataattcttatctgagctgtaaacaagattctctccaactctctctctctcgccggctctctaatggaagattacaaccgtcaaagagcctacggagacacagggatgcagatccagccttaccacggcggcggtccgggaaccggcgacttcaggagstatagcacctcgtacgcgacggagaacaacatctwcaatatcaagaaggagaaatctatagcgaggtcgaagtcttgggggataactgacccggagctccagaggaagaaaagggtggcgagttacaagatgtatagtgttgaaggcaaagtcaaaggctcttttagaaaaagtttcagatggcttaagcagaggtacacacaggtcgtctatggctggtggtgatcaaagagttttccccttttcatcttatttaagcttttgagtattttttctgttttgatattttgattttgatttcctcaagtaattataattgtcttctctctcttatatatctatgtgtgttgtattyttytatgtaattgtgatggccgtaaaattaattataagtttacatattttcctkag

SEQ ID NO: 193 - protein, 106 aa, Brassica napus
  misc_feature (1)..(106): Ceres CLONE ID no.873093
  misc_feature (1)..(106): Bit score of 230.2 for HMM based on sequences of FIGURE 07.
  misc_feature (1)..(106): Functional Homolog Of Ceres SEEDLINE ID no. ME02613 at SEQ ID NO: 186
  misc_feature (32)..(32): Xaa is any aa, unknown or other
  misc_feature (44)..(44): Xaa is any aa, unknown or other
MEDYNRQRAYGDTGMQIQPYHGGGPGTGDFRXYSTSYATENNIXNIKKEKSIARSKSWGITDPELQRKKRVASYKMYSVEGKVKGSFRKSFRWLKQRYTQVVYGWW

SEQ ID NO: 194 - protein, 125 aa, Brassica oleracea
  misc_feature (1)..(125): Public GI ID no.6635384
  misc_feature (1)..(125): Bit score of 257.6 for HMM based on sequences of FIGURE 07.
  misc_feature (1)..(125): Functional Homolog Of Ceres SEEDLINE ID no. ME02613 at SEQ ID NO: 186
MLKSKSCREEMRSSSIAYKYHCLTNGGTPEAVAAPSPTNPQLPVMLRSYSTSTYSPHKNPTTVRDNPNSKSNGKVKKGLKEAEIQRKKRVAAYNVYGVEGKVKGSIRKNFKWFKETCSNAVNGLW

SEQ ID NO: 195 - DNA, 717 bp, Glycine max
  misc_feature (1)..(717): Ceres CLONE ID no.663726
  misc_feature (1)..(717): Encodes the peptide sequence at SEQ ID NO 196
ccattaagaaaacgcaaaaatcatcgctgaaaacataaacaaacatggtctgcctctgctgttagcagctactacctcgctccacaaaaaacaccccctttctcaaatcttaggttgttccaacgatggaagagttcagatccaaatcgtacggtgacggaaggatgcagattgaggcctaccgtggagcgaacattcaagatctccgctgctacagcgcctcctacgcctcttcggtgcacccaacaacaacaacaacaacaacaacgcagacccagatgggaggaaacaacaacaacgaagccaagttcaagaagggaaagtccacaaacgggtccacatcgaaaagttggagctttagtgaccccgaattgcagaggaaaaagagggtcgctagttacaaggtctatgctgttgaaggaaaactcaaaggctctctcaggaagagtttcaagtggctcaaggacaggtgcaacagagttgtctatggctagtaatcacaacaacatcaactatgggtggggattggggtgtcttatatatgatgtaagaatactaattttataatttatttgtatttgtttctttttatctgctgcactttttagtgtttcttttctgtgcctgctgaagtacacataatgggtgtaatgtggaagagaaattgtgattcttgtgttcattctggtccgtcaaaagagtgcaatcaccttgctt

SEQ ID NO: 196 - protein, 122 aa, Glycine max
  misc_feature (1)..(122): Ceres CLONE ID no.663726
  misc_feature (1)..(122): Bit score of 283.5 for HMM based on sequences of FIGURE 07.
  misc_feature (1)..(122): Functional Homolog Of Ceres SEEDLINE ID no. ME02613 at SEQ ID NO: 186
MEEFRSKSYGDGRMQIEAYRGANIQDLRCYSASYASSVHPTTTTTTTTQTQMGGNNNNEAKFKKGKSTNGSTSKSWSFSDPELQRKKRVASYKVYAVEGKLKGSLRKSFKWLKDRCNRVVYG

SEQ ID NO: 197 - protein, 119 aa, Medicago truncatula
  misc_feature (1)..(119): Public GI ID no.92881411
  misc_feature (1)..(119): Bit score of 255.9 for HMM based on sequences of FIGURE 07.
  misc_feature (1)..(119): Functional Homolog Of Ceres SEEDLINE ID no. ME02613 at SEQ ID NO: 186
MEDYNKQIRPYGNSQMMQMEGYYGATNPNYDIRSYSDFSYAQTQRGPNNKDLKLKKGKSISSRSSISKSWSFGDDPEFQRKKRVASYKMYSVEGKVKGSFRKSFKWLKNRYWHVVYSLW

SEQ ID NO: 198 - DNA, 697 bp, Triticum aestivum
  misc_feature (1)..(697): Ceres CLONE ID no.686525
  misc_feature (1)..(697): Encodes the peptide sequence at SEQ ID NO 199
aattttcctttttcctccccgaagcgcagctccacgggcggcttcgcgatggccgccgccgactacgaccgcgcgtaccgcccctacgcgccctcctccgccgccgactacgaccgcccctaccgcaacgagatcgtgccctacggcgaccgccgcatcgacctcgtcgtcaagccgccgccgcccaccaggtccccgccgccgccgttgccggtcaccaagagcggaggcggaggcgggataggctccgcctggtgcttcagcgacccggaggtgaagaggcggcgtcgggtggcgagctacaaggcgtactcggtggagggaaaagtcaaggcctccttccgccggggcttccgctggatcaaggacaagtgcacgggcttcatccatggctgaatccgtggtcttgggtgagttctattgggatcgaagaagacgctgcaacaatgtgcgagtaacggatgctgttgcctttgctaattttgtccatgaggttgtgatggtaacttttgggtcaggtttataggaaacaaaaaagaattaagagcttcctcatgagattgcgttgattgcagatgctgttcttactgtctgctaattagctagttgtttcaagaatgtctcaacaggagttgaatctttggaaaggaactggtgaattttcatgatatctctatgtctctccttaagccacgcc

SEQ ID NO: 199 - protein, 115 aa, Triticum aestivum
  misc_feature (1)..(115): Ceres CLONE ID no.686525
  misc_feature (1)..(115): Bit score of 197.2 for HMM based on sequences of FIGURE 07.
  misc_feature (1)..(115): Functional Homolog Of Ceres SEEDLINE ID no. ME02613 at SEQ ID NO: 186
MAAADYDRAYRPYAPSSAADYDRPYRNEIVPYGDRRIDLVVKPPPPTRSPPPPLPVTKSGGGGGIGSAWCFSDPEVKRRRRVASYKAYSVEGKVKASFRRGFRWIKDKCTGFIHG

SEQ ID NO: 200 - DNA, 754 bp, Zea mays
  misc_feature (1)..(754): Ceres CLONE ID no.1524364
  misc_feature (1)..(754): Encodes the peptide sequence at SEQ ID NO 201
aatccaatcaaatcgagtggagcacatattcgcaaccaccgcgtccagcctccacctccatttctactctgcttcgtcgtcccaacaacccagccgtcatcagggcctctcttcccctcctctgcctcgaccgcccatagcctgcctggtagccatggaccgatccaagtcgtacgcgggcgggcgcatgcaaatcgagccgtactacgacggaggcggcgcgcggccggacttccggtcctactcctacagcgccggcggcagcgggatggggacgtcgtcctacgcgtaccagtacgagtacagcggggcgggggcaggggaagagatgaagcggagcaagtcgaagcggcggtggctggcgctggcggacccggacatggagcgcaagcgccgggtggcggcgtacaaggcgtacggcgtggagggcaagatgaagggctccttccgcaagagcttcaagtggatcaaggaccgctacctcaacctcgtctacgggtggtcctgatcctcaaagtatatatactccatggttttggctctgcatgtttgcttgatatatcatatcatcatcctggattcatggtgagtacatgcatacagtatatatatcagagagagtgtgtgtgtttccatttttcttcttggttggctttgctagatgttgttgttggtgatctgatagtaccaatcagtcaaagtgtattgatgagatgtaacccaaggggctgtttcagaccaaatcgttaaagac

SEQ ID NO: 201 - protein, 117 aa, Zea mays
  misc_feature (1)..(117): Ceres CLONE ID no.1524364
  misc_feature (1)..(117): Bit score of 232.1 for HMM based on sequences of FIGURE 07.
  misc_feature (1)..(117): Functional Homolog Of Ceres SEEDLINE ID no. ME02613 at SEQ ID NO: 186
MDRSKSYAGGRMQIEPYYDGGGARPDFRSYSYSAGGSGMGTSSYAYQYEYSGAGAGEEMKRSKSKRRWLALADPDMERKRRVAAYKAYGVEGKMKGSFRKSFKWIKDRYLNLVYGWS

SEQ ID NO: 202 - DNA, 647 bp, Musa acuminata
  misc_feature (1)..(647): Ceres CLONE ID no.1742159
  misc_feature (1)..(647): Encodes the peptide sequence at SEQ ID NO 203
agagagagagagagagaagggggaaggagggaagagaaggagagacccatcccatggacgacttcagatcgaggtccttcaacgacgggaagatgcagctggaggtgtacggaggccggcgctcgggggcggtcccggcccctccggtcctgcacgactacaggagctacagcgcttcctacttctacacctacgacggcagcggcgtcggctacggcgatttcaaagggaagcctgaccacggttcctccgcgtccaacaagggcgggcgggtcttcaaagaccccgagttccagcggaaacggagggtcgccagctacaaggcctacgccgtggagggcaaggtgaagggctcgctgcggcggagcctccggtggtttaaggataagtacacccgggcggtctacggctggtggtaggacttcgcttccctatcgggtcatgtgtggaaactttgctcgatagttccatccatcgagtattttgctcataaatcatgttcccggaaggggtgaccaaaagaacaacttgtattcttaatagtgtgtacttgtatcaagttatagttagaggctgtatggatcagcaaagatgtatgattatgatctgaagattctgaactgctaatttgttgtgacatttatgct

SEQ ID NO: 203 - protein, 121 aa, Musa acuminata
  misc_feature (1)..(121): Ceres CLONE ID no.1742159
  misc_feature (1)..(121): Bit score of 228.1 for HMM based on sequences of FIGURE 07.
  misc_feature (1)..(121): Functional Homolog Of Ceres SEEDLINE ID no. ME02613 at SEQ ID NO: 186
MDDFRSRSFNDGKMQLEVYGGRRSGAVPAPPVLHDYRSYSASYFYTYDGSGVGYGDFKGKPDHGSSASNKGGRVFKDPEFQRKRRVASYKAYAVEGKVKGSLRRSLRWFKDKYTRAVYGWW

SEQ ID NO: 204 - protein, 145 aa, Oryza sativa subsp. indica
  misc_feature (1)..(145): Public GI ID no.125543535
  misc_feature (1)..(145): Bit score of 246.4 for HMM based on sequences of FIGURE 07.
  misc_feature (1)..(145): Functional Homolog Of Ceres SEEDLINE ID no. ME02613 at SEQ ID NO: 186
MAAADADYEYRAYGAPADHDRPYHGREVVPYGDRRIDVVVKPPGTTTTTTTRSPPPPLPVTKVGGGGGGMGSAWCFSDPEMKRRRRVASYKAYSVEGKVKSSLRRGFRWIKAKCSELIHGWYGSLLLPLSFSLDDFIITSKQALS

SEQ ID NO: 205 - protein, 146 aa, Oryza sativa subsp. indica
  misc_feature (1)..(146): Public GI ID no.125543531
  misc_feature (1)..(146): Bit score of 246.8 for HMM based on sequences of FIGURE 07.
  misc_feature (1)..(146): Functional Homolog Of Ceres SEEDLINE ID no. ME02613 at SEQ ID NO: 186
MAAAAADYEYRAYGAPADHDRPYHGREVVPYGDRRIDVVVKPPGTTTTTTTTRSPPPPLPVTKVGGGGGGMGSAWCFSDPEMKRRRRVASYKAYSVEGKVKSSLRRGFRWIKAKCSELIHGWYGSLLLPLSFSLDDFIITSKQALS

SEQ ID NO: 206 - protein, 159 aa, Oryza sativa subsp. japonica
  misc_feature (1)..(159): Public GI ID no.115463389
  misc_feature (1)..(159): Bit score of 90.3 for HMM based on sequences of FIGURE 07.
  misc_feature (1)..(159): Functional Homolog Of Ceres SEEDLINE ID no. ME02613 at SEQ ID NO: 186
MADYHRPYRSDLDLRPPPPPPSSASFPHSNGYYLPSSSSSSPTANGYFSSKGTGGFAANGDRRIEIYTTAPPPPLPPPPRLALPPPPGRRDGYLGGGGAGGGGGGGGSGGMWCFSDPEMKRRRRVASYKAYSVEGKMKASLRRGLRWFKGKCSEIFHGW

SEQ ID NO: 207 - DNA, 648 bp, Arabidopsis thaliana
  misc_feature (1)..(648): Ceres SEEDLINE ID no.ME02801
  misc_feature (1)..(648): Ceres CLONE ID no.251590
  misc_feature (1)..(648): Inplanta Sequence
  misc_feature (1)..(648): Encodes the peptide sequence at SEQ ID NO. 208
ataaaacaaaaacaaaaatggaaactttacaatgtcgtcatcagcatgtcttcattttgcttcttgtcctatttcattcctctctgtttgttttagcttcaaagatcgatgtttctgacgatgcacgaggcatcagaatcgacggtggccagaaacgttttctaactaattctcctcaacatggcaaggaacatgcagcgtgtacgaacgaagaacctgatctcggtccgctgacgcgtatttcttgcaatgaacctgaatatgttattacaaagatcaatttcgctgattatggcaatcccactggtacatgtggacactttagacgtgacaattgcggtgcacgagctaccatgaggatcgtcaaaaagaattgtcttggaaaagagaagtgtcaccttttggttacggatgagatgtttggtccgagcaagtgcaaaggagctcctatgctcgctgttgaaaccacttgtacaatagcttaggtttcatcatatatttcctgcccctatatagagagatttcttcaagtgtattgtttttgttcatcttttctcgttttggtcaagctgttgtttagagtttctttgatgcatggatctatatgttgtcgtcttgtcgattatgtttcaagtgctttaattttac

SEQ ID NO: 208 - protein, 155 aa, Arabidopsis thaliana
  misc_feature (1)..(155): Ceres SEEDLINE ID no.ME02801
  misc_feature (1)..(155): Ceres CLONE ID no.251590
  misc_feature (1)..(155): Bit score of 394.0 for HMM based on sequences of FIGURE 08.
  misc_feature (75)..(152): Pfam Name: Gal_Lectin Pfam Description: Galactose binding lectin domain
METLQCRHQHVFILLLVLFHSSLFVLASKIDVSDDARGIRIDGGQKRFLTNSPQHGKEHAACTNEEPDLGPLTRISCNEPEYVITKINFADYGNPTGTCGHFRRDNCGARATMRIVKKNCLGKEKCHLLVTDEMFGPSKCKGAPMLAVETTCTIA

SEQ ID NO: 209 - protein, 155 aa, Arabidopsis thaliana
  misc_feature (1)..(155): Public GI ID no.15231742
  misc_feature (1)..(155): Bit score of 390.3 for HMM based on sequences of FIGURE 08.
  misc_feature (75)..(152): Pfam Name: Gal_Lectin Pfam Description: Galactose binding lectin domain
  misc_feature (1)..(155): Functional Homolog Of Ceres SEEDLINE ID no. ME02801 at SEQ ID NO: 208
METLQCRHQHVFILLLVLFHSSLFGLASKIDVSDDARGIRIDGGQKRFLTNSPQHGKEHAACTNEEPDLGPLTRISCNEPGYVITKINFADYGNPTGTCGHFRRGNCGARATMRIVKKNCLGKEKCHLLVTDEMFGPSKCKGAPMLAVETTCTIA

SEQ ID NO: 210 - protein, 156 aa, Arabidopsis thaliana
  misc_feature (1)..(156): Public GI ID no.116831297
  misc_feature (1)..(156): Bit score of 390.3 for HMM based on sequences of FIGURE 08.
  misc_feature (75)..(152): Pfam Name: Gal_Lectin Pfam Description: Galactose binding lectin domain
  misc_feature (1)..(156): Functional Homolog Of Ceres SEEDLINE ID no. ME02801 at SEQ ID NO: 208
METLQCRHQHVFILLLVLFHSSLFGLASKIDVSDDARGIRIDGGQKRFLTNSPQHGKEHAACTNEEPDLGPLTRISCNEPGYVITKINFADYGNPTGTCGHFRRGNCGARATMRIVKKNCLGKEKCHLLVTDEMFGPSKCKGAPMLAVETTCTIAG

SEQ ID NO: 211 - protein, 426 aa, Oryza sativa subsp. indica
  misc_feature (1)..(426): Public GI ID no.116308981
  misc_feature (288)..(342): Pfam Name: bZIP_2 Pfam Description: Basic region leucine zipper
  misc_feature (1)..(426): Bit score of 111.3 for HMM based on sequences of FIGURE 56.
  misc_feature (1)..(426): Functional Homolog Of Ceres SEEDLINE ID no. ME20628 at SEQ ID NO: 1681
MEGEPSRRLSLLDRCDDGSEDPVVPPRVPTILNLASHHRLDRSKFLPLIHPAPARFISSTGSSFPPYSEPPPSAPMLEVGSGFGLEDLYSFFPNHFFSMESISLPPCDVVDVPPVIPLALRSGRSNQGLPSKLPLIEGHRRSHSDIPFGYSQEHPQMPPVASVKPEVTTIEGHQLEDVAAAALKDMGIQAWSPSGSIDKEVKSSGAGSTTHHCRSLSVDSFMMGNLNFGVVGQQMSSPPLLTTEVNVGGGEPIGSTASPFAAELANVKFTEDEKKKIVMDKSLSEIVLTDPRRVKRILNNRASATKSKEKKMKHVGELQRKLQVLQSETTTLGAQVTVMQRNNNELVSQNNELKTRLQAMDQLAQLGDALTSRLAAEAQHLRAVVSEISDPNLPSGPHQQLSSDMDQLQQLLTQRQTSQIQQNQPQ

SEQ ID NO: 212 - protein, 457 aa, Oryza sativa subsp. japonica
  misc_feature (1)..(457): Public GI ID no.115477615
  misc_feature (1)..(457): Bit score of 1058.7 for HMM based on sequences of FIGURE 56.
  misc_feature (318)..(372): Pfam Name: bZIP_2 Pfam Description: Basic region leucine zipper
  misc_feature (1)..(457): Functional Homolog Of Ceres SEEDLINE ID no. ME20628 at SEQ ID NO: 1681
MDDPGAADPGARPHHLSPGQPPVVPRSPTPLDLSSAAAAAAAASYRRLSPSLRPPAHPQARLPSPYPQIPSSSSAAAAGSSGHHARSLSQPLFFSLDSLPPLPYADLAAPPAIPPSPPSSSSDPPPPGLPPRKGGHRRSQSDIPFGFSHLSPPLPPPAPVKREAATAAEGCRSDGDDFALYDLVNSYMDLDGMEALNSSEERHEDRDSRASGTRTGSVADSSENEAESHSTPVERKDGGGKSRHCRSLSVDSFIEKLNFDESPKLPLPSPSGGLSRSGSGSLDGGAASLFGAEFANGEFTEAEKKKIMANERLAEIALTDPKRVKRILANRQSAARSKERKMRYIQELEHKVQVLQTEATTLSAQLTMLQRDSTGLATQNNELKIRLQAMEQQAQLRDALNEALTAEVQRLKLATGEITDGRMSKGLQQQMNSQLIQLQQLQIQQQQSSQTTQQDRL

SEQ ID NO: 213 - DNA, 622 bp, Brassica napus
  misc_feature (1)..(622): Ceres CLONE ID no.981621
  misc_feature (1)..(622): Encodes the peptide sequence at SEQ ID NO 214
aatacattttttttacttttgattacgaagacaacaaaatggatactacacatagctgtcgtcgaggctacatcttgcttctagttctatcttattcctctgtgtttggtttagcttccaatatgagtatttctaatgatacaagcggcaacaaaaccgacagtttctttgaatctcaaagtacttccactgaatggggcacagacatgggcgacaaatatattatgtgtacagaatctaatatggaaattccatggatgatttcttgcaaaaaatctaaagaagtttttacaaggatcaattttgctgattatggaaatccttcgggtaagtgtgaacattatagacacggaaactgcggtgcaaaaactactatggaagtcgccaaaaagaattgtcttggaaaacaccagtgtgtgtttaaggtgtcggacgagatgtttggtacaagtcactgcaaaaaagaggctaagttctttgttcaactcacttgtacaaaagcttaagtttcttagttgctccttaattaataaggtctttaagaaaatggttgcgtggtttattttcttgtaatgatcaagctcttgttgattattaaaggaatgtccgatataagttatct

SEQ ID NO: 214 - protein, 155 aa, Brassica napus
  misc_feature (1)..(155): Ceres CLONE ID no.981621
  misc_feature (1)..(155): Bit score of 389.6 for HMM based on sequences of FIGURE 08.
  misc_feature (75)..(136): Pfam Name: Gal_Lectin Pfam Description: Galactose binding lectin domain
  misc_feature (1)..(155): Functional Homolog Of Ceres SEEDLINE ID no. ME02801 at SEQ ID NO: 208
MDTTHSCRRGYILLLVLSYSSVFGLASNMSISNDTSGNKTDSFFESQSTSTEWGTDMGDKYIMCTESNMEIPWMISCKKSKEVFTRINFADYGNPSGKCEHYRHGNCGAKTTMEVAKKNCLGKHQCVFKVSDEMFGTSHCKKEAKFFVQLTCTKA

SEQ ID NO: 215 - DNA, 1171 bp, Glycine max
  misc_feature (1)..(1171): Ceres CLONE ID no.564714
  misc_feature (1)..(1171): Encodes the peptide sequence at SEQ ID NO 216
  misc_feature (1045)..(1045): y is t/u or c
  misc_feature (1165)..(1165): y is t/u or c
ttcttgaattaactaatattaattatgtgcgatattattgaaatcttttcagggagtcaaccaggcaacagtggcaaatataagttcactgtggacatccctgtcacactagtcgctggaaagaacacaattgatctcttgagtttaactgtgggacttcagaactatggagccttttttgacacatggggagtggggatcactggtccagtgatattgaaaggtttggcaaatggcaacacgcttgatctctcctcccagaagtggacctatcaggttggcctcaaaggggaagatttgggtctgtctagtgggagttcgggacagtggaatttgcaatctaccttccctaagaaccaaccattgacttggtacaagtgatccagttgcaattgacttcacggggatgggaaaaggcgaggcttgggttaatgggcaacgcatcgggcgatactggcctacatatgtcgcttcagatgctagttgcacggactcatgcaattatagaggaccttacagtgcatccaaatgtcgcaagaattgtgaaaagccatcacagacactataccatgtaccgcgatcgtggctgaaaccaagtggcaacattcttgtattgtttgaggaaaggggaggtgatccaacacaaatatctattgtcacaaaacagacagaaagtttgtgtgcgcatgtatccgattctcacccaccacctgtagacttgtggaactcagaaacagaatcaggaagaaaagtaggtcctgtactatcactcacctgccctcatgataaccaagtcatctcttccattaaatttgcaagctatggaacaccccttggaacctgtggtaacttctaccatggacgatgcagcagcaacaaggctctatctattgtgcagaaggcctgcattggatcaagcagttgtagtgttggagtatcaagtgacacattcggagacccttgtagaggaatggcaaagagtttagcagttgaagctacttgtgcatagacatacatgttgcttcaataacactccccaattttytgaagatgattcctgctaataagcaaaactagatttgcaattctaggaacatccaagaaaaaatagtcaactaaaacagtctagtttcacatgcaatgaaagagaaaagtgttaggattyttcttc

SEQ ID NO: 216 - protein, 200 aa, Glycine max
  misc_feature (1)..(200): Ceres CLONE ID no.564714
  misc_feature (1)..(200): Bit score of 543.9 for HMM based on sequences of FIGURE 08.
  misc_feature (122)..(199): Pfam Name: Gal_Lectin Pfam Description: Galactose binding lectin domain
  misc_feature (1)..(200): Functional Homolog Of Ceres SEEDLINE ID no. ME02801 at SEQ ID NO: 208
MGKGEAWVNGQRIGRYWPTYVASDASCTDSCNYRGPYSASKCRKNCEKPSQTLYHVPRSWLKPSGNILVLFEERGGDPTQISIVTKQTESLCAHVSDSHPPPVDLWNSETESGRKVGPVLSLTCPHDNQVISSIKFASYGTPLGTCGNFYHGRCSSNKALSIVQKACIGSSSCSVGVSSDTFGDPCRGMAKSLAVEATCA

SEQ ID NO: 217 - DNA, 790 bp, Arabidopsis thaliana
  misc_feature (1)..(790): Ceres SEEDLINE ID no.ME03123
  misc_feature (1)..(790): Ceres CLONE ID no.4898
  misc_feature (1)..(790): Encodes the peptide sequence at SEQ ID NO. 218
aagtctcttttctcctcgtctctgcctagccgataaattcgccgttctccatcggtaaacgcagctgaggagctagataattctctgatatctgcgttacgccggtgtggaagcaaaatttaggttaatcggatctcaattatggacgaagaggcagcaaaacctagagactccaccgtgaatcagcaacatcaatactattacggaacgtttcaaggcgttgcgaattttcctactcctactccaccaccgcaatttatgcaaccacagcatccgattactacgtttcctggacatgcttaccaaaatctccaaggtcatggtggtggtgtgaattatgctcaaggattcccagttgttgttcctgattatacagtggttgaggtgagaccaatgatagagcatgaacttccttgttgtggcttgggcatgggctggtttctgtttatcatgggcttcttgttcggtgggatcccttggtacctcggtgcttttattgttctagtcacatctgttgatcaccgcgagaaagctggttacgttgcctgttcaatcgcatccgttgtctatttgattgccgtcatgctcgggatgactggggatattaacatctggtgaaactactccccagccaaaaccaaactcaatcttgtatatatatctacatatatactcgaaaacgtagatatatatcaatatcatttacaccagttattgctgattttagtgagttacagaagggaaatatttgtaactttgtgttgaattttatatcataactaaatattgt

SEQ ID NO: 218 - protein, 158 aa, Arabidopsis thaliana
  misc_feature (1)..(158): Ceres SEEDLINE ID no.ME03123
  misc_feature (1)..(158): Ceres CLONE ID no.4898
  misc_feature (1)..(158): Bit score of 296.0 for HMM based on sequences of FIGURE 09.
MDEEAAKPRDSTVNQQHQYYYGTFQGVANFPTPAPPPQFMQPQHPITTFPGHAYQNLQGHGGGVNYAQGFPVVVPDYTVVEVRPMIEHELPCCGLGMGWFLFIMGFLFGGIPWYLGAFIVLVTSVDHREKAGYVACSIASVVYLIAVMLGMTGDINIW

SEQ ID NO: 219 - DNA, 739 bp, Gossypium hirsutum
  misc_feature (1)..(739): Ceres CLONE ID no.1899168
  misc_feature (1)..(739): Encodes the peptide sequence at SEQ ID NO 220
cagtcaaaactctcacagagaagaaacatgagtggtgacgagaaaaacccggctgtagttgtagatcaccagcatcatcaatatgggactttccaaggagtatccaactaccctcctccacctcctccccagcaccatggcccggctattgggtttcctcagcctgttccgccgcctggcctccatgagccctctgctcctcctccacagtattacccccaaggttatcaaaccgttccaggttatgctgttgctgaaggaagacctgtaagagagcgtcgtctaccatgctgtggcattggttttggatggttcttgtttatcattggtttcttccttggggccatcccctggtacattggattgtttgttctactttgtgcgaggatagactaccgagagaagccgggatatattgcttgcacaattgccgctgttcttgctacaattgctattatccttggtgtaacgaagggaatcgatgattgacaagctcttccgagtgggaaaataatgtatatttccttgtaagctatctttatgtcgaattggtttaagaatcagtgtgagcattagtgatgtttgttttatcattgctccgatagcaatggagattgttaaattaaacttctacatagatttattattaagccgatagaaagtgcatatgttaagttgtatgatacacagggtttgcaaatggaacagggaaaacatggttcaatttgatattgtttgc

SEQ ID NO: 220 - protein, 153 aa, Gossypium hirsutum
  misc_feature (1)..(153): Ceres CLONE ID no.1899168
  misc_feature (1)..(153): Bit score of 325.3 for HMM based on sequences of FIGURE 09.
  misc_feature (1)..(153): Functional Homolog Of Ceres SEEDLINE ID no. ME03123 at SEQ ID NO: 218
MSGDEKNPAVVVDHQHHQYGTFQGVSNYPPPPPPQHHGPAIGFPQPVPPPGLHEPSAPPPQYYPQGYQTVPGYAVAEGRPVRERRLPCCGIGFGWFLFIIGFFLGAIPWYIGLFVLLCARIDYREKPGYIACTIAAVLATIAIILGVTKGIDD

SEQ ID NO: 221 - DNA, 543 bp, Populus balsamifera subsp. trichocarpa
  misc_feature (1)..(543): Ceres ANNOT ID no.1494669
  misc_feature (1)..(543): Encodes the peptide sequence at SEQ ID NO 222
atgagcgaccaagagaaaaacaggggagttgttgtagatcaccgccaccatgaagaccaaccaccgccaccgccaccaccccagccccaatatggtacctttcaaggagttgccaattatccaccgccttctcaaagccatgtcatcggctttcctcagcctgtccctcctcctggtatcaccgccgaaccttatgctcagggctaccaaaccgtcccaggttatgctgttgctgaaggaagacctgtgagacaacgtcgcctaccttgttgcggttgtggtgttggctggttcttgtttatcatcggtttctttctgggtgccatcccctggtatattgggttatttatcatagcttgtatgaggatagatccccgagagaaacctggatatgttgcttgcaccattgctctaaggaaacatcttgtcgagcatgagtgccacattgaaataaggtgtctattgcacaatctctgtgtaaaggctattcttgcaacaattgcaattattcttggtgcaacaaagggagctgatgagtggtaa

SEQ ID NO: 222 - protein, 180 aa, Populus balsamifera subsp. trichocarpa
  misc_feature (1)..(180): Ceres ANNOT ID no.1494669
  misc_feature (1)..(180): Bit score of 303.9 for HMM based on sequences of FIGURE 09.
  misc_feature (1)..(180): Functional Homolog Of Ceres SEEDLINE ID no. ME03123 at SEQ ID NO: 218
MSDQEKNRGVVVDHRHHEDQPPPPPPPQPQYGTFQGVANYPPPSQSHVIGFPQPVPPPGITAEPYAQGYQTVPGYAVAEGRPVRQRRLPCCGCGVGWFLFIIGFFLGAIPWYIGLFIIACMRIDPREKPGYVACTIALRKHLVEHECHIEIRCLLHNLCVKAILATIAIILGATKGADEW

SEQ ID NO: 223 - protein, 158 aa, Arabidopsis thaliana
  misc_feature (1)..(158): Public GI ID no.18397305
  misc_feature (1)..(158): Bit score of 293.7 for HMM based on sequences of FIGURE 09.
  misc_feature (1)..(158): Functional Homolog Of Ceres SEEDLINE ID no. ME03123 at SEQ ID NO: 218
MDEEAAKPRDSTVNQQHQYYYGTFQGVANFPTPTPPPQFMQPQHPITTFPGHAYQNLQGHGGGVNYAQGFPVVVPDYTVVEVRPMIEHELPCCGLGMGWFLFIMGFLFGGIPWYLGAFIVLVTSVDHREKAGYVACSIASVVYLIAVMLGMTGDINIW

SEQ ID NO: 224 - DNA, 612 bp, Triticum aestivum
  misc_feature (1)..(612): Ceres SEEDLINE ID no.ME13006
  misc_feature (1)..(612): Ceres CLONE ID no.1017441
  misc_feature (1)..(612): Encodes the peptide sequence at SEQ ID NO 225
aggtcttttagatcgatcggatctgaatcatggacgaggaggcagcaaaacctagagacaccaccataaaccagcaacaacaatactattacggaacgtttcaaggcgttgcaaattatcctcctcccgctccgccaccgcttccgcatcaacctattgtcacgagtcccttgcttcctcctgtacatggttatcagactctccaagaatatacagtggttgaggtgagaccggtgagagagcatgacgttccttgctgtggctttggcatgggctggttcttgtttattatgggcttcttgttcggtgggatcccttggtatctcggtgctgttattattcttttcacctcagttgatcatcgcgagaaggctggttacgttgcttgttctgtcgcatccgttgtctatttgattgccgtcatgctcgggatggctgggaatattaacatcatctggtgacagatactcccttacatatcacatttcaataacgtatatgcatcatcataaccatagtgatttacaaaagcaaatgttgttattctgtgttgtatttatttgtttacaacaatgatcaatatgttcttgattcctttgatggcatcttcct

SEQ ID NO: 225 - protein, 143 aa, Triticum aestivum
  misc_feature (1)..(143): Ceres SEEDLINE ID no.ME13006
  misc_feature (1)..(143): Ceres CLONE ID no.1017441
  misc_feature (1)..(143): Bit score of 284.3 for HMM based on sequences of FIGURE 09.
  misc_feature (1)..(143): Functional Homolog Of Ceres SEEDLINE ID no. ME03123 at SEQ ID NO: 218
MDEEAAKPRDTTINQQQQYYYGTFQGVANYPPPAPPPLPHQPIVTSPLLPPVHGYQTLQEYTVVEVRPVREHDVPCCGFGMGWFLFIMGFLFGGIPWYLGAVIILFTSVDHREKAGYVACSVASVVYLIAVMLGMAGNINIIW

SEQ ID NO: 226 - DNA, 669 bp, Zea mays
  misc_feature (1)..(669): Ceres CLONE ID no.1065937
  misc_feature (1)..(669): Encodes the peptide sequence at SEQ ID NO 227
atctcaatctcgatttgagacgaaaaggaagagaagctgaagctaaagatgggtcaaggagaagaagacaaaagcaaaggcttcgctgatgaagcaggcacccatcatcagtacggtacgtttcaaggcgtttccaattaccctcctccgcggcctcagaactctcctccggtcactgggtttcctcagccttctgctccgcctcgagtctacgattccgcccctcctcattacgcccatggttatcaaaccgttccggtacatggtattgctgaaggaagacctgtgcatgtgcgacaacgccgccttccttgctgtggaattggtcttggatggttcctgttcatagttgggtttttccttggagcaatcccttggtacgtcggaatgttcatcatgatagttggaaggaggattgaccacagggagaagccaggatacattgcttgcaccatcgctgctatacttgcaacaattgctgtgattcttggtgtaactaaaggagcagaagactggtgatcaatcaaaactatctttgtggtcaagtcagaacgtttgtataggtgtcagacaaacatttcgtcttgtattttattatattcgtgctgcttgaagaaagacaaaaaggtgtaaacttaataaaaagatatgagttaagttatttgcaag

SEQ ID NO: 227 - protein, 156 aa, Zea mays
  misc_feature (1)..(156): Ceres CLONE ID no.1065937
  misc_feature (1)..(156): Bit score of 317.1 for HMM based on sequences of FIGURE 09.
  misc_feature (1)..(156): Functional Homolog Of Ceres SEEDLINE ID no. ME03123 at SEQ ID NO: 218
MGQGEEDKSKGFADEAGTHHQYGTFQGVSNYPPPRPQNSPPVTGFPQPSAPPRVYDSAPPHYAHGYQTVPVHGIAEGRPVHVRQRRLPCCGIGLGWFLFIVGFFLGAIPWYVGMFIMIVGRRIDHREKPGYIACTIAAILATIAVILGVTKGAEDW

SEQ ID NO: 228 - DNA, 1202 bp, Panicum virgatum
  misc_feature (1)..(1202): Ceres CLONE ID no.1822919
  misc_feature (1)..(1202): Encodes the peptide sequence at SEQ ID NO 229
atcatcactctactccttccagatcccaccgcgcgactcccgctgcgacacgcacgcctcacctcgtcgcctccgtcaacggtcaacccaccgcccatgggaggagggcaggagcaggaggccgacgccggcaagtccgggggctactcctcctccggcctcccgccgtcggagccgtcgcagcagtacgggtacggcacgttccagggctctcgcgctggctcgggcgagttccggaagccgcccgtcgggttcccgcagcccgccccgcctcccggattcggcggcggcggctaccacaaccagcagcagccctacacgccagaggagccgtactacgcccaggggtaccaggccgtgccaggctatggtcaagtagctgaaggaagacctgtgagaatgcggcgtctcccatgttgtggcctcggcttaggctggtgcctgttcatcactggttttttccttgccgccattccatggtatattggagcttttattatgatatgtgttcgggtacatgaccacagagagaaaccaggatacgtagcatgcacaatcgctgtaagttcctttctactaatacaatgcaacctcactgtttatttcacctctgggatttgagactgagctgcatggaactaacgaagcaaactgtttgatactcatctttgttattattccttaaatgaaaacatactaagtgtactaaatacagttaggttcttgttaagggtttatatttgcataatgctgaatattaatcttaatctaaaaaatgctgaatattaatgggattgacatggttgctcaacatttatacataactatatacataagtgctaacttttgacttcattgctcgctgactgtatcatttgatctgaattccttcatttttctggaatctcaagctgattttgctcctaatgatgatgtatcttacacaggccgcaattgctgcagttgccatcatcctgggggttactaaaggaactcatgtatggtgaattgcctccagagtccagagttttggcaatggccaaatgcaacccatcgatgtatttgcttgttggtgttgtacatatatgtattaatgtatattatgaagtgtgagcaacatccatgtgtattgtactttgtaataagattttaaacgtacaatctgtgtaagcattggatcatataataagataccatggtgg

SEQ ID NO: 229 - protein, 174 aa, Panicum virgatum
  misc_feature (1)..(174): Ceres CLONE ID no.1822919
  misc_feature (1)..(174): Bit score of 363.3 for HMM based on sequences of FIGURE 09.
  misc_feature (1)..(174): Functional Homolog Of Ceres SEEDLINE ID no. ME03123 at SEQ ID NO: 218
MGGGQEQEADAGKSGGYSSSGLPPSEPSQQYGYGTFQGSRAGSGEFRKPPVGFPQPAPPPGFGGGGYHNQQQPYTPEEPYYAQGYQAVPGYGQVAEGRPVRMRRLPCCGLGLGWCLFITGFFLAAIPWYIGAFIMICVRVHDHREKPGYVACTIAVSSFLLIQCNLTVYFTSGI

SEQ ID NO: 230 - protein, 189 aa, Oryza sativa subsp. indica
  misc_feature (1)..(189): Public GI ID no.125553329
  misc_feature (1)..(189): Bit score of 390.8 for HMM based on sequences of FIGURE 09.
  misc_feature (1)..(189): Functional Homolog Of Ceres SEEDLINE ID no. ME03123 at SEQ ID NO: 218
MGGGREEEAASKVGYSSGDLPPSAPPHLQGQDPQQYQYGTFQPPPHHHAASGELARPPVGFPQPAPPPGFAGASGGGGHYHHHHQQQPYAPAEPYYAQGYQTGPGYGSIAEGRPVRMRRLPCCGLGLGWLLFIAGFFLAAIPWYVGAFILICVRVHDYREKPGYVACTVAAVIAAIVIPLGLTKGAHVW

SEQ ID NO: 231 - protein, 185 aa, Oryza sativa subsp. japonica
  misc_feature (1)..(185): Public GI ID no.115439053
  misc_feature (1)..(185): Bit score of 364.3 for HMM based on sequences of FIGURE 09.
  misc_feature (1)..(185): Functional Homolog Of Ceres SEEDLINE ID no. ME03123 at SEQ ID NO: 218
MAGEMPDADGKPRSASSGFQPSAPPQPQAQQYQYGTFGAPSSAPGEVPQPAVGFPQPAPPPGLRHYPQPPPPSYAVYPPLPPQTYPAAAPYYALGYQAVQGYIPVVEGRPVRMRRLPFCGLGMGWFLFIIGFFLAAIPWYIGAFVLICVRVHDYREKPGYVACTIAASLAAIAILLGVTRGEEIW

SEQ ID NO: 232 - protein, 141 aa, Oryza sativa subsp. japonica
  misc_feature (1)..(141): Public GI ID no.115468006
  misc_feature (1)..(141): Bit score of 110.9 for HMM based on sequences of FIGURE 09.
  misc_feature (1)..(141): Functional Homolog Of Ceres SEEDLINE ID no. ME03123 at SEQ ID NO: 218
MQEAEEPSTKLPSRSPLDGPAPPPYHHHHYGTFLPPPPPQQQQQQKPDGAASNHPFPAGYAAQGVVAFPCTVQQLVLVEGVPIREPPLPFCGIGLGWILFLLGFFLAALPWYAGAFILFFVALDHREKPGLIACTIANYAY

SEQ ID NO: 233 - DNA, 691 bp, Arabidopsis thaliana
  misc_feature (1)..(691): Ceres SEEDLINE ID no.ME04204
  misc_feature (1)..(691): Ceres CLONE ID no.148977
  misc_feature (1)..(691): Inplanta Sequence
  misc_feature (1)..(691): Encodes the peptide sequence at SEQ ID NO. 234
tattatcttgttccaggtgtcatttgccaactctgtacattggaatggagtatatgcgaactcacagctacaagcttgcggaccagtttttcatgcaagcaaaggcgatatgcccttcggatccacttgtttataatgaactcggagttgttgcatatcatatgaaagagtatggtaaagctgtgcggtggtttgagaagacattggcccatataccatctgcattaactgaatcctgggaaccaactgtggtcaatcttgctcatgcatatagaaagctaagaaaggaccgtgaagctatctcctattatgaaagagcacttacactatcaactaaaagcttaagcacttattccggcttggcttacacttaccatttgcaggggaatttctcagctgccatctcatattatcacaaggccttgtggttgaaacctgatgatcaattttgtacggaaatgttgaacgtggctctcatggatgaatgtcagaacggggttgattcaaaggttgagctctgctaggaattggtcagttaaaattaaccgccttattctagttcttgttgtaatttatctgtactatcatcattgtgacgcctaacataacttataatttattccatgcatcaataaccaagagactgttacaatatattctttaaagggtcaaatacacttctgcttttctt

SEQ ID NO: 234 - protein, 159 aa, Arabidopsis thaliana
  misc_feature (1)..(159): Ceres SEEDLINE ID no.ME04204
  misc_feature (1)..(159): Ceres CLONE ID no.148977
  misc_feature (1)..(159): Bit score of 373.0 for HMM based on sequences of FIGURE 10.
  misc_feature (100)..(133): Pfam Name: TPR_1 Pfam Description: Tetratricopeptide repeat
  misc_feature (27)..(60): Pfam Name: TPR_2 Pfam Description: Tetratricopeptide repeat
MEYMRTHSYKLADQFFMQAKAICPSDPLVYNELGVVAYHMKEYGKAVRWFEKTLAHIPSALTESWEPTVVNLAHAYRKLRKDREAISYYERALTLSTKSLSTYSGLAYTYHLQGNFSAAISYYHKALWLKPDDQFCTEMLNVALMDECQNGVDSKVELC

SEQ ID NO: 235 - DNA, 1635 bp, Populus balsamifera subsp. trichocarpa
  misc_feature (1)..(1635): Ceres ANNOT ID no.1519952
  misc_feature (1)..(1635): Encodes the peptide sequence at SEQ ID NO 236
atgagagaagagcagatagagaagcttcgaggggtagtgcgtgactgtgtgagcaagcacttatactcctctgccattttcttcgccgacaaagtcgccgccttcaccgacgatcccgctgacatctacatgcaagctcaggctctcttcctcggccgccactaccgccgcgcctaccacctcctcaacgcctccaaaatagtccttcgcgacctccgtttccgctacctcgccgccaaatgcctcgaggaattgaaagagtgggaccagtgtttgttaatgcttggtgatgcaaaagttgatgaacatggaaatgtatatgacactaaagactgtaatgttatgtacttagataaggatagtgaagatcgcgagatcaatatttcttcagcaatatgttttctaagaggtagggcttatgaagcattggaaaatcgtgctctagctcgacattggtacaaagctgctatcaaggctgatcctttatgttatgaggctttggaatgccttattgaaaatcacatgctcacatttgaagaagaaacaagtctactttcctccttgcaatttggtcctgaagataggtggctctcttcattctactcttgcttgataaaaaagtatgacaaagagtgtgtcatagaagccaaattcagagaagttgaaaaagaaagctgcaatagcaatccttctagcccttctttcatgcatacactaaaaaacaacaccgatcttttggcttgtaaagcagagtacttcaatcagtgtggtgaatatcagaaatgctttgaactaacttcagatctgcttgagaaggacccttttcatttgaaatgtacattggtacatttagcagctgctgtggagcttggaaattcaaatgagctgtatctcatggcatctaacttggtgaaggattatcctcaaaagactctctcatggtttgctgttggctgttactactactgtatcaagaagtatgatcaatcacggcgttatttcagcaaggctaccagtctagatggaacctttgcacctgcttggattggctttgggaatgcttatgctgctcaagaagagggtgatcaagcaatgtcggcatatcgcaccgctgctcgtttattcccagggtgtcatttgccaactttgtatattgggatggaatacatgcgaactcacagctataagcttgctgagcagtttttcatgcaggcaaagacaatttgcccttcagatccacttgtatacaatgaacttggtgttgttgcttataatatgaaggagtacaacaaggcagtgttgtggtttgagaagactttgaagcacattccttcgttgagtcaattgtgggaaccaactgtcattaatcttgcccatgcctacagaaagttaaagatttaccatgaagcaatttcatgctatgagagagcacttgcattatcaactagaagcttgagtacttatgctggtcttgcatacacttatcatttgcaggataactttactgctgcaattacatgctaccacaaggctttatggctgaaaccggatgatcaattttgcactgaaatgttgagcctggcacttgtagatgaaggtcgtcgaggcatcgaccccaaaattgaatttcgatga

SEQ ID NO: 236 - protein, 158 aa, Populus balsamifera subsp. trichocarpa
  misc_feature (1)..(158): Ceres ANNOT ID no.1519952
  misc_feature (1)..(158): Bit score of 366.3 for HMM based on sequences of FIGURE 10.
  misc_feature (27)..(60): Pfam Name: TPR_2 Pfam Description: Tetratricopeptide repeat
  misc_feature (99)..(132): Pfam Name: TPR_1 Pfam Description: Tetratricopeptide repeat
  misc_feature (1)..(158): Functional Homolog Of Ceres SEEDLINE ID no. ME04204 at SEQ ID NO: 234
MEYMRTHSYKLAEQFFMQAKTICPSDPLVYNELGVVAYNMKEYNKAVLWFEKTLKHIPSLSQLWEPTVINLAHAYRKLKIYHEAISCYERALALSTRSLSTYAGLAYTYHLQDNFTAAITCYHKALWLKPDDQFCTEMLSLALVDEGRRGIDPKIEFR

SEQ ID NO: 237 - DNA, 1599 bp, Populus balsamifera subsp. trichocarpa
  misc_feature (1)..(1599): Ceres ANNOT ID no.1536363
  misc_feature (1)..(1599): Encodes the peptide sequence at SEQ ID NO 238
atgagagaagagcaaatagagaagctgcgaggggtagtgcgcgactgcgtgagcaagcacttgtactcctccgccattttcttcgccgacaaagtcgccgctttcaccaacgaccccgccgacatctacatgcaagcccaggctctcttcctcggccgccactaccgtcgtgcctaccacctcctcaacgcctccaaaatcgtccttcgcgacctccgcttccgctacctcgccgcaaaatgcctcgaggaattgaaagagtgggaccagtgtttgttaatgctcggtgatgcaaaggttgatgagcatggagatgtatatgatactaaagattgtaacgttatgtacttagataaggatagtgaagatcgcgagatcaatatttctgcagcaacatgttttctaagaggcagggcttatgaagcattggaaaatcgtgccctggctcgacagtggtacaaggctgctatcaaggccgatcctttatgctatgaggctttggaatgccttattgaaaatcacatgctcacatgtgaagaagaaacaaggctgctttcctccttgcaattcggtccagaagatgggtggctctcttcattctactcatgcttgataaaaaagtatgaaaaaaagagtgttgtagaagccaaattcagagaagttgaaaaagaaagctgcaatagcaatccttctagcccatctatcaagcatacactaaaaaatgatactgatcttttgacctgcaaagcagagtacttcaatcagtgtggtgaatatcagaaatgctttgaactaacttcagacctgcttgagaaagacccttttcatttgaaatgtaccttagtacacatagctgctgctatggagcttggaaattcaaatgagctttatcttatggcatcgaacttagtgaaggattatcctcaaaaggctctctcatggtttgctgtcggctgctactactactgtatcaagaagtatgatcaatcacggcgttatttcagcaaggctacaagtctagagggaacctttgcacctgcttggattggctttgggaatgcttatgctgctcaagaagagggtgatcaagcaatgtcggcataccgcactgctgctcgtttatttccagggtgccatttaccaactttgtatattgggatggagtacatgcgaactcacagctataagcttgctgagcagtttttcatgcaggcaaaggcaatttgcccttcagatccacttgtatacaacgaacttggtgttgttgcttataacatgaaggagtacaataagtctgtgttgtggtttgagaagactttgaagcacattccgtctttaagtcaattgtgggaaccaactattgttaatcttgcccatgcctacagaaagttgaagatttaccatgaagcaatttcatattatgagagagcacttacactatcacctagaagcttgagtacttatgctggtcttgcatacacttatcatttgcaggctttatggctgaaaccagatgatcaattttgcactgaaatgctgagcttggcacttgtagatgaaggtcgtcgaggcacggaccccaaaattgaattccgctga

SEQ ID NO: 238 - protein, 146 aa, Populus balsamifera subsp. trichocarpa
  misc_feature (1)..(146): Ceres ANNOT ID no.1536363
  misc_feature (1)..(146): Bit score of 310.6 for HMM based on sequences of FIGURE 10.
  misc_feature (27)..(60): Pfam Name: TPR_1 Pfam Description: Tetratricopeptide repeat
  misc_feature (65)..(98): Pfam Name: TPR_1 Pfam Description: Tetratricopeptide repeat
  misc_feature (1)..(146): Functional Homolog Of Ceres SEEDLINE ID no. ME04204 at SEQ ID NO: 234
MEYMRTHSYKLAEQFFMQAKAICPSDPLVYNELGVVAYNMKEYNKSVLWFEKTLKHIPSLSQLWEPTIVNLAHAYRKLKIYHEAISYYERALTLSPRSLSTYAGLAYTYHLQALWLKPDDQFCTEMLSLALVDEGRRGTDPKIEFR

SEQ ID NO: 239 - protein, 143 aa, Arabidopsis thaliana
  misc_feature (1)..(143): Public GI ID no.26451171
  misc_feature (1)..(143): Bit score of 300.6 for HMM based on sequences of FIGURE 10.
  misc_feature (11)..(44): Pfam Name: TPR_2 Pfam Description: Tetratricopeptide repeat
  misc_feature (84)..(117): Pfam Name: TPR_1 Pfam Description: Tetratricopeptide repeat
  misc_feature (1)..(143): Functional Homolog Of Ceres SEEDLINE ID no. ME04204 at SEQ ID NO: 234
MQAKAICPSDPLVYNELGVVAYHMKEYGKAVRWFEKTLAHIPSALTESWEPTVVNLAHAYRKLRKDREAISYYERALTLSTKSLSTYSGLAYTYHLQGNFSAAISYYHKALWLKPDDQFCTEMLNVALMDECQNGVDSKVELC

SEQ ID NO: 240 - DNA, 1888 bp, Zea mays
  misc_feature (1)..(1888): Ceres CLONE ID no.234768
  misc_feature (1)..(1888): Encodes the peptide sequence at SEQ ID NO 241
aaatttcggtttccctcgcgtcctgcccacatcgtccgcatccgccgagcctagccccaagcggaggagaataggagaggccaccgatccgccgccggagatgagggaggaggcactggagcggctgcgcggggtggtgcgggacagcgccggtaagcacctctacacgtcggccatcttcctcgctgacaaggtggctgcggccacgggggatcctggcgacgtctacatgctcgcgcaggcactctttctcggccgccaattccgccgcgcgctccacctcctcaacaattctcgtctgctccgcgacctccggttcagattcctcgccgccaagtgcctcgaggagttgaaagagtggcatcagtgtttgttgatgcttggggatgcaaaagtggatgagcatggaaatgtccttgatcatgatgttggcagtgatatatattttgacaaggacgctgaagatcatgagatcaatatcaaatcagctctatgtttcttacgtggcaaggcgtatgaagcactggataaccgtgatcttgctcgccaatggtacaaggcagctgttaaagccgatcctctgtgttatgaggctattgaatgtcttgttgataattatatgttgacatgtgaggaagaagttgagttattgtcctctctgcaattcggtgaagaagatgggtggctatcagcattctattcatgtttggtcacgaagcatgaaaaagaatatttagttgaagcaaaattcaaggaacttgagcaagaagcttgtagtatttcgtcctcgagttctggtgaaacaatgaaaaataacattgatgttttggtttgcaaagctgaatactaccaccagagtggagagtaccaaaaatgttttaaactcacatcctcgttacttgagagagaccctttccatttaaagtgcacattagttcatttggcaactgcaatggagcttggtcattgcaatgatctttatcttttggcatgcaacttagtgaaggattatcctcaaaaagctctttcatggtttgctgttggttgctattactactgtatcaagaagtatgatcaagcgcgaagatacttcggcaaagctacaggtttagatggggcatttcctcctgcttggattggtacaggcattgcctatgctgctcaagaggagggtgaccaagcaatggctgcgtttcggacggcagctcggttatttcctggatgccatctgccaactttatacatgggcatgcagtatgtgcgaatgcacaatttcaaacttgcagagcagttcttcacacaagcaaaatccatctgcccatctgatccacttattcacaatgagttgggggtcgttgcatataatatgaaggaggaataccagaaagcagtatcatattatgcaaaggcactcacttttccaaccaaaagtttgagtgcatttgctggtcttgcttacacttatcatcttatggatgattttgaggctgccataaattattaccataaggctctatggttgaaaccagacgaccagttttgcacagacatgctaacatatgctcttgagtccatctgccaaatcactgctcgtagaaagcctggtcgaggtttgctaaccgcaacaggtggtgtcacatgctagggtattattttccttacagacatagtagtagctaattatatgtaaatttgttggtgtacaatatgtaattgctcaagttcatttcagtcactcgaggctgatcgtagtgtaaagccagacattttctgtaccttttaatttatactagaaataggcagcgtccgaggacgctttgtaccagccacctacactatggaaaaactggggagagaccggagttgcaagatcaggttgttcagaggc

SEQ ID NO: 241 - protein, 131 aa, Zea mays
  misc_feature (1)..(131): Ceres CLONE ID no.234768
  misc_feature (1)..(131): Bit score of 258.8 for HMM based on sequences of FIGURE 10.
  misc_feature (27)..(61): Pfam Name: TPR_1 Pfam Description: Tetratricopeptide repeat
  misc_feature (62)..(95): Pfam Name: TPR_1 Pfam Description: Tetratricopeptide repeat
  misc_feature (1)..(131): Functional Homolog Of Ceres SEEDLINE ID no. ME04204 at SEQ ID NO: 234
MQYVRMHNFKLAEQFFTQAKSICPSDPLIHNELGVVAYNMKEEYQKAVSYYAKALTFPTKSLSAFAGLAYTYHLMDDFEAAINYYHKALWLKPDDQFCTDMLTYALESICQITARRKPGRGLLTATGGVTC

SEQ ID NO: 242 - protein, 133 aa, Oryza sativa subsp. japonica
  misc_feature (1)..(133): Public GI ID no.108707052
  misc_feature (1)..(133): Bit score of 266.8 for HMM based on sequences of FIGURE 10.
  misc_feature (27)..(60): Pfam Name: TPR_2 Pfam Description: Tetratricopeptide repeat
  misc_feature (66)..(99): Pfam Name: TPR_1 Pfam Description: Tetratricopeptide repeat
  misc_feature (1)..(133): Functional Homolog Of Ceres SEEDLINE ID no. ME04204 at SEQ ID NO: 234
MQYLRMHNFKLAEQFFTQAKSICPSDPLIYNEMGVVAYNMKEYQKAVQWFELTLEHTSSSLNEMWEPTLVNLGHALRKLKKYQKAISYYEKALTFQTKSLSAFAGLAYTYHLMAMYHVHRAEVLQILTKEPGR

SEQ ID NO: 243 - protein, 121 aa, Oryza sativa subsp. japonica
  misc_feature (1)..(121): Public GI ID no.115451781
  misc_feature (1)..(121): Bit score of 222.2 for HMM based on sequences of FIGURE 10.
  misc_feature (27)..(60): Pfam Name: TPR_2 Pfam Description: Tetratricopeptide repeat
  misc_feature (66)..(99): Pfam Name: TPR_1 Pfam Description: Tetratricopeptide repeat
  misc_feature (1)..(121): Functional Homolog Of Ceres SEEDLINE ID no. ME04204 at SEQ ID NO: 234
MQYLRMHNFKLAEQFFTQAKSICPSDPLIYNEMGVVAYNMKEYQKAVQWFELTLEHTSSSLNEMWEPTLVNLGHALRKLKKYQKAISYYEKALTFQTKSLSAFAGLAYTYHLMFDTSTVTF

SEQ ID NO: 244 - protein, 237 aa, Ostreococcus tauri
  misc_feature (1)..(237): Public GI ID no.55978030
  misc_feature (1)..(237): Bit score of 587.9 for HMM based on sequences of FIGURE 10.
  misc_feature (27)..(60): Pfam Name: TPR_2 Pfam Description: Tetratricopeptide repeat
  misc_feature (66)..(99): Pfam Name: TPR_1 Pfam Description: Tetratricopeptide repeat
  misc_feature (1)..(237): Functional Homolog Of Ceres SEEDLINE ID no. ME04204 at SEQ ID NO: 234
MEYQRTNNLSLAFQFFRKAFEMCDSDPLLFNEYGVLRYRQGNYEEAVENFERALDLAPKPVGSRWESLIVNLAQAFRKIGRYDEAIATFQSALLISPRNASTYAALAFTYQMKSRCSEPVSLGLAIEYYHKALSLRADDAFSQHHLELALIDQSAITIPRHQQVEWDTMFPKVEDINAVTPTFGIASSPQGGILFPTPSPHSFQGTPTFGQTPFSARVDRMDESVDMDQSVDMDESE

SEQ ID NO: 245 - DNA, 974 bp, Arabidopsis thaliana
  misc_feature (1)..(974): Ceres SEEDLINE ID no.ME04477
  misc_feature (1)..(974): Ceres CLONE ID no.24255
  misc_feature (1)..(974): Inplanta Sequence
  misc_feature (1)..(974): Encodes the peptide sequence at SEQ ID NO. 246
aaacacatctctctctctctctctctctttctctctttttatatttttgtgtcccaatctcttcttcatttctgtttggttgccgagaaaacgcaggaaacttttctgcaaaaaaactcggtgaccatatttaaaactttcccacgttaattctctcttctttgttttgtttcagattcattacttttctccaaaaaactttcttcaagatctgctcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgcgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtccc

SEQ ID NO: 246 - protein, 161 aa, Arabidopsis thaliana
  misc_feature (1)..(161): Ceres SEEDLINE ID no.ME04477
  misc_feature (1)..(161): Ceres CLONE ID no.24255
  misc_feature (1)..(161): Bit score of 371.9 for HMM based on sequences of FIGURE 11.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 247 - DNA, 586 bp, Papaver somniferum
  misc_feature (1)..(586): Ceres CLONE ID no.1620215
  misc_feature (1)..(586): Encodes the peptide sequence at SEQ ID NO 248
atctccaaaacaatcaaaaatctgcaaaaaaaaaaaaaatcatttctcaaattctactcagattcatggctcagagagataaagaagaaacagaaatgaaggtttctgaatccttatcactttgcatcaacaactgtggtttctcaggtaatccggctaccaagaacatgtgtcaaagttgttacaaaatttctaccgggattatgacacaaccggctctgacgttttccggcaaagaaaaggctagatctagctttctgaggttgccggagcgatcggattatcaacgacgagatctgattacgcaggatgataagaaaggaattgatgatgatcaagcgaagaatgattcgacgacaattaagattgttgagaagaagcaagaggtgaatcggtgttcaggttgccggaggaaagtaggattgaccggatttagatgtcggtgcggtgatatgttctgttcggaacatagatattccgatcgacatgactgtagttttgattataaagctgctggtagagagagtattgctcgccagaatcctgtcgttaaagctgctaagattattagactctaaattaatgt

SEQ ID NO: 248 - protein, 170 aa, Papaver somniferum
  misc_feature (1)..(170): Ceres CLONE ID no.1620215
  misc_feature (1)..(170): Bit score of 313.7 for HMM based on sequences of FIGURE 11.
  misc_feature (111)..(151): Pfam Name: zf-AN1 Pfam Description: AN1-like Zinc finger
  misc_feature (17)..(41): Pfam Name: zf-A20 Pfam Description: A20-like zinc finger
  misc_feature (1)..(170): Functional Homolog Of Ceres SEEDLINE ID no. ME04477 at SEQ ID NO: 246
MAQRDKEETEMKVSESLSLCINNCGFSGNPATKNMCQSCYKISTGIMTQPALTFSGKEKARSSFLRLPERSDYQRRDLITQDDKKGIDDDQAKNDSTTIKIVEKKQEVNRCSGCRRKVGLTGFRCRCGDMFCSEHRYSDRHDCSFDYKAAGRESIARQNPVVKAAKIIRL

SEQ ID NO: 249 - protein, 137 aa, Gossypium barbadense
  misc_feature (1)..(137): Public GI ID no.38016527
  misc_feature (1)..(137): Bit score of 222.6 for HMM based on sequences of FIGURE 11.
  misc_feature (10)..(34): Pfam Name: zf-A20 Pfam Description: A20-like zinc finger
  misc_feature (103)..(130): Pfam Name: zf-AN1 Pfam Description: AN1-like Zinc finger
  misc_feature (1)..(137): Functional Homolog Of Ceres SEEDLINE ID no. ME04477 at SEQ ID NO: 246
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 250 - DNA, 894 bp, Gossypium hirsutum
  misc_feature (1)..(894): Ceres CLONE ID no.1798756
  misc_feature (1)..(894): Encodes the peptide sequence at SEQ ID NO 251
gatctttctgataatcctttcctttgttcatattctccctttctgcttcttatttattttctttcaccttttcctttcaagatcgagagaaaaaagaatggcagaggagcatagatgccaagcgccagaaggccatcgtctttgcgtcaataactgcggctttttcggaagttcggcgacgatgaacctttgctccaaatgttacagagatctctgtctcaaggaacaggaagcttcttcgatcaaatccgctctttcctcttccccttcgtcttcatcaacggtcgtcgaatccatttctcaggttcctcttttggctctccatgaagtcaacagagaatcggcggttccggagattgcatcggcggccgaacagcgatcgcagcaacaaccgaatcggtgcatggtttgcaggaagcgggtcgggttgaccggattcagatgcaagtgcggtgttacgttttgtgggtcccacaggtaccctgagaatcacgggtgtacgttcgatttcaagaaggtcggcagagaggagatagcacgcgctaatcccctcgtcaaagcagagaagctcgagaagatttgagtagaagatgatgatgatgggaagccaagccattgggaaaatttcaaatttcatcaaacgttgataaggtcgagacacgtgtttcggaggtggtccctaccaccaagagtaaaccaattgggctggataaatatattttcttcttaaaatataaatattttataataatatttaaattatgtgcctctttagttttttttttttctcttcctcttttgctttgtaaaaaaaaaaaaagtcactttttcttttcttcttttaatcccttgtggtgaaaaaaagaaaaagaaatgtagattcctgcttcttcc

SEQ ID NO: 251 - protein, 161 aa, Gossypium hirsutum
  misc_feature (1)..(161): Ceres CLONE ID no.1798756
  misc_feature (1)..(161): Bit score of 359.6 for HMM based on sequences of FIGURE 11.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
  misc_feature (1)..(161): Functional Homolog Of Ceres SEEDLINE ID no. ME04477 at SEQ ID NO: 246
MAEEHRCQAPEGHRLCVNNCGFFGSSATMNLCSKCYRDLCLKEQEASSIKSALSSSPSSSSTVVESISQVPLLALHEVNRESAVPEIASAAEQRSQQQPNRCMVCRKRVGLTGFRCKCGVTFCGSHRYPENHGCTFDFKKVGREEIARANPLVKAEKLEKI

SEQ ID NO: 252 - DNA, 814 bp, Gossypium hirsutum
  misc_feature (1)..(814): Ceres CLONE ID no.1918424
  misc_feature (1)..(814): Encodes the peptide sequence at SEQ ID NO 253
gttcacattcttccttccaccttttcctttcaagatcgaaagattttttctttttttaaaaatggcggaggagcatagatgccaaacgccggaaggccaccgtctttgcgttaacaactgcggctttttcggaagtccggcgacaatgaatctttgctctaaatgttatagagatttccgtcttaaagaacaacagggagctacttccatcaaatcatctctttcttcctctccttcgttttcatcttcgtcagtcgttgtcgaatccgtttctcaggttccgctgttcaatctgcctgagttcattggagaatcgccagttcctgcagtggaggttgccctggtggctgagcaacggccgcaacagcaacaaccgaatcgatgcatggtttgcaggaaacgggtcgggttgaccgggttcaggtgcaaatgcgagattacattttgcgggtcccataggtatccagagaatcacgggtgtaccttcgatttcaaggaggttgggagagaggagattgcacgcgcaaatccactggtcaaagcagagaagctggagaagatttgagatgaaagtggaaagccattggatccctcgactttcgatgaaataaaaaaaaaaaagcaaatgaaaatgatctctttaagattgcgacacgtgtttagatgtagtccccaccatgaagagaaaccaattaggctggataaaattattttcatcctaataggttttcttaaaatatatataatattttaatttatgtgcctcttttagtctttctcttttgtaaaaaaagacttttttttttttcttttc

SEQ ID NO: 253 - protein, 167 aa, Gossypium hirsutum
  misc_feature (1)..(167): Ceres CLONE ID no.1918424
  misc_feature (1)..(167): Bit score of 327.3 for HMM based on sequences of FIGURE 11.
  misc_feature (108)..(148): Pfam Name: zf-AN1 Pfam Description: AN1-like Zinc finger
  misc_feature (13)..(37): Pfam Name: zf-A20 Pfam Description: A20-like zinc finger
  misc_feature (1)..(167): Functional Homolog Of Ceres SEEDLINE ID no. ME04477 at SEQ ID NO: 246
MAEEHRCQTPEGHRLCVNNCGFFGSPATMNLCSKCYRDFRLKEQQGATSIKSSLSSSPSFSSSSVVVESVSQVPLFNLPEFIGESPVPAVEVALVAEQRPQQQQPNRCMVCRKRVGLTGFRCKCEITFCGSHRYPENHGCTFDFKEVGREEIARANPLVKAEKLEKI

SEQ ID NO: 254 - DNA, 480 bp, Populus balsamifera subsp. trichocarpa
  misc_feature (1)..(480): Ceres ANNOT ID no.1460527
  misc_feature (1)..(480): Encodes the peptide sequence at SEQ ID NO 255
atggcagaagaacaacaccgatgccaagaaccacgtctctgcgtaaacaactgcggtttttttggaagcccagcaactcaaaatctgtgttctaaatgttatggtgatcttcgtcaatcacagcccctgaatcagctcctagccccatcatcatctgcttctgtttcttccttttcatccccaaccgtcgatgttataaagaaccagatagctcccgtgttggtggtggaaggtgatgaaaaaggggagtttaaggctgaacctacggttgtggttccacagcagaagccaaataggtgcttgacgtgtaggaggcgcgtagggttgacgggatttaattgcaggtgtggtatggtgttttgtggaacgcataggtacccagaacaacatgattgtgagtttgattttaagagcttaggtaaagaacagatcgctaaggctaatcctgttgttaagggtgagaagcttcaaaggatttaa

SEQ ID NO: 255 - protein, 159 aa, Populus balsamifera subsp. trichocarpa
  misc_feature (1)..(159): Ceres ANNOT ID no.1460527
  misc_feature (1)..(159): Bit score of 340.4 for HMM based on sequences of FIGURE 11.
  misc_feature (100)..(140): Pfam Name: zf-AN1 Pfam Description: AN1-like Zinc finger
  misc_feature (11)..(35): Pfam Name: zf-A20 Pfam Description: A20-like zinc finger
  misc_feature (1)..(159): Functional Homolog Of Ceres SEEDLINE ID no. ME04477 at SEQ ID NO: 246
MAEEQHRCQEPRLCVNNCGFFGSPATQNLCSKCYGDLRQSQPLNQLLAPSSSASVSSFSSPTVDVIKNQIAPVLVVEGDEKGEFKAEPTVVVPQQKPNRCLTCRRRVGLTGFNCRCGMVFCGTHRYPEQHDCEFDFKSLGKEQIAKANPVVKGEKLQRI

SEQ ID NO: 256 - DNA, 504 bp, Populus balsamifera subsp. trichocarpa
  misc_feature (1)..(504): Ceres ANNOT ID no.1450673
  misc_feature (1)..(504): Encodes the peptide sequence at SEQ ID NO 257
atggcagaagaacaacacagatgccaagaacaacgactctgcgtaaacaactgcggcttttatgggagccaagcaacagaaaatctttgttccaagtgttaccgtgatcttcatcaatcacagcccttgaatcatcagctgctaaacccatcatcatcatcggctgcttctgtttcctcctttgcatccccagccgttgatgttctaaaagtcaacaccaaccagaaagctcctgttgtggtggtgggagatgataaaaaagatgaggtaaaggcaggagagcctgcggctgggaagcagcagcagcataagccaaataggtgcttgacgtgtaggaggcgcgtggggttgacggggttcaagtgcaggtgtggtatggtgttttgtggaacacataggtacccggaacagcatgattgcgaatttgattttaagagtttagggaaacaacagattgctaaggctaatcccgttgttaagggagagaaactccaaaaaatttaa

SEQ ID NO: 257 - protein, 167 aa, Populus balsamifera subsp. trichocarpa
  misc_feature (1)..(167): Ceres ANNOT ID no.1450673
  misc_feature (1)..(167): Bit score of 285.3 for HMM based on sequences of FIGURE 11.
  misc_feature (108)..(148): Pfam Name: zf-AN1 Pfam Description: AN1-like Zinc finger
  misc_feature (11)..(35): Pfam Name: zf-A20 Pfam Description: A20-like zinc finger
  misc_feature (1)..(167): Functional Homolog Of Ceres SEEDLINE ID no. ME04477 at SEQ ID NO: 246
MAEEQHRCQEQRLCVNNCGFYGSQATENLCSKCYRDLHQSQPLNHQLLNPSSSSAASVSSFASPAVDVLKVNTNQKAPVVVVGDDKKDEVKAGEPAAGKQQQHKPNRCLTCRRRVGLTGFKCRCGMVFCGTHRYPEQHDCEFDFKSLGKQQIAKANPVVKGEKLQKI

SEQ ID NO: 258 - DNA, 471 bp, Populus balsamifera subsp. trichocarpa
  misc_feature (1)..(471): Ceres ANNOT ID no.1456578
  misc_feature (1)..(471): Encodes the peptide sequence at SEQ ID NO 259
atggagcaagaatcccaaaagagaaagctagaagacagcagcagtaacgaggcacaaaacacgccaattctttgtgtgaataactgtggtttttttggaagccccaacactaataatctctgctctaaatgttacaaagaattccttctaacccaacaagacacaactacaacaacaattgatgttccagttcatgttgccgaaaacagtgcagcagcagcagcagaagttgaagggcaacaagaaggaggtgaagaggagaagcggccggtggtggtggcaaacaggtgcaacttctgcaggaaaaaagtgggcttgacagggttcaagtgccgttgtggatacactttctgttcgcagcacagatattcggacaagcataactgtgtgttcgattacaagagtgctggacaggatgctattgctaaagccaatcctgttgtcaaggcagataagattgataagatatga

SEQ ID NO: 259 - protein, 156 aa, Populus balsamifera subsp. trichocarpa
  misc_feature (1)..(156): Ceres ANNOT ID no.1456578
  misc_feature (1)..(156): Bit score of 249.4 for HMM based on sequences of FIGURE 11.
  misc_feature (22)..(46): Pfam Name: zf-A20 Pfam Description: A20-like zinc finger
  misc_feature (97)..(137): Pfam Name: zf-AN1 Pfam Description: AN1-like Zinc finger
  misc_feature (1)..(156): Functional Homolog Of Ceres SEEDLINE ID no. ME04477 at SEQ ID NO: 246
MEQESQKRKLEDSSSNEAQNTPILCVNNCGFFGSPNTNNLCSKCYKEFLLTQQDTTTTTIDVPVHVAENSAAAAAEVEGQQEGGEEEKRPVVVANRCNFCRKKVGLTGFKCRCGYTFCSQHRYSDKHNCVFDYKSAGQDAIAKANPVVKADKIDKI

SEQ ID NO: 260 - protein, 175 aa, Brassica rapa
  misc_feature (1)..(175): Public GI ID no.119720772
  misc_feature (1)..(175): Bit score of 346.9 for HMM based on sequences of FIGURE 11.
  misc_feature (116)..(156): Pfam Name: zf-AN1 Pfam Description: AN1-like Zinc finger
  misc_feature (16)..(40): Pfam Name: zf-A20 Pfam Description: A20-like zinc finger
  misc_feature (1)..(175): Functional Homolog Of Ceres SEEDLINE ID no. ME04477 at SEQ ID NO: 246
MSSEQNNSTSFPPTEPKLCDNGCGFFGSPSNMNLCSKCYRSLRAEEDQTAVAKAAVEKSLKLPSCSLITAPAPKQPLETKPASVETVVIAETSSVPPVATGQDEGEPSKPARPNRCFSCNKKVGVMGFKCKCGSTFCGSHRYPEKHECSFDFKEVGRGAIAKANPVVKADKVQRI

SEQ ID NO: 261 - DNA, 1190 bp, Glycine max
  misc_feature (1)..(1190): Ceres CLONE ID no.708446
  misc_feature (1)..(1190): Encodes the peptide sequence at SEQ ID NO 262
tataaatcaggtactaactctttctccttctcccctcatcccaatacccctttatttttttcgttttttttttatggaaaaaaatattgtagcaatttcgtcgtagaaacaaaattcccctattttcggcacgccgttgttgaatttccaatctgtgattttttttcttcttctatttatacgtgataattccaaaaagcctaacgcgagagattcatcagcttttcaattattcctcgaattattttgaaggaatcatccaaactgcttgaaatattcatcatcaacaacctcacgctgttatagatattctctctctctctctccctctctctctctctcacacacacacacacacagatccagacatggccgaagaacaccgatgccaagctcccgaaggtcacagactctgctccaacaactgcggtttctttggtagccccgccaccatgaatctctgttccaaatgctacagagacatccgtttgaaggaagaagaacaagccaaaaccaaatccacaatcgaaaccgctctttcaggatcttcctccgccaccgtcaccgcaaccgccgtcgttgcctcctccgtggaatccccttcggcgccggttgaatccctccctcaaccaccggtgctgatttcgccggatatagccgcaccggttcaggcgaaccggtgcggcgcgtgtaggaagcgcgtggggttgacagggttcaagtgcaggtgcggaacaacgttttgtgggagccacaggtaccccgagaaacacgcgtgtggcttcgatttcaaggcggtggggagagaggagatagcacgggcgaatcccgtgatcaaaggcgagaagctacggaggatttaatctgcgccgttggatgatcgaagcgattagggtgagttgatcaggaccgttcgtcgtggaccgttgatacgaaccgatttcgagcgtgtaaataaaaaaatctattattatgacgacattgggaagggttgaataagtcatattttggtggctttggtttgtgtttgtgcattaaaagtggaaaaatgttaggtccacccacgttcggaaattgaggggtttagaattgaaatgaaatgtaaaaaagtttagtttgattatttttctacggcatttctatttttctagtgggtggcgcgtttgccagaaagggaaattatcgtcggc

SEQ ID NO: 262 - protein, 164 aa, Glycine max
  misc_feature (1)..(164): Ceres CLONE ID no.708446
  misc_feature (1)..(164): Bit score of 373.9 for HMM based on sequences of FIGURE 11.
  misc_feature (105)..(145): Pfam Name: zf-AN1 Pfam Description: AN1-like Zinc finger
  misc_feature (13)..(37): Pfam Name: zf-A20 Pfam Description: A20-like zinc finger
  misc_feature (1)..(164): Functional Homolog Of Ceres SEEDLINE ID no. ME04477 at SEQ ID NO: 246
MAEEHRCQAPEGHRLCSNNCGFFGSPATMNLCSKCYRDIRLKEEEQAKTKSTIETALSGSSSATVTATAVVASSVESPSAPVESLPQPPVLISPDIAAPVQANRCGACRKRVGLTGFKCRCGTTFCGSHRYPEKHACGFDFKAVGREEIARANPVIKGEKLRRI

SEQ ID NO: 263 - DNA, 920 bp, Glycine max
  misc_feature (1)..(920): Ceres CLONE ID no.1614593
  misc_feature (1)..(920): Encodes the peptide sequence at SEQ ID NO 264
attctccgttaagattctttcttctttcctctttccactcttggtcttatcttcttcacaatcccacaaccactccttgttataaatcagatccaaacatggccgaagaacaccgatgccaagctcccgaaggtcacagactctgctccaacaactgcggcttcttcggtagccccgccacaatgaatctctgttccaaatgctacagagacatccgtttgaaggaagaagaacaagccaaaactaaatccacaatcgaaaccgctctttctggatcttcctccgccaccgtcgccgttgcctccgccgtggattctcttccggcgccggttgaatccctccctcaaccgtcggtggtgagttcgccagatgtggccgcaccggttcaggcgaaccggtgcggcgcgtgtaggaagcgcgtgggattgactgggtttaagtgcaggtgcggaaccacgttttgtgggactcaccggtaccccgagaaacacgcgtgtggcttcgatttcaaggcggtggggagagaggagatagcacgggcgaatcccgtgatcaaaggcgagaagctacggaggatttaatctgcaccgttgatatgatgatcgaagcgattagggtgagttgatcaggaccgtccgtcgtgggccgttgatacgaacctatttcgagcgtgtgtaagaaaaaaaaaatctattagttatgacgacattgggaagggttgaataagtcatattttggaggctttgctttgtgtttgttcattaaaaatggaaaatgttaggtccacccacgttcggaaattgaggggtttgtttagaattgcaatgcaatgtaaaaaagtgtagtttaatatttttctacaggcatttctatttttcttccgtttgcgagaaaggtaaattatcgtctgcgttgtattc

SEQ ID NO: 264 - protein, 160 aa, Glycine max
  misc_feature (1)..(160): Ceres CLONE ID no.1614593
  misc_feature (1)..(160): Bit score of 358.3 for HMM based on sequences of FIGURE 11.
  misc_feature (101)..(141): Pfam Name: zf-AN1 Pfam Description: AN1-like Zinc finger
  misc_feature (13)..(37): Pfam Name: zf-A20 Pfam Description: A20-like zinc finger
  misc_feature (1)..(160): Functional Homolog Of Ceres SEEDLINE ID no. ME04477 at SEQ ID NO: 246
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 265 - protein, 170 aa, Medicago truncatula
  misc_feature (1)..(170): Public GI ID no.92896423
  misc_feature (1)..(170): Bit score of 351.9 for HMM based on sequences of FIGURE 11.
  misc_feature (11)..(35): Pfam Name: zf-A20 Pfam Description: A20-like zinc finger
  misc_feature (111)..(151): Pfam Name: zf-AN1 Pfam Description: AN1-like Zinc finger
  misc_feature (1)..(170): Functional Homolog Of Ceres SEEDLINE ID no. ME04477 at SEQ ID NO: 246
MAEEHRCQAAQRLCANNCGFFGSPAMQDLCSKCYRDLQMKEQRSSSAKLVLNQTLIPQQSNSSSLDTGIIHPSSTSPSVMIVSSSTPTVELVAAAAGPSEAEPPKVQPNRCGTCRRRVGLTGFKCRCGLTLCGTHRYPEQHGCGFDFKGMGREEIKKANPVVKGEKLNKI

SEQ ID NO: 266 - protein, 137 aa, Phaseolus vulgaris
  misc_feature (1)..(137): Public GI ID no.169363
  misc_feature (1)..(137): Bit score of 212.2 for HMM based on sequences of FIGURE 11.
  misc_feature (78)..(118): Pfam Name: zf-AN1 Pfam Description: AN1-like Zinc finger
  misc_feature (1)..(137): Functional Homolog Of Ceres SEEDLINE ID no. ME04477 at SEQ ID NO: 246
MAQKAQKNDTDFKVPEPITPCATATAAAATSISEPSRFFDAATPATSSRSPKRSLPLEDAANADRTVASEPKRAVNRCSGCRRRVGLTGFRCRCGDLFCAEHRYTDRHDCSYDYKTVGREAIARENPVVKAAKIVKV

SEQ ID NO: 267 - protein, 173 aa, Camellia sinensis
  misc_feature (1)..(173): Public GI ID no.113196593
  misc_feature (1)..(173): Bit score of 366.3 for HMM based on sequences of FIGURE 11.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature (1)..(173): Functional Homolog Of Ceres SEEDLINE ID no. ME04477 at SEQ ID NO: 246
MEQNETGCQVPPDAPMLCVNNCGFFGSAATMNPCSKCHKDLMLKQQQTELAASSIGSIANGGSGSPGKEPDSAITTVHVDAGSSDSMIVSMQASHESLLNENNVIVKEVPPNRCSACRKRVGLTGFNCRCGNLFCAVHRYSDKHDCPFDYRSAAQDAIAKANPVVKAEKLDKL

SEQ ID NO: 268 - protein, 224 aa, Oryza sativa subsp. japonica
  misc_feature (1)..(224): Public GI ID no.75133829
  misc_feature (1)..(224): Bit score of 372.9 for HMM based on sequences of FIGURE 11.
  misc_feature (165)..(205): Pfam Name: zf-AN1 Pfam Description: AN1-like Zinc finger
  misc_feature (78)..(102): Pfam Name: zf-A20 Pfam Description: A20-like zinc finger
  misc_feature (1)..(224): Functional Homolog Of Ceres SEEDLINE ID no. ME04477 at SEQ ID NO: 246
MEEQQAAAAGGGGGGGGASMCANGCGFFGSEATKKLCSKCYRDQLKAAPSSPPAAPDLVANEEEEASTAAAAAADEQLALCSSGCGFFGSKETNNMCSKCYRDHLKATSPLFSSSSSPATASTTDITVPIAPATTAPTPSLKGKEEEATAAASSSAAAAAKPNRCVACRKKVGLLGFECRCGGTFCSTHRHADKHACTFDFKKSDREKIAKENPLIVAPKITKF

SEQ ID NO: 269 - DNA, 951 bp, Triticum aestivum
  misc_feature (1)..(951): Ceres CLONE ID no.1030374
  misc_feature (1)..(951): Encodes the peptide sequence at SEQ ID NO 270
gaaactcagaaaagcagagaactttattctctcctctaacctctcaacttctgctggatctctccagcagacggaagatcttcttcggagagattcttaggggaccgaacgatctatcgatcaaggcttctcgggcaaacagaagtgcagaaatggaccacgacaagacaggatgccaaagcccacccgagggtcccaagctatgcatcaacaactgcggtttcttcggaagcgctgccacaatgaacatgtgttccaagtgccacaagactatcttgtttcaacaggaacagggggccaagcttgcatctgcagtgtctggatcacccagcaacatcctaaaggaaaccttcactgctgatttggttgatgctggaaccaaatccatcgagcctgtggctgtctctgtacaagctgttgcagaggtagtagcaccagaagaagctgcagcaaaaccaaaggaagggcccagccgatgtactacttgcaacaaacgggttggtttgactggattcaaatgtcgatgtggtgacctcttctgtggtacgcaccgctatgcagacgttcataactgctctttcgattaccatgttgctgcgcaagaagctatagccaaagcgaacccggttgtgaaggcagataagcttgacaagatctgaaactcagaaactatgtttccttcttcatgtccgtgtctggttcaagcgtgtgttgatctttagcttcttccgttctctctgccagtatctgtggtgtgaaaactttctatattatcttgtgtttgcaagcagagaagtgtgctcttaaatatatatatatgctttgatgtgtttctctttttttttttttaatattatttatgagcactatggtttggttatgtttactcctttgggtctgtatcatattgagattgtaactttagctatatgaagatttttcttaaaagct

SEQ ID NO: 270 - protein, 168 aa, Triticum aestivum
  misc_feature (1)..(168): Ceres CLONE ID no.1030374
  misc_feature (1)..(168): Bit score of 348.4 for HMM based on sequences of FIGURE 11.
  misc_feature (109)..(149): Pfam Name: zf-AN1 Pfam Description: AN1-like Zinc finger
  misc_feature (15)..(39): Pfam Name: zf-A20 Pfam Description: A20-like zinc finger
  misc_feature (1)..(168): Functional Homolog Of Ceres SEEDLINE ID no. ME04477 at SEQ ID NO: 246
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 271 - DNA, 807 bp, Triticum aestivum
  misc_feature (1)..(807): Ceres CLONE ID no.634261
  misc_feature (1)..(807): Encodes the peptide sequence at SEQ ID NO 272
aaccaaacgcaatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggcaccaatattgtgtgtaaacaactgcggcttcttcggtagcagcatgacaaacaacatgtgctccaagtgctacagggacttcattaaggccacgacaatggctgcccctgtagtggagaagaaggtgttctcagtggcatcatcttccagtgtgacattggagcaagcaaaggcagatgaagtaccagccgtggctgtagctgatagccaagcagcacaggagcctccaaagccgcccagcaacagatgcctttcatgccgcaagaagataggcttgaccggtttccagtgccggtgcgggggaacattctgctccatgcaccgctacgctgactcccacgaatgcactttcgactacaagaaggctggccgggagcagattgccaagcagaaccctgttgtgatagccaagaagatcaacaagatataattgataatgacaccgggttcatttgcttgctattcgtggtggtgctggattcgtctttacttgaatcagtaggtttcttctggtctggttgctagggtctcaattgtgtctatccttctccttcatggttcgcttctctccattaagaatgaaatgaaataatgtaaatatataatattatattgttttagctgttcgtttcgtatg

SEQ ID NO: 272 - protein, 160 aa, Triticum aestivum
  misc_feature (1)..(160): Ceres CLONE ID no.634261
  misc_feature (1)..(160): Bit score of 306.6 for HMM based on sequences of FIGURE 11.
  misc_feature (101)..(141): Pfam Name: zf-AN1 Pfam Description: AN1-like Zinc finger
  misc_feature (19)..(43): Pfam Name: zf-A20 Pfam Description: A20-like zinc finger
  misc_feature (1)..(160): Functional Homolog Of Ceres SEEDLINE ID no. ME04477 at SEQ ID NO: 246
MAQESWKESEETVQTPEAPILCVNNCGFFGSSMTNNMCSKCYRDFIKATTMAAPVVEKKVFSVASSSSVTLEQAKADEVPAVAVADSQAAQEPPKPPSNRCLSCRKKIGLTGFQCRCGGTFCSMHRYADSHECTFDYKKAGREQIAKQNPVVIAKKINKI

SEQ ID NO: 273 - DNA, 870 bp, Zea mays
  misc_feature (1)..(870): Ceres CLONE ID no.1387149
  misc_feature (1)..(870): Encodes the peptide sequence at SEQ ID NO 274
aaaaacaggttaacaacaacacatacacatctctctctctctctcttcttcgttttatatttccattctttttcttcatttccgccatttctgttttattttggttgccgagaaaacgcaggaactcggtgacctaattatagtctcgtcgattgtctttttcagaattttcgacgaattttattgattaataattaattaatggcggaagaacatccatgtcagacgccggaaggccaccgtctctgcgttaacaactgcggtttcttcggaagctcagccaccatgaatctctgctccaactgctacggcgacctctgcctcaagaaccagcagcaagcttccatgaaatcaaccgtcgagtcctccctctccgccgcatctcctccgtcgtcaccggagatccagtcaatctccacgtcgacgatcgcgcccgtcgtccaaatttacgcggcggagatacagatagagaaacaaatccagcagcaacggcctaatcggtgcaccgtgtgcaggaaacgggtcgggttaaccgggttcatgtgccggtgcgggacgactttctgcgggacccacaggtatccggaggttcacggatgcacgttcgatttcaaatcggctgggcgcgaggagatcgcgaaggctaacccgttggttgtagccgcgaagctccagaagatatgatctgagccgttgcttgcgttgttcaccgtgaaacatacttttatgttacggacatgtgtttacgtaattaatggttgagacagttttcattcaccttttaattattttccttttcttccggaagaattttaaagttttataattgtgtggctttgtgcttgtaaaaaaaaagattttcttttgcgg

SEQ ID NO: 274 - protein, 160 aa, Zea mays
  misc_feature (1)..(160): Ceres CLONE ID no.1387149
  misc_feature (1)..(160): Bit score of 373.0 for HMM based on sequences of FIGURE 11.
  misc_feature (101)..(141): Pfam Name: zf-AN1 Pfam Description: AN1-like Zinc finger
  misc_feature (13)..(37): Pfam Name: zf-A20 Pfam Description: A20-like zinc finger
  misc_feature (1)..(160): Functional Homolog Of Ceres SEEDLINE ID no. ME04477 at SEQ ID NO: 246
MAEEHPCQTPEGHRLCVNNCGFFGSSATMNLCSNCYGDLCLKNQQQASMKSTVESSLSAASPPSSPEIQSISTSTIAPVVQIYAAEIQIEKQIQQQRPNRCTVCRKRVGLTGFMCRCGTTFCGTHRYPEVHGCTFDFKSAGREEIAKANPLVVAAKLQKI

SEQ ID NO: 275 - DNA, 760 bp, Zea mays
  misc_feature (1)..(760): Ceres CLONE ID no.1589047
  misc_feature (1)..(760): Encodes the peptide sequence at SEQ ID NO 276
gttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctgaggagcaggaaccgccgcctctcgcttcagagttcatgtcttccccccgtcagcggaactccggaagagcaaggacgaccgacggccagaagggacggatcgtcggattgtacgaattactcccgtgtactctacgattggtataaaacccaagcccgtcggttcgattgtgtaaagctggcggtgaaatcgctggccgtttactgaatgaaaaaaaattcaaatagaaaaatatttacttttc

SEQ ID NO: 276 - protein, 152 aa, Zea mays
  misc_feature (1)..(152): Ceres CLONE ID no.1589047
  misc_feature (1)..(152): Bit score of 249.5 for HMM based on sequences of FIGURE 11.
  misc_feature (14)..(38): Pfam Name: zf-A20 Pfam Description: A20-like zinc finger
  misc_feature (92)..(132): Pfam Name: zf-AN1 Pfam Description: AN1-like Zinc finger
  misc_feature (1)..(152): Functional Homolog Of Ceres SEEDLINE ID no. ME04477 at SEQ ID NO: 246
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDAIARANPVVKGDKLKDKI

SEQ ID NO: 277 - protein, 173 aa, Prunus armeniaca
  misc_feature (1)..(173): Public GI ID no.5031281
  misc_feature (1)..(173): Bit score of 376.4 for HMM based on sequences of FIGURE 11.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature (1)..(173): Functional Homolog Of Ceres SEEDLINE ID no. ME04477 at SEQ ID NO: 246
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 278 - DNA, 979 bp, Panicum virgatum
  misc_feature (1)..(979): Ceres CLONE ID no.1775820
  misc_feature (1)..(979): Encodes the peptide sequence at SEQ ID NO 279
atcgccagcgcgcgcgccggccgatctgggggcgggctccgctccacccgaggctcgccgttgacggggtccgcgtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggaaaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcggggacaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagcttatctgatcctgctaccatcatgtttatgtgatcagatgaagttatagataagcatacatatc

SEQ ID NO: 279 - protein, 163 aa, Panicum virgatum
  misc_feature (1)..(163): Ceres CLONE ID no.1775820
  misc_feature (1)..(163): Bit score of 343.3 for HMM based on sequences of FIGURE 11.
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
  misc_feature (1)..(163): Functional Homolog Of Ceres SEEDLINE ID no. ME04477 at SEQ ID NO: 246
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGDTFCSTHRYTDSHQCTFDYKKVAREQIAKQNPVVMAEKINKI

SEQ ID NO: 280 - DNA, 939 bp, Panicum virgatum
  misc_feature (1)..(939): Ceres CLONE ID no.1787151
  misc_feature (1)..(939): Encodes the peptide sequence at SEQ ID NO 281
attctccgcggggggtaagggaaaggtcgcgtggcgtctcgcccacagtccatcggtagcaatggcacaagagagctggaaacaagagtccgaggagactagagtccacgcccctgaggcccctattctctgcataaacaactgtggtttctttggcagcagcatgacgaacaatatgtgctcgaagtgctatagggacttcatcaagttgatggaagctcctgtggtggagaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcgggggcaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactatgatcgataggttccttagggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcaacatgtcattggttttgtatcgttgtatgttatcacgtgtgctggaaatcacagcaagtatgaagcttatctgatcctgctaccatcatgtttatgtgatcagatgaagttatagac

SEQ ID NO: 281 - protein, 163 aa, Panicum virgatum
  misc_feature (1)..(163): Ceres CLONE ID no.1787151
  misc_feature (1)..(163): Bit score of 342.1 for HMM based on sequences of FIGURE 11.
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
  misc_feature (1)..(163): Functional Homolog Of Ceres SEEDLINE ID no. ME04477 at SEQ ID NO: 246
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGGTFCSTHRYTDSHQCTFDYKKVAREQIAKQNPVVMAEKINKI

SEQ ID NO: 282 - DNA, 750 bp, Panicum virgatum
  misc_feature (1)..(750): Ceres CLONE ID no.1765871
  misc_feature (1)..(750): Encodes the peptide sequence at SEQ ID NO 283
gttggctaacaatcccattgctgcgctgcagcccatctgtagcaatggcacaggagagctggaaacaggagtccgaggagactggagtccatgcgcctgaggccccaattctgtgcataaacaactgtgttttcttcggcagcagcatgacaaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacgggagcagattgccaagcaaaatccagttgtgatggcagagaagatcaacaagatatgatgcatggtcgtgtgcagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttcc

SEQ ID NO: 283 - protein, 164 aa, Panicum virgatum
  misc_feature (1)..(164): Ceres CLONE ID no.1765871
  misc_feature (1)..(164): Bit score of 326.7 for HMM based on sequences of FIGURE 11.
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature (1)..(164): Functional Homolog Of Ceres SEEDLINE ID no. ME04477 at SEQ ID NO: 246
MAQESWKQESEETGVHAPEAPILCINNCVFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAREQIAKQNPVVMAEKINKI

SEQ ID NO: 284 - DNA, 1598 bp, Panicum virgatum
  misc_feature (1)..(1598): Ceres CLONE ID no.1990071
  misc_feature (1)..(1598): Encodes the peptide sequence at SEQ ID NO 285
  misc_feature (601)..(601): r is g or a
  misc_feature (948)..(948): y is t/u or c
  misc_feature (989)..(989): m is a or c
  misc_feature (1009)..(1009): w is a or t/u
gccttcgcctacctctcgacgcccaaccccaaaaagaaaaattctcctcgcggagaaaggtcgcgtgccgtctcgcccacaggttggcggcgggcttcgcgtcgaggcgcggccggttggttctggatcggatctgcgcggattggaattgggttgacccggtgggtttggtggcacagggtctgcgcgcctctgttacggaggatttgggctcgcctgtgggtattttccctttaattatttgcagatcatttgcggtggtttgttttctaggctggcactggcaggcgagacctcaacctttgtgaacagcggagggggtgaatcagtgaaggatagcgagtccgtccgcgtggttgatgaacaaactttggtggttgccggcggatgtgggagtgggttcatcctggcgccgccgggtgcacgccgcggcgtgcgtggctgcttgcttgtcgcagggctcttccatccctgcgtcacatgcgagcttcgtgccaattcgtgaagcaggcgagagatgtttgctgataaggtctcctgtggcccttgtgtagggggtggatgaagcggcgagcttcctttccgtgctcggcgtgggtarccttgattgtggccagaggtttcgtgctggccatggcaaggtctattgcttggacgtgtggataaaggtttgactgcctgaattggctgtgtgcatctacctgattgcagttccgggcactgattgcttcgcctgtatgctgctggttgcctgccttgtgctgctactacatatgcaatctgtggagcaaccaaaaagaccttggcttcatgctatgattgtgtcaagcaattgactaaccacgcccatctgttgcaatggcacacgagagctggaaacaggaatctgaggagactggagtccatgcacctgaggccccaattctgtgcataaacaactgtggtttyttcggcagcagcatgacgaacaatatgtgctcgaagtgctmcagggacttcatcaaattgwtggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagcccccaaagccgcccagcaaccggtgccttacctgccgcaagaaggttgggctgactggcttcctctgccgctgcgggggccccttttgctccatgcaccgctacactgactcccaccagtgcaccttcgactacaagaaggtggcacgggagcagattgccaagcaaaatccagttgtgatggcagagaagattaacaagatatgatgcatagtcatgtgaagggatcactaaattcatgcctgggttcactccaaatgataggttccttcaggcggtggtctgggtctgggttagagtggtagctggtctcaattgtgtctatccccctttatcatggtttcattctctcgattgtgtaataatgtaaatatattcaaactgtaatttaatcctattgcttcctactacgattgatgggtttgatgggtttatcgctgatcatggctttc

SEQ ID NO: 285 - protein, 164 aa, Panicum virgatum
  misc_feature (1)..(164): Ceres CLONE ID no.1990071
  misc_feature (1)..(164): Bit score of 305.5 for HMM based on sequences of FIGURE 11.
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature (1)..(164): Functional Homolog Of Ceres SEEDLINE ID no. ME04477 at SEQ ID NO: 246
  misc_feature (30)..(30): Xaa is any aa, unknown or other
  misc_feature (44)..(44): Xaa is any aa, unknown or other
  misc_feature (51)..(51): Xaa is any aa, unknown or other
MAHESWKQESEETGVHAPEAPILCINNCGXFGSSMTNNMCSKCXRDFIKLXEGPVVEKKVITVASSSAAPMETAKQDDVPAAAATEAVTEKQAEQEPPKPPSNRCLTCRKKVGLTGFLCRCGGPFCSMHRYTDSHQCTFDYKKVAREQIAKQNPVVMAEKINKI

SEQ ID NO: 286 - protein, 171 aa, Oryza sativa subsp. indica
  misc_feature (1)..(171): Public GI ID no.35187687
  misc_feature (1)..(171): Bit score of 379.1 for HMM based on sequences of FIGURE 11.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Functional Homolog Of Ceres SEEDLINE ID no. ME04477 at SEQ ID NO: 246
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 287 - protein, 171 aa, Oryza sativa subsp. indica
  misc_feature (1)..(171): Public GI ID no.125556051
  misc_feature (1)..(171): Bit score of 322.4 for HMM based on sequences of FIGURE 11.
  misc_feature (112)..(152): Pfam Name: zf-AN1 Pfam Description: AN1-like Zinc finger
  misc_feature (20)..(38): Pfam Name: zf-A20 Pfam Description: A20-like zinc finger
  misc_feature (1)..(171): Functional Homolog Of Ceres SEEDLINE ID no. ME04477 at SEQ ID NO: 246
  misc_feature (3)..(3): Xaa is any aa, unknown or other
MEXQGDWMPAARRPDPLHHNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCATHRYSDKHDCQFDYRTAARDAIAKANPVVKAEKLDKI

SEQ ID NO: 288 - protein, 223 aa, Oryza sativa subsp. indica
  misc_feature (1)..(223): Public GI ID no.125561658
  misc_feature (1)..(223): Bit score of 369.6 for HMM based on sequences of FIGURE 11.
  misc_feature (164)..(204): Pfam Name: zf-AN1 Pfam Description: AN1-like Zinc finger
  misc_feature (77)..(101): Pfam Name: zf-A20 Pfam Description: A20-like zinc finger
  misc_feature (1)..(223): Functional Homolog Of Ceres SEEDLINE ID no. ME04477 at SEQ ID NO: 246
MEEQQAAAAGGGGGGGGASMCANGCGFFGSEATKKLCSKCYRDQLKAAPSSPPAAPDLVANEEEEASTAAAAADEQLALCSSGCGFFGSKETNNMCSKCYRDHLKATSPLFSSSSSPATASTTDITVPIAPATTAPTPSLKGKEEEATAAASSSAAAAAKPNRCVECRKKVGLLGFECRCGGTFCSTHRHADKHACTFDFKKSDREKIAKENPLIVAPKITKF

SEQ ID NO: 289 - protein, 238 aa, Oryza sativa subsp. indica
  misc_feature (1)..(238): Public GI ID no.125546011
  misc_feature (1)..(238): Bit score of 113.0 for HMM based on sequences of FIGURE 11.
  misc_feature (178)..(218): Pfam Name: zf-AN1 Pfam Description: AN1-like Zinc finger
  misc_feature (1)..(238): Functional Homolog Of Ceres SEEDLINE ID no. ME04477 at SEQ ID NO: 246
MATKRKCPANGDDGGVADLEPVAGGSFASRPPEKKAKLTVAVAVAVAPSSSSSATTAAAGEATAKREHGGFFAFARPENNTRLSVAVASSFSSASAAAEKAMAKLTVAGVAPSSSSASAAAAGKATAKLEYGGFCAFARPDDKTRWRVAVASSAAAAADASYSSSSPATGEQPEANRCATCRRKVGLTGFKCRCGGTFCGGHRYADEHGCGFDYKSSGRELIAKQNPVVVADKLAFRI

SEQ ID NO: 290 - protein, 171 aa, Oryza sativa subsp. japonica
  misc_feature (1)..(171): Public GI ID no.115468934
  misc_feature (1)..(171): Bit score of 382.7 for HMM based on sequences of FIGURE 11.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Functional Homolog Of Ceres SEEDLINE ID no. ME04477 at SEQ ID NO: 246
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 291 - protein, 161 aa, Oryza sativa subsp. japonica
  misc_feature (1)..(161): Public GI ID no.115470773
  misc_feature (1)..(161): Bit score of 312.0 for HMM based on sequences of FIGURE 11.
  misc_feature (102)..(142): Pfam Name: zf-AN1 Pfam Description: AN1-like Zinc finger
  misc_feature (20)..(44): Pfam Name: zf-A20 Pfam Description: A20-like zinc finger
  misc_feature (1)..(161): Functional Homolog Of Ceres SEEDLINE ID no. ME04477 at SEQ ID NO: 246
MAQESWKNESEETVHTPEAPILCVNNCGFFGSSMTNNMCSKCYRDFVKVTTMAAPVVEKKAFTPASSSKTPLEPAKPDEVPAAAVEDKQAAQEPPKPPSNRCLSCRKKVGLTGFQCRCGGTFCSTHRYTEAHDCTFDYKKAGRDQIAKQNPVVIAEKINKI

SEQ ID NO: 292 - protein, 173 aa, Oryza sativa subsp. japonica
  misc_feature (1)..(173): Public GI ID no.115444813
  misc_feature (1)..(173): Bit score of 338.6 for HMM based on sequences of FIGURE 11.
  misc_feature (114)..(154): Pfam Name: zf-AN1 Pfam Description: AN1-like Zinc finger
  misc_feature (14)..(38): Pfam Name: zf-A20 Pfam Description: A20-like zinc finger
  misc_feature (1)..(173): Functional Homolog Of Ceres SEEDLINE ID no. ME04477 at SEQ ID NO: 246
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 293 - protein, 169 aa, Oryza sativa subsp. japonica
  misc_feature (1)..(169): Public GI ID no.115455855
  misc_feature (1)..(169): Bit score of 220.4 for HMM based on sequences of FIGURE 11.
  misc_feature (109)..(149): Pfam Name: zf-AN1 Pfam Description: AN1-like Zinc finger
  misc_feature (21)..(45): Pfam Name: zf-A20 Pfam Description: A20-like zinc finger
  misc_feature (1)..(169): Functional Homolog Of Ceres SEEDLINE ID no. ME04477 at SEQ ID NO: 246
MASMKRKCPDDETACGSGAGAAMCVTGCGFFGSEATNNMCSRCYREHSADNDAVEEAAAANSDLELVGVAETTTKKARMSAVVPVAVASSSSAAAEQPAAKAATAPNRCAACRKKVGLTGFKCRCGGNFCGGHRHADAHGCGFDYKSAGKEQIAKQNPLVVADKLATRI

SEQ ID NO: 294 - protein, 237 aa, Oryza sativa subsp. japonica
  misc_feature (1)..(237): Public GI ID no.115455859
  misc_feature (1)..(237): Bit score of 108.5 for HMM based on sequences of FIGURE 11.
  misc_feature (177)..(217): Pfam Name: zf-AN1 Pfam Description: AN1-like Zinc finger
  misc_feature (1)..(237): Functional Homolog Of Ceres SEEDLINE ID no. ME04477 at SEQ ID NO: 246
MATKRKCPANGDDGGVADLEPVAGGSFASPPPEKKAKLTVAVAVAVAPSSSSSATTAAAGEATAKREHGGFFAFARPENNTRLSVAVASSSSSASAAAEKAMAKLTVAGVAPSSSASAAAAGKATAKREYGGFCAFARPDDKTRWRVAVASSAAAAADASYSSSSPATGEQPEANRCATCRRKVGLTGFKCRCGGTFCGGHRYADEHGCGFDYKSSGRELIAKQNPVVVADKLAFRI

SEQ ID NO: 295 - protein, 170 aa, Chrysanthemum x morifolium
  misc_feature (1)..(170): Public GI ID no.112819496
  misc_feature (1)..(170): Bit score of 223.0 for HMM based on sequences of FIGURE 11.
  misc_feature (111)..(151): Pfam Name: zf-AN1 Pfam Description: AN1-like Zinc finger
  misc_feature (1)..(170): Functional Homolog Of Ceres SEEDLINE ID no. ME04477 at SEQ ID NO: 246
MAQREQERTQEARRKLRAPENHAVRQQLADFPGNPATQKPLPELLLGGHGRTTSSAGLSLPSPVLDKRSRQAVRRRWLSLRLLSHRLWRRWPPRSRRRRRRSAKTSAVNRCSRCRKRVGLTGFRCRCGHLFCGEHRYSDRHGCSYDYKSAARDAIARDNPVVRAAKIVRF

SEQ ID NO: 296 - protein, 159 aa, Aeluropus littoralis
  misc_feature (1)..(159): Public GI ID no.118424243
  misc_feature (1)..(159): Bit score of 339.8 for HMM based on sequences of FIGURE 11.
  misc_feature (100)..(140): Pfam Name: zf-AN1 Pfam Description: AN1-like Zinc finger
  misc_feature (16)..(40): Pfam Name: zf-A20 Pfam Description: A20-like zinc finger
  misc_feature (1)..(159): Functional Homolog Of Ceres SEEDLINE ID no. ME04477 at SEQ ID NO: 246
MAQESWKQESHAPEAPILCINNCGFFGSSMTNNMCSKCYRDFVKLMEMDAPVVDKKLITTASSSTVPFETAKQDDTVPDAAAMDDKQPAQEPPKPPSNRCSTCRKKVGLTGFQCRCGGTFCSLHRYTDSHECTFDYKKVAREQIAKQNPVVIAEKINKI

SEQ ID NO: 297 - DNA, 582 bp, Sorghum bicolor
  misc_feature (1)..(582): Ceres ANNOT ID no.6063957
  misc_feature (1)..(582): Encodes the peptide sequence at SEQ ID NO 298
atggcggagaggcaggaggtctctggcggcatggcggcgccgatgtgcgccaacgcctgcgggttcttcgggagtgcggcgaccaagaacctctgctccaagtgctacaaggagcacctgatcaagaccgccaagcaggaagcatccgccgccgtcgtcgtcggcggcgccatcgtcaagtgcgcggccgacgggtgcggtttcttcggatcctcggcgaccaacaacatgtgctccggctgctacatggacttcctcaaagacgctcacgcctcccctgctgtggcggacaaggtcgtcgtactcgctgccgagaagcagccggcggcggcccagatctctgctgcaacgtccagtactgcaccggcggcggtgaaggcggcggcggcgcccaacaggtgcgcgtcgtgccgcaagaaggtggggctgctggggttcccctgccgctgcggcggcacgttctgcgcgctgcaccggtacgcggagaagcacgcctgcgacttcgacttcaaggcggcgggccgggagaagatcgccaagaacaacccgctcgtcgtggcagccaagatcaacaagatctga

SEQ ID NO: 298 - protein, 193 aa, Sorghum bicolor
  misc_feature (1)..(193): Ceres ANNOT ID no.6063957
  misc_feature (1)..(193): Bit score of 392.0 for HMM based on sequences of FIGURE 11.
  misc_feature (134)..(174): Pfam Name: zf-AN1 Pfam Description: AN1-like Zinc finger
  misc_feature (58)..(83): Pfam Name: zf-A20 Pfam Description: A20-like zinc finger
  misc_feature (1)..(193): Functional Homolog Of Ceres SEEDLINE ID no. ME04477 at SEQ ID NO: 246
MAERQEVSGGMAAPMCANACGFFGSAATKNLCSKCYKEHLIKTAKQEASAAVVVGGAIVKCAADGCGFFGSSATNNMCSGCYMDFLKDAHASPAVADKVVVLAAEKQPAAAQISAATSSTAPAAVKAAAAPNRCASCRKKVGLLGFPCRCGGTFCALHRYAEKHACDFDFKAAGREKIAKNNPLVVAAKINKI

SEQ ID NO: 299 - DNA, 1549 bp, Arabidopsis thaliana
  misc_feature (1)..(1549): Ceres SEEDLINE ID no.ME04507
  misc_feature (1)..(1549): Ceres CLONE ID no.38432
  misc_feature (1)..(1549): Inplanta Sequence
  misc_feature (1)..(1549): Encodes the peptide sequence at SEQ ID NO. 300
aaactctacacgcaattcatccaattatcttgctgtcgccattctccaatatccatccccatcttcttcgatttctgagattcggtcgaaaatcatcagatgggttttcagaacgaagctagctcctcctcttatacccttaaaatacctccaccggccagagaggacacgcctcttctcggcaagggacctcccctctccagccagtttaagaccttcgccaacgtcttcatcgctgtcgtcggcgctggtgttcttggtcttccttacgccttcaagcgaaccggatggctcatgggtgtcctcctcctcgtctccgtctctgttttgacccatcactgtatgatgcttcttgtctatacccgccgcaagctcgactctttcaatgctggcatctccaagatcggctcttttggtgaccttggattcgccgtctgcggctccttggggaggatcgtcgttgacttatttatcattctgtctcaagctggtttttgtgtcggatatcttatcttcatcggcactactttagctaatctatccgatcctgaatcgcccaccagtctgaggcatcagtttacaaggctgggttctgaattcctgggcgtgtcttctaagagtctctacatatggggatgctttccctttcagctcggtttgaattcgatcaagacgctcactcacttggctcctctcagcatcttcgccgatattgttgatcttggcgctatggctgtggtcattgttgaggattccatgattatactcaagcaaaggcctgacgtggttgcctttggtggtatgtccctcttcttgtatggtatgggcgtcgctgtctattccttcgaaggcgttggaatggtcttgcctcttgaatcggagatgaaggacaaggacaagtttggcaaagtcttggctctcggcatgggattcatctctctcatatacatcgcatttggtatcttaggttacttggcttttggtgaggacaccatggacattatcactgctaacttgggggcaggacttgtcagcactgttgtccagcttggactgtgcatcaacctcttcttcaccttccccttgatgatgaatccagtgtttgagatagtggagaggcgtttctcacgcgggatgtactctgcgtggctcagatgggtactcgtcttagcagtgactctggtggctctttttgtgccaaactttgcagattttttgtcattggttggcagcagcacttgctgtgtgttaggctttgtgttacctgcattgtttcatttattggtgttcaaggaagagatggggtggctgcaatggagttcagacacagcgattgtggtactaggtgtggttcttgctgtgtcgggaacttggagttccctgagtgagatcttctctgtcaaagtgtgagcgtccgtgaagtcagagattggagaggtttttctctccttgtgtgcaattatgtatatggaattggttgtggttttaagagtaactgtgattgtatttgtattttgatggtttggaataaaagagatcagctctgttt

SEQ ID NO: 300 - protein, 436 aa, Arabidopsis thaliana
  misc_feature (1)..(436): Ceres SEEDLINE ID no.ME04507
  misc_feature (1)..(436): Ceres CLONE ID no.38432
  misc_feature (1)..(436): Bit score of 1120.5 for HMM based on sequences of FIGURE 12.
  misc_feature (32)..(429): Pfam Name: Aa_trans Pfam Description: Transmembrane amino acid transporter protein
MGFQNEASSSSYTLKIPPPAREDTPLLGKGPPLSSQFKTFANVFIAVVGAGVLGLPYAFKRTGWLMGVLLLVSVSVLTHHCMMLLVYTRRKLDSFNAGISKIGSFGDLGFAVCGSLGRIVVDLFIILSQAGFCVGYLIFIGTTLANLSDPESPTSLRHQFTRLGSEFLGVSSKSLYIWGCFPFQLGLNSIKTLTHLAPLSIFADIVDLGAMAVVIVEDSMIILKQRPDVVAFGGMSLFLYGMGVAVYSFEGVGMVLPLESEMKDKDKFGKVLALGMGFISLIYIAFGILGYLAFGEDTMDIITANLGAGLVSTVVQLGLCINLFFTFPLMMNPVFEIVERRFSRGMYSAWLRWVLVLAVTLVALFVPNFADFLSLVGSSTCCVLGFVLPALFHLLVFKEEMGWLQWSSDTAIVVLGVVLAVSGTWSSLSEIFSVKV

SEQ ID NO: 301 - DNA, 1287 bp, Populus balsamifera subsp. trichocarpa
  misc_feature (1)..(1287): Ceres ANNOT ID no.1513514
  misc_feature (1)..(1287): Encodes the peptide sequence at SEQ ID NO 302
atgggatttgggaggaaaaaagcatcctcatcagcaaaaacttttccaccgagagaagacacacctctcatagccaagtccacgcctttatcatctcaatcgaagacttttgcaaatgtcttcattgctattgtcggtgctggtgttcttggtctcccttatgctttcaaacgcacaggttggctaatgagtcttattatgcttttctctgttgctggcttaactcattattgtatgatgttgttagtcaatactcgtggaaagcttcaatctttttctggtggattctcaaagattacctcttttggtgatgtgggtttcactgtttgtggttctattgggaggtttgttgttgatgttatgattgtcttgtcacaagctggattttgtattggttatttgatattcattgctaatactttggctaatctattcaattcgccatcacctaatggcctggcttctcaaattctggccctttcaatgtcagctaagagttggtatatgtggggttgttttccttttcagttggggttgaattctattgcaacgttgacccatttggctcctctgagtatttttgccgatgttgttgatcttgctgccatgggagtggtgattgttaaggatgtttttataatgatggaaaatagggctgaagttagagcatttggaggtttgtctgtgtttttctatgggatgggtgtggctgtttatgcgtttgaagggattggcatggttttgccaatagaatctgaaatgagagagagggaaaagtttgggagaatcctagggctgagcatggggcttatttcagtgatatatggagcttttggcgtgctgggttactttgcttttggaaatgatactcaggatattatcactgctaatttagggcctggactcattagcctcttggttcaattgggtctttgtattaacctgttctttacatttcctttgatgatgaaccctgtttatgagatactggagagaaggttttggggtggaaggtattgtttgtggcttagatgggtatccgttttgttggttactttggtggctctaatggtgccgaactttgccgatttcatgtccttggtggggagtagtgtatgctgtgggctgggatttgttttgccagctttgtttcacctgctcgtgttcaaggaggagatgagctggaaagggtggagtattgatgtagggattgtggccttaggccttgttcttgctgtttctgggacatggtatgctctcatggagatctttgctgtcaaggtatag

SEQ ID NO: 302 - protein, 428 aa, Populus balsamifera subsp. trichocarpa
  misc_feature (1)..(428): Ceres ANNOT ID no.1513514
  misc_feature (1)..(428): Bit score of 1107.4 for HMM based on sequences of FIGURE 12.
  misc_feature (29)..(421): Pfam Name: Aa_trans Pfam Description: Transmembrane amino acid transporter protein
  misc_feature (1)..(428): Functional Homolog Of Ceres SEEDLINE ID no. ME04507 at SEQ ID NO: 300
MGFGRKKASSSAKTFPPREDTPLIAKSTPLSSQSKTFANVFIAIVGAGVLGLPYAFKRTGWLMSLIMLFSVAGLTHYCMMLLVNTRGKLQSFSGGFSKITSFGDVGFTVCGSIGRFVVDVMIVLSQAGFCIGYLIFIANTLANLFNSPSPNGLASQILALSMSAKSWYMWGCFPFQLGLNSIATLTHLAPLSIFADVVDLAAMGVVIVKDVFIMMENRAEVRAFGGLSVFFYGMGVAVYAFEGIGMVLPIESEMREREKFGRILGLSMGLISVIYGAFGVLGYFAFGNDTQDIITANLGPGLISLLVQLGLCINLFFTFPLMMNPVYEILERRFWGGRYCLWLRWVSVLLVTLVALMVPNFADFMSLVGSSVCCGLGFVLPALFHLLVFKEEMSWKGWSIDVGIVALGLVLAVSGTWYALMEIFAVKV

SEQ ID NO: 303 - DNA, 1281 bp, Populus balsamifera subsp. trichocarpa
  misc_feature (1)..(1281): Ceres ANNOT ID no.1451213
  misc_feature (1)..(1281): Encodes the peptide sequence at SEQ ID NO 304
atgggatttgataaagaagcaagttcatcttcacatgttttgaagatacctcggtttccaagagaagacacccctttattaagcaagagacctccagtttcttctcaaggcaagacctttgcaaatgttttcatagctatagttggtgcaggagttcttggcttaccttacactttcaagaaaacaggatgggttatgggctctatcatggttttctccgttgctttcctgacttactattgcatgatgttgttagtgcatactcgtagaaagcttgaatctttagaaggattctcaaagattgcatcttttggtgatctgggttttactgtttgtggccctataggtcgttttgctgttgatattatgattgttcttgcacaagctgggttttgtgttagctatcttatttttattgctaacactttagcttatgttgttaatcatcaatccggtgatagaattttgggctttttgagtcccaaagctttgtatatatggggttgttttccttttcagttggggttgaattcaattccaacgttgacccatttggccccacttagtatttttgctgatgttgttgatcttggagctatgggagtggttatggtagaggatgtgatggtatttttgaaaaataggccagctttagaagcttttggtgggttctctgttttcttttatggtttaggtgtggctgtttatgcctttgagggaattggtatggtattgccattggagactgaagctaaacacaaggacaattttggtagagtgttggggttatgtatggctttcatttctttgttgtatggaggttttggggtattgggttactttgcttttggtgaagataccaaggatataatcactaccaatttgggacctggactactgagcaatcttgtgcagattggtttgtgtgtgaatctgttctttacattcccattgatgatgaatccagtttatgaagtggtggagagaaggttttgtgattctaggtattctatatggctgagatgggtagttgttttgggagtgagtttggtggctttgttggtgcctaattttgcagatttcttgtctctagtagggagcagcgtgtgttgtattctggggtttgtgttgcctgctttgtttcatctgttggtgttcaaggaagagctgggttggaatggtttgcttttggatggggcttttgtggtttttggtgtcatcattgctgtcaccggtacctggtcttccttgatggagatatttgcatccaagacctcttag

SEQ ID NO: 304 - protein, 426 aa, Populus balsamifera subsp. trichocarpa
  misc_feature (1)..(426): Ceres ANNOT ID no.1451213
  misc_feature (1)..(426): Bit score of 952.4 for HMM based on sequences of FIGURE 12.
  misc_feature (32)..(418): Pfam Name: Aa_trans Pfam Description: Transmembrane amino acid transporter protein
  misc_feature (1)..(426): Functional Homolog Of Ceres SEEDLINE ID no. ME04507 at SEQ ID NO: 300
MGFDKEASSSSHVLKIPRFPREDTPLLSKRPPVSSQGKTFANVFIAIVGAGVLGLPYTFKKTGWVMGSIMVFSVAFLTYYCMMLLVHTRRKLESLEGFSKIASFGDLGFTVCGPIGRFAVDIMIVLAQAGFCVSYLIFIANTLAYVVNHQSGDRILGFLSPKALYIWGCFPFQLGLNSIPTLTHLAPLSIFADVVDLGAMGVVMVEDVMVFLKNRPALEAFGGFSVFFYGLGVAVYAFEGIGMVLPLETEAKHKDNFGRVLGLCMAFISLLYGGFGVLGYFAFGEDTKDIITTNLGPGLLSNLVQIGLCVNLFFTFPLMMNPVYEVVERRFCDSRYSIWLRWVVVLGVSLVALLVPNFADFLSLVGSSVCCILGFVLPALFHLLVFKEELGWNGLLLDGAFVVFGVIIAVTGTWSSLMEIFASKTS

SEQ ID NO: 305 - DNA, 1284 bp, Populus balsamifera subsp. trichocarpa
  misc_feature (1)..(1284): Ceres ANNOT ID no.1488546
  misc_feature (1)..(1284): Encodes the peptide sequence at SEQ ID NO 306
atggagtctggaaaaaatgcagcattctcatctgcaaaagctctaccaagagaagacacacctctcatacccaattccccgactctatcctctcaatccaagacttttgcaaatgtattcattgctattgttggtgctggtgttcttggtctcccttatgcttttaaacgcacaggttggataatgagtcttatgatgcttttttctgttgctggtttaactcattattgtatgatgttgttaatccatacacgtagaaagcttcaatctttatctggtgatttcgcaaagattaactcctttggtgatctgggtttcaccgtttgtggttctcttgggaggtttgttgttgatgtaatgattgttttgtctcaagctggattttgtattggttatttgatatttattggtaataccatggctaatctgttcaatgcatcatcacctgatagcttgacttctcaagttattgccttctcaatgtccgctaagagctggtatatatggggctgttttccttttcaattgggattaagttctgttgcaacgttgacccatttggctccgttgagcatttttgctgatgttgttgatcttgctgccatgggagtggtgattgctaaggatgtttttttaatgatggagaataggcctgaagttagagcctttggaggtttgtctgtgtttttctacgggatgggcgtggctgtatatgcatttgaaggggttggtatggttttgccaatagaatctgaaatgaaagagagggaaacgtttgggaaaatcttaggtttgagcatggggcttatttcagtgatatatggagcttttggtgtgctgggttactttgcttttggaaatgatactcaggatattatcactgctaatttagggcctgggctcattagccttttggttcaattgggtctttgtatcaatctgtttttcacatttcccctgatgatgaaccctgtttatgagatagtggagagaagattctggggtggcaggtattgcctgtggcttagatggctgtcggttatgctggttactctggtggctttaacggtgccaaatttcgccgatttcttgtccttggtggggagcagtgtatgttgtggattgggatttgttttgccagctttgtttcacttgcttgtgttcaaggaagagatgaactggaaaggatggacaattgatgtggggattgtgtccttgggccttgttcttgcggtttcagggacttggtatgctctcatggagatcttcgctatcaaggcatag

SEQ ID NO: 306 - protein, 427 aa, Populus balsamifera subsp. trichocarpa
  misc_feature (1)..(427): Ceres ANNOT ID no.1488546
  misc_feature (1)..(427): Bit score of 1036.7 for HMM based on sequences of FIGURE 12.
  misc_feature (28)..(420): Pfam Name: Aa_trans Pfam Description: Transmembrane amino acid transporter protein
  misc_feature (1)..(427): Functional Homolog Of Ceres SEEDLINE ID no. ME04507 at SEQ ID NO: 300
MESGKNAAFSSAKALPREDTPLIPNSPTLSSQSKTFANVFIAIVGAGVLGLPYAFKRTGWIMSLMMLFSVAGLTHYCMMLLIHTRRKLQSLSGDFAKINSFGDLGFTVCGSLGRFVVDVMIVLSQAGFCIGYLIFIGNTMANLFNASSPDSLTSQVIAFSMSAKSWYIWGCFPFQLGLSSVATLTHLAPLSIFADVVDLAAMGVVIAKDVFLMMENRPEVRAFGGLSVFFYGMGVAVYAFEGVGMVLPIESEMKERETFGKILGLSMGLISVIYGAFGVLGYFAFGNDTQDIITANLGPGLISLLVQLGLCINLFFTFPLMMNPVYEIVERRFWGGRYCLWLRWLSVMLVTLVALTVPNFADFLSLVGSSVCCGLGFVLPALFHLLVFKEEMNWKGWTIDVGIVSLGLVLAVSGTWYALMEIFAIKA

SEQ ID NO: 307 - DNA, 1218 bp, Populus balsamifera subsp. trichocarpa
  misc_feature (1)..(1218): Ceres ANNOT ID no.1460251
  misc_feature (1)..(1218): Encodes the peptide sequence at SEQ ID NO 308
atgggatttgggaggaaaaaagcatcctcatcagcaaaaacttttccaccgagagaagacacacctctcatagccaagtccacgcctttatcatctcaatcgaagacttttgcaaatgtcttcattgctattgtcggtgctggtgttcttggtctcccttatgctttcaaacgcacagtcaatactcgtggaaagcttcaatctttttctggtggattctcaaagattacctcttttggtgatgtgggtttcactgtttgtggttctattgggaggtttgttgttgatgttatgattgtcttgtcacaagctggattttgtattggttatttgatattcattgctaatactttggctaatctattcaattcgccatcacctaatggcctggcttctcaaattctggccctttcaatgtcagctaagagttggtatatgtggggttgttttccttttcagttggggttgaattctattgcaacgttgacccatttggctcctctgagtatttttgccgatgttgttgatcttgctgccatgggagtggtgattgttaaggatgtttttataatgatggaaaatagggctgaagttagagcatttggaggtttgtctgtgtttttctatgggatgggtgtggctgtttatgcgtttgaagggattggcatggttttgccaatagaatctgaaatgagagagagggaaaagtttgggagaatcctagggctgagcatggggcttatttcagtgatatatggagcttttggcgtgctgggttactttgcttttggaaatgatactcaggatattatcactgctaatttagggcctggactcattagcctcttggttcaattgggtctttgtattaacctgttctttacatttcctttgatgatgaaccctgtttatgagatactggagagaaggttttggggtggaaggtattgtttgtggcttagatgggtatccgttttgttggttactttggtggctctaatggtgccgaactttgccgatttcatgtccttggtggggagtagtgtatgctgtgggctgggatttgttttgccagctttgtttcacctgctcgtgttcaaggaggagatgagctggaaagggtggagtattgatgtagggattgtggccttaggccttgttcttgctgtttctgggacatggtatgctctcatggagatctttgctgtcaaggtatag

SEQ ID NO: 308 - protein, 405 aa, Populus balsamifera subsp. trichocarpa
  misc_feature (1)..(405): Ceres ANNOT ID no.1460251
  misc_feature (1)..(405): Bit score of 1008.3 for HMM based on sequences of FIGURE 12.
  misc_feature (78)..(398): Pfam Name: Aa_trans Pfam Description: Transmembrane amino acid transporter protein
  misc_feature (1)..(405): Functional Homolog Of Ceres SEEDLINE ID no. ME04507 at SEQ ID NO: 300
MGFGRKKASSSAKTFPPREDTPLIAKSTPLSSQSKTFANVFIAIVGAGVLGLPYAFKRTVNTRGKLQSFSGGFSKITSFGDVGFTVCGSIGRFVVDVMIVLSQAGFCIGYLIFIANTLANLFNSPSPNGLASQILALSMSAKSWYMWGCFPFQLGLNSIATLTHLAPLSIFADVVDLAAMGVVIVKDVFIMMENRAEVRAFGGLSVFFYGMGVAVYAFEGIGMVLPIESEMREREKFGRILGLSMGLISVIYGAFGVLGYFAFGNDTQDIITANLGPGLISLLVQLGLCINLFFTFPLMMNPVYEILERRFWGGRYCLWLRWVSVLLVTLVALMVPNFADFMSLVGSSVCCGLGFVLPALFHLLVFKEEMSWKGWSIDVGIVALGLVLAVSGTWYALMEIFAVKV

SEQ ID NO: 309 - DNA, 1708 bp, Triticum aestivum
  misc_feature (1)..(1708): Ceres CLONE ID no.923483
  misc_feature (1)..(1708): Encodes the peptide sequence at SEQ ID NO 310
aaaatcaaaattcacttcgaaaagctccgctacttctcttgtctctgcgtcgccgccgccacggttgttgctgcggatggctgaggcgaagggggcggctgcgccgctgctggcgcgggaggatgggagacggcgtggaggctggggaggagcaacctgggcgcagacgctgggcaacgtggtggtgtccattgtgggcacgggggtgctcggcctgccctacgccttccgagccgccggctgggtcgccggatccctcggcgtcgccgccgccggattcgccacgctctactgcatgctcctcctggtggactgtaaagataaattgcaggaggaagaaactgatgaaccaaagaattatacatatggagattttggtgagaagtgctttgggactataggtcggtgcttgacggaaattctcattcttatctcacaagcgggtggttctgtagcttacctagtattcattggtgaaaatctgcattccgtgtttagccagtcgatgtcaccagctggcttcatctttgccgtcctattgcctgtgcaaatcgcgttgtccttcattctttcactatcctctctttcaccattcagtatatttgctgatgtgtgcaatgtcctagcggcggcagtggttatcagaaaagatcttcaactaattgatcatccttttgcaaatagaagtgcttttaatggagttttggcgatacctttcgcttttggagtcgcggtcttctgctttgaaggattcagcatgacactggcactagaatcatcaatggcggaacgtagaaagttccgttgggtgctttctcaagcagttgtgggcatcatagttgtgtatgcatgttttggagtatgtgggtacttggcctatggtgaggctaccaaggacatcataacacttaatcttcccaatagttggtcatctgctgctgttaaggttggcctatgcattgcactagcattcacattcccagttatgatgcacccgattcacgagattgtggagacaaggctcagatcaagtggatgcttccagaagctctcccacggggttcctggtgccgagtggctaggcctgcactcgagccgcatcatcatggtgactattttaactgtgatggcatcctgcatacctgcatttgggtccttcgtctcctttgttgggtgcaccgtctgtgcgctgctctcctttgtgctacctaccttcttccacctcaacatcgtaggatcgtcaatgagcctatggagaagagtgctggactacggcttccttctgtttggccttggttttgctggttatggaatattcactgctctctcgtcacactgactgatgaagtaatgacaaaatgtccaagatctgcaaattagggtttatttcttcggaagacgtgtctggagagaaatatctgctgccctgggataacatgcatcaaattgagaagactttcatactcagctgattatcccctgccttggtttgatttgttaggtggtggtgtactttatatgtatctttacctttcgtatcatttttttaaaatgtattcataggaggcaacatgatgtttatcgtgatttggttgtgatccttatctgtctgttgtcaggatttctgtttttgagtctgatagttcatacagatgataaggaagcacatgggtccatcaatgctattgtccatgtgaagctgcagagc

SEQ ID NO: 310 - protein, 420 aa, Triticum aestivum
  misc_feature (1)..(420): Ceres CLONE ID no.923483
  misc_feature (1)..(420): Bit score of 1020.7 for HMM based on sequences of FIGURE 12.
  misc_feature (24)..(418): Pfam Name: Aa_trans Pfam Description: Transmembrane amino acid transporter protein
  misc_feature (1)..(420): Functional Homolog Of Ceres SEEDLINE ID no. ME04507 at SEQ ID NO: 300
MAEAKGAAAPLLAREDGRRRGGWGGATWAQTLGNVVVSIVGTGVLGLPYAFRAAGWVAGSLGVAAAGFATLYCMLLLVDCKDKLQEEETDEPKNYTYGDFGEKCFGTIGRCLTEILILISQAGGSVAYLVFIGENLHSVFSQSMSPAGFIFAVLLPVQIALSFILSLSSLSPFSIFADVCNVLAAAVVIRKDLQLIDHPFANRSAFNGVLAIPFAFGVAVFCFEGFSMTLALESSMAERRKFRWVLSQAVVGIIVVYACFGVCGYLAYGEATKDIITLNLPNSWSSAAVKVGLCIALAFTFPVMMHPIHEIVETRLRSSGCFQKLSHGVPGAEWLGLHSSRIIMVTILTVMASCIPAFGSFVSFVGCTVCALLSFVLPTFFHLNIVGSSMSLWRRVLDYGFLLFGLGFAGYGIFTALSSH

SEQ ID NO: 311 - DNA, 1731 bp, Zea mays
  misc_feature (1)..(1731): Ceres CLONE ID no.304357
  misc_feature (1)..(1731): Encodes the peptide sequence at SEQ ID NO 312
caatcgccgcagcagctggtcccctgctcggctcgtctgatccagcggctgaatccacaggccatggggttcgacaaggaggcgagctcctcctcctcgcggctcgacgcggcgccgctgctcccgcagcacggcggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgccggatcgcggacgcgcaccccaagatcgcctccttcggggacctgggccacgccatctacggcgcgcccgggcgccacgcggtcgacgccatgctcgtgctcagccaggccagcttctgcgtcggctacctgatcttcatctccaacaccatggcgcacctctaccccatcgccatcggggcccagtccccggcgtcgccgctcctcacggccaaggcgctcttcatctgggccatgctgccgttccagctcggcctcaactccatcaggacgctcacgctcctcgcgccgctcagcatcttcgccgacgtcgttgacctcggcgccatgggcgtcgtcctgggccaggacgcctccgtctggctcgccgacaggccccccgtgttcgccttcgctggccccgcccagctcctctacggcctcggcgtcgccgtctacgccttcgagggcatcggcatggtcctgccgctggaggcggaggccgccgacaagcgcaggttcggcgccacgctcgcgctgtccatggcgttcatcgccgtcatgtacgggctgttcggcgccatgggctacctcgccttcggcgccgccacgcgggacatcatcaccaccaacctcggcaccggctggctctcggtcctcgtgcagctcggcctctgcatcaacctcttcttcaccatgccggtgatgatgaacccggtctacgaggtcgcggagcgcctgctctgcggcaagcgctacgcctggtggctgcgctggatcctcgtcgtgctcgtcgggctcctggcgatgctcgtgcccaacttcgcagacttcctctcgctcgtcggcagcagcgtctgcgtcgtgctcggcttcgtgctgcccgccgtgttccacctcaaggtcttcggcaccgagatcgggtgggccggcctcgtcgccgacgtggccatcatcgtcaccgggattgcgctcgcggtgtccgggacatggacgtcactcgtacagatcttcagttcttccgacctgtaagcatcgacagtctgatatgtgcaatgggagggctcaaattggttccaatagattgagacacaattcagcgaccgggataacactgcatgcatttgtggacgtccgatcccgcaggcgatggttcagatccgatggttgaacagcaatttcttaaacactagccgcagtaccgactgcattttatccagctgccatgtcgattgagcattttatccgatggtaaagtatgggaacaaactattgttgggagctctctgaaatctacattggtttggttcagatagagccatatagattccagctgtaccaggcagcagatccatgtgtaaagcctatatgatgttgtattgaattgaatcgatgactgctttatgcaagattcttttgtcc

SEQ ID NO: 312 - protein, 425 aa, Zea mays
  misc_feature (1)..(425): Ceres CLONE ID no.304357
  misc_feature (1)..(425): Bit score of 1100.5 for HMM based on sequences of FIGURE 12.
  misc_feature (31)..(417): Pfam Name: Aa_trans Pfam Description: Transmembrane amino acid transporter protein
  misc_feature (1)..(425): Functional Homolog Of Ceres SEEDLINE ID no. ME04507 at SEQ ID NO: 300
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQASFCVGYLIFISNTMAHLYPIAIGAQSPASPLLTAKALFIWAMLPFQLGLNSIRTLTLLAPLSIFADVVDLGAMGVVLGQDASVWLADRPPVFAFAGPAQLLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVLVGLLAMLVPNFADFLSLVGSSVCVVLGFVLPAVFHLKVFGTEIGWAGLVADVAIIVTGIALAVSGTWTSLVQIFSSSDL

SEQ ID NO: 313 - DNA, 1778 bp, Zea mays
  misc_feature (1)..(1778): Ceres CLONE ID no.263136
  misc_feature (1)..(1778): Encodes the peptide sequence at SEQ ID NO 314
  misc_feature (1587)..(1587): y is t/u or c
gttgttccccaggcgcagcagcacggcagtcctccgtttcctcctcgtcgctcgccccggttgtctcctcctcgacctcccccgtcgcgacaccgcccgatctctctagcgcacggcggccggagaagaggaggagggggggacgatctcattcatcggaccggcgtgcctgtgtcgtctgctgttttcgtttttttctttactcttttttttccctcctttgcttgttcaattcaatcagtatattaagatttctgatttgggggcggctcgccatgggattcggaatggggaataataacaacggggcgagctcctcgtcgtcgcgcctggacccggcggcgccgctgctgccgcgccacggcagcagcgggggccgcgagggtggtggcctgtcctcgcagccgaagacgttcgccaacgtcttcatcgcggtggtcggcgccggcgtgctggggctgccgtacaccttctcgcgcaccgggtgggcggcggggtcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcacgggcggttcgccgtggacgtgatgctggtgctcagccaattcagcttctgcgtcggctacctcatcttcatctccaacaccatggcgcacctctatccgattaccgccgcggcgtcctcatcctccgcgctcctctcccccaaggcgctcgtcatctgggcgatgctgcctttccagctcgggctcaactccatcaagacgctgacgctgcttgcgccgctcagcatcttcgccgacgtcgttgacctcggcgccatgggcgtggtcctcggccaggacgtcgccgcctggctcgccaagcccgtgcccgtggtcgccttcggcggcgctggcgcgcttctctacgggctcggcgtctccgtgtacgcgttcgagggcatcggcatggtgctgccgctggaggcggaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaaccttttcttcacgatgccggtgatgatgaaccccgtgtacgaggtcgccgagcgcctgctccacggcaagcggtactgctggtggcttaggtggctgctggtcgtcgtcgtcggactggccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatattccaatcgtcaagcgcttgatcgacgcaccttycgctgcgcgtcgatcatcgcattctccagggcaactacgatacatgtgttgagtgttgttcgtgagtggcttgtattggacgggggaaatctgtacgcttttcgtaccacagatttcagttactcccggtagcagtgtatgtgtatgcgtcctagatgttcctcctgctgtgcacgatgggggatacgatg

SEQ ID NO: 314 - protein, 432 aa, Zea mays
  misc_feature (1)..(432): Ceres CLONE ID no.263136
  misc_feature (1)..(432): Bit score of 1089.1 for HMM based on sequences of FIGURE 12.
  misc_feature (39)..(424): Pfam Name: Aa_trans Pfam Description: Transmembrane amino acid transporter protein
  misc_feature (1)..(432): Functional Homolog Of Ceres SEEDLINE ID no. ME04507 at SEQ ID NO: 300
MGFGMGNNNNGASSSSSRLDPAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFAVDVMLVLSQFSFCVGYLIFISNTMAHLYPITAAASSSSALLSPKALVIWAMLPFQLGLNSIKTLTLLAPLSIFADVVDLGAMGVVLGQDVAAWLAKPVPVVAFGGAGALLYGLGVSVYAFEGIGMVLPLEAEAANKSKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMEWPGVLSDVLLVVIGLALAVFGTYTSLLQIFQSSSA

SEQ ID NO: 315 - DNA, 1900 bp, Panicum virgatum
  misc_feature (1)..(1900): Ceres CLONE ID no.1902716
  misc_feature (1)..(1900): Encodes the peptide sequence at SEQ ID NO 316
cccccccaaacacagcagcagcagcacggccgtcgtcctccgtttcctcctctcctcgccgcagtgccgcacctgggggcagcccgcgagccattctctcctcctcgatccccctcgtcgcgggatcgccggatctctctcgcacaccgcggccggagaagaggaggagagaggcagtcttgttcatcggatcggcgcgcctgtgttgtctggtttcgatttccctttttttttcagggtcaataggatttgggggcggtcgccatgggattcgggatgggaaatgacggggcgagctcgtcgtcgtcgcggctggaccccgcgccgctcctgccgcaccacggcagcgcgggcggcgagatcggcctgtcgtcgcagcccaagacgttcgccaacgtcttcatcgcggtggtcggcgccggcgtgctggggctgccgtacaccttctcgcacaccgggtgggcggcggggtcgctgctgctcttcgccgtcgccgtgctcaccttctactgcatgatgctgctcgtggcctgccgccgccgcctcgccgacgagcgcccgaagatcgcctcgttcggggacctcggggacgccgtgttcggcgcgcacgggcggttcgccgtcgacgtcatgctggtgctcagccaagcgagcttctgcatcgggtacctcatcttcatctccaacaccatggcgcacctctacccgatattcgcgccgtcgtcctccgccctcctctcccccaaggcgctcttcatctgggcgatgctgccgttccagctcgggctcaattccattaagacgctcacgctgctcgcgccgctcagcatcttcgccgacgtcgtcgacctcggcgccatgggggttgtccttggccaggacgtcgccgcctggctcgccatgcccccacccgtggtcgcgttcggcggcccggccgcgctcctctacgggctcggcgtctccgtgtacgcgttcgagggagtcggcatggtgctgccgctggaggcggaggcggcgaacaagaggaagttcggcgtcacgctcgggctgtccatggcgttcatcgccgtcatgtacgggctgttcggcgtgatggggtacgtcgcgttcggcgacgccacgcgggacatcatcaccaccaacctcggcgccgggtggctgtcggccgccgtgcagctggggctctgcatcaacctcttcttcacgatgccagtgatgatgaaccccgtgtacgaggtcgccgagcgcctgctccacggcaagcgctactgctggtggctccgctggctgctcgtcgtcgtcgtcgggctcgccgccatgtacgtgcccaacttcaccgacttcctggcgctcgtcggaagcagcgtctgcgtcctcctcgggttcgtgctgccggcctcgttccacctcaaggtgttcggcgccgagatggcctggcccggggtgctctccgacgccctcctggtcgtgctcggcctcgcgctcgccgtgttcgggacgtacacgtcgctgctgcaaatcttccactcgtccagcgcttgatctccccaccatggcaccatttgctatgtgccgagtaaattcatactctggcggattagtttcaggtgttggtcgcgcctctgttcagagaagtggaacaggggaggaacggccgcccgtctcaggtgatttgggcgtggatttgcatcagtcgtcgcgttcttccagggcagattacgtttcagatgttgttcgtgattgggttgtatagcatggtaactagatctgtctgcttttgccttggcagatttcagttactccaggtagcaatgtactacgaatgtttgcgtcctagatgaccctcctgctgtgcatgatggattcgatgaaagggcaacatttttaggtcgtggaagct

SEQ ID NO: 316 - protein, 425 aa, Panicum virgatum
  misc_feature (1)..(425): Ceres CLONE ID no.1902716
  misc_feature (1)..(425): Bit score of 1121.5 for HMM based on sequences of FIGURE 12.
  misc_feature (34)..(417): Pfam Name: Aa_trans Pfam Description: Transmembrane amino acid transporter protein
  misc_feature (1)..(425): Functional Homolog Of Ceres SEEDLINE ID no. ME04507 at SEQ ID NO: 300
MGFGMGNDGASSSSSRLDPAPLLPHHGSAGGEIGLSSQPKTFANVFIAVVGAGVLGLPYTFSHTGWAAGSLLLFAVAVLTFYCMMLLVACRRRLADERPKIASFGDLGDAVFGAHGRFAVDVMLVLSQASFCIGYLIFISNTMAHLYPIFAPSSSALLSPKALFIWAMLPFQLGLNSIKTLTLLAPLSIFADVVDLGAMGVVLGQDVAAWLAMPPPVVAFGGPAALLYGLGVSVYAFEGVGMVLPLEAEAANKRKFGVTLGLSMAFIAVMYGLFGVMGYVAFGDATRDIITTNLGAGWLSAAVQLGLCINLFFTMPVMMNPVYEVAERLLHGKRYCWWLRWLLVVVVGLAAMYVPNFTDFLALVGSSVCVLLGFVLPASFHLKVFGAEMAWPGVLSDALLVVLGLALAVFGTYTSLLQIFHSSSA

SEQ ID NO: 317 - DNA, 1909 bp, Panicum virgatum
  misc_feature (1)..(1909): Ceres CLONE ID no.1797307
  misc_feature (1)..(1909): Encodes the peptide sequence at SEQ ID NO 318
aaacgcagcagtagcagcacggccgtcgtcctccgtttcctcctcgccgcaccggggggcaatccgcaagccattctctcctcctcgattcccctcgtcgcgggatcgccggatctcccttgcacaccgcggccggagaagaggaggagaggggcagcctcattcatcggatcggcgtgcctgtgctgtctgtggtttcgattttccttttttcccccttatttttccaggtcgataagatttgggggcgatcgccatgggattcgggatggggaataacgaggcgagctcgtcgtcgtcgcggctggaccccgccccgctcctgccgcaccatggcagcgcgggcggcgagatcggcctgtcgtcgcagcccaagacgttcgccaacgtcttcatcgcggtggtcggcgccggcgtgctggggctgccgtacaccttctcgcacaccgggtgggcggcggggtcgctgctgctcttcgtcgtcgccgcgctcaccttctactgcatgatgctgctcgtcgcgtgccgccgccgcctcgccgacgagcacccgaagatcgcctcgttcggggacctgggggacgccgtgttcggcgcgcacgggcggtccgccgtggacgtgatgctggtgctcagccaagtgagcttctgcatcgggtacctcatcttcatctccaacaccatggcgcacctctacccgatattcgcgccgtcggcctccgccctcctctcccccaaggcgctattcatctgggcgatgctgccgttccagctcgagctcaattccatcaagacgctcacgctgctcgcgccgctcagcatcttcgccaacgtcgtggacctcggcgccatgggggttgtccttggccaggacgtcgctgcctggctcgccgagcccccacccgtggtcgcgttcggcggccctgccgcgctcctctacgggctcggcgtctccgtgtacgcgttcgagggagtcggcatggtgctgccgctggaggcggaggcggcgaacaagaggaagttcggcgtcacgctcgggctgtccatggcgttcatcgccgtcatgtacgggctgttcggcgtgatggggtacgtcgcgttcggcgacgccacaagggacatcatcaccaccaacctcggcgccgggtggttgtcggccgccgtgcagctgaggctgtgcatcaacctcttcttcacgatgccggtgatgatgaaccccgtgtacgaggtcgccgagcgcctgctccacggcaagcgctactgctggtggctccggtggctgctcgtcgtcgtcgtcgggctcgccgctatgtacgtgcccaacttcaccgacttcctggcgctcgtcgggagcagcgtctgcgtcgtcctcgggttcgtgctgccggcctcgttccacctcaaggtgttcggcgccgagatgggctggcccggggtgctctccgacgtcctcctggtcgtgctcgggctcgcgctcgccgtgttcgggacgtacacatcgctgctgcaaatcttccactcgtccagcgtttgatctccccaccatggctccatttgctatctgccgagtaaattcatcctcgggcggattaatttcaggtacgttggtcgcgcctctgttcagagaagtggaacaggggaggaacggccgcccatctcagctgatttgggcgtggatttgcagcggtcgtcgcattcttccagggcagactacgttattgatgttgttcgattgggttgtatagcatgggaagaatataatctctctgcttttgccgcggcagattgcagttactccatgtagcaatgtaataggaatgtttgcatactagatgatcctcctgctgtgcacgatggattcgatgaaagggcaacattctcaggtcatggaagcttatctgtttattgt

SEQ ID NO: 318 - protein, 425 aa, Panicum virgatum
  misc_feature (1)..(425): Ceres CLONE ID no.1797307
  misc_feature (1)..(425): Bit score of 1102.4 for HMM based on sequences of FIGURE 12.
  misc_feature (34)..(417): Pfam Name: Aa_trans Pfam Description: Transmembrane amino acid transporter protein
  misc_feature (1)..(425): Functional Homolog Of Ceres SEEDLINE ID no. ME04507 at SEQ ID NO: 300
MGFGMGNNEASSSSSRLDPAPLLPHHGSAGGEIGLSSQPKTFANVFIAVVGAGVLGLPYTFSHTGWAAGSLLLFVVAALTFYCMMLLVACRRRLADEHPKIASFGDLGDAVFGAHGRSAVDVMLVLSQVSFCIGYLIFISNTMAHLYPIFAPSASALLSPKALFIWAMLPFQLELNSIKTLTLLAPLSIFANVVDLGAMGVVLGQDVAAWLAEPPPVVAFGGPAALLYGLGVSVYAFEGVGMVLPLEAEAANKRKFGVTLGLSMAFIAVMYGLFGVMGYVAFGDATRDIITTNLGAGWLSAAVQLRLCINLFFTMPVMMNPVYEVAERLLHGKRYCWWLRWLLVVVVGLAAMYVPNFTDFLALVGSSVCVVLGFVLPASFHLKVFGAEMGWPGVLSDVLLVVLGLALAVFGTYTSLLQIFHSSSV

SEQ ID NO: 319 - protein, 425 aa, Oryza sativa subsp. indica
  misc_feature (1)..(425): Public GI ID no.116309713
  misc_feature (1)..(425): Bit score of 1112.2 for HMM based on sequences of FIGURE 12.
  misc_feature (33)..(417): Pfam Name: Aa_trans Pfam Description: Transmembrane amino acid transporter protein
  misc_feature (1)..(425): Functional Homolog Of Ceres SEEDLINE ID no. ME04507 at SEQ ID NO: 300
MGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVAVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 320 - protein, 422 aa, Oryza sativa subsp. indica
  misc_feature (1)..(422): Public GI ID no.125540628
  misc_feature (1)..(422): Bit score of 1062.3 for HMM based on sequences of FIGURE 12.
  misc_feature (31)..(414): Pfam Name: Aa_trans Pfam Description: Transmembrane amino acid transporter protein
  misc_feature (1)..(422): Functional Homolog Of Ceres SEEDLINE ID no. ME04507 at SEQ ID NO: 300
MGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASCGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAERLLHGKRYCWWLRWLLVLAVGLSAMYVPNFTDFLALVGSSVCVLLGFVLPASFHLKVFGAEMSWPGVLSDVLLVLLGLSLAVFGTYTSLLQIFHSSST

SEQ ID NO: 321 - protein, 425 aa, Oryza sativa subsp. japonica
  misc_feature (1)..(425): Public GI ID no.38345408
  misc_feature (1)..(425): Bit score of 1110.9 for HMM based on sequences of FIGURE 12.
  misc_feature (33)..(417): Pfam Name: Aa_trans Pfam Description: Transmembrane amino acid transporter protein
  misc_feature (1)..(425): Functional Homolog Of Ceres SEEDLINE ID no. ME04507 at SEQ ID NO: 300
MGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVTVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 322 - protein, 422 aa, Oryza sativa subsp. japonica
  misc_feature (1)..(422): Public GI ID no.115447835
  misc_feature (1)..(422): Bit score of 1066.6 for HMM based on sequences of FIGURE 12.
  misc_feature (31)..(414): Pfam Name: Aa_trans Pfam Description: Transmembrane amino acid transporter protein
  misc_feature (1)..(422): Functional Homolog Of Ceres SEEDLINE ID no. ME04507 at SEQ ID NO: 300
MGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASFGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAERLLHGKRYCWWLRWLLVLAVGLSAMYVPNFTDFLALVGSSVCVLLGFVLPASFHLKVFGAEMSWSGVLSDVLLVLLGLSLAVFGTYTSLLQIFHSSSA

SEQ ID NO: 323 - protein, 395 aa, Oryza sativa subsp. japonica
  misc_feature (1)..(395): Public GI ID no.115459950
  misc_feature (1)..(395): Bit score of 992.3 for HMM based on sequences of FIGURE 12.
  misc_feature (33)..(387): Pfam Name: Aa_trans Pfam Description: Transmembrane amino acid transporter protein
  misc_feature (1)..(395): Functional Homolog Of Ceres SEEDLINE ID no. ME04507 at SEQ ID NO: 300
MGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFAGPTEILYGLGVAVYAFEGIGMVLPLEAEAADKRKFGGTLALSMAFIAVMYGLFGAMGYLAFGAATRDIITTNLGTGWLSVTVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 324 - DNA, 1281 bp, Sorghum bicolor
  misc_feature (1)..(1281): Ceres ANNOT ID no.6017635
  misc_feature (1)..(1281): Encodes the peptide sequence at SEQ ID NO 325
atgggattcggaatggggaataataacggggcgagctcctcgtcgtcgcggctggacccggcgccgctgctgccgcaccacggcagcgggagccgcgaggtcggcctgtcgtcgcagcccaagacgttcgccaacgtcttcatcgcggtggtgggcgccggcgtgctgggactgccgtacaccttctcgcacaccgggtgggcggcggggacgctgctgctcttctccgtcgccgcgctcaccttctactgcatgatgctgctcgtcgcgtgccgccgccgcctcgccgacgagcaccctaagatcgcctcgttcggggacctcggggacgccgtgttcggcgcgcacggccggttcgccgtcgacgtcatgctggtgctcagccaagtcagcttctgcgtcggctacctcatcttcatctctaacaccatggcgcacctctacccgattaccgcgccgtcctcctcggccctcctctcccccaaggcgctcgtcatctgggcgatgctgccgttccagctcgggctcaattccatcaagacgctcacgctgctcgcgccactcagcatcttcgccgacgtcgtcgacctcggcgccatgggcgtggtgcttggccaggacgttgccgcctgggtcgctaagcccgtgcccgtggccgccttcggcgggcctgccgcgcttctctacggtctcggcgtctccgtgtacgcgttcgagggcgtcggcatggtgctgccgctggaggccgaggcggcgaacaagaagaagttcggcgtcacgctggggctgtccatggcgttcatcgccgtcatgtacgggctgttcggcgtgatggggtacgtcgcgttcggcgacgccacgcgggacatcatcaccacaaacctcggcgccgggtggctgtcggccgccgtgcagctggggctctgcatcaacctcttcttcacgatgccggtgatgatgaaccccgtgtacgaggtcgccgagcgcctgctccacgggaagcgctactgctggtggctgaggtggctgctcgtcatcgtcgtcggactcgccgccatgtacgtgcccaacttcacggacttcctggcgctcgtcgggagcagcgtctgcgtcctcctcggcttcgtgctgccggcctcgttccacctcaaggtgttcggcggcgagatggaatggcccggagtggtatccgatgtcctgctggtcgtgatcggcctctcgctcgccgtgttcgggacgtacacgtcgctgctgcaaatcttccactcgtcaagcgcttga

SEQ ID NO: 325 - protein, 426 aa, Sorghum bicolor
  misc_feature (1)..(426): Ceres ANNOT ID no.6017635
  misc_feature (1)..(426): Bit score of 1117.2 for HMM based on sequences of FIGURE 12.
  misc_feature (35)..(418): Pfam Name: Aa_trans Pfam Description: Transmembrane amino acid transporter protein
  misc_feature (1)..(426): Functional Homolog Of Ceres SEEDLINE ID no. ME04507 at SEQ ID NO: 300
MGFGMGNNNGASSSSSRLDPAPLLPHHGSGSREVGLSSQPKTFANVFIAVVGAGVLGLPYTFSHTGWAAGTLLLFSVAALTFYCMMLLVACRRRLADEHPKIASFGDLGDAVFGAHGRFAVDVMLVLSQVSFCVGYLIFISNTMAHLYPITAPSSSALLSPKALVIWAMLPFQLGLNSIKTLTLLAPLSIFADVVDLGAMGVVLGQDVAAWVAKPVPVAAFGGPAALLYGLGVSVYAFEGVGMVLPLEAEAANKKKFGVTLGLSMAFIAVMYGLFGVMGYVAFGDATRDIITTNLGAGWLSAAVQLGLCINLFFTMPVMMNPVYEVAERLLHGKRYCWWLRWLLVIVVGLAAMYVPNFTDFLALVGSSVCVLLGFVLPASFHLKVFGGEMEWPGVVSDVLLVVIGLSLAVFGTYTSLLQIFHSSSA

SEQ ID NO: 326 - DNA, 1281 bp, Sorghum bicolor
  misc_feature (1)..(1281): Ceres ANNOT ID no.6026632
  misc_feature (1)..(1281): Encodes the peptide sequence at SEQ ID NO 327
atgggattcgacaaggaggcgagctcctcgtcctcgcggctcgacgcggcgccgctgctcccgcagcacgggctgcacggcggcggcggcggcggcgggcacctgtcgtcgcagcccaagacgttcgccaacgtcttcatcgccgtcgtcggctcgggcgtgctgggcctcccctacaccttctcccgcacgggctgggcggcggggacgctgctcctcctcgccgtcgccgcgctcaccttccactgcatgatgctcctcgtcgccacacgccgccggatcgccgacgagcaccccaagatcgcctccttcggggacctgggccacgccgtctacggcgcgcccgggcgccacgcggtggacgccatgctcgtgctcagccaggccagcttctgcgtcggctacctgatcttcatctccaacaccatggcgcacctttaccccatcggggccgagtccccggcgtccccgctcctcacggccaaggcgctcttcatctgggccatgctgccgttccagctgggactcaactccatcaagacgctcacgctcctcgcgccgctcagcatctttgccgacgtcgttgacctcggagccatgggcgtcgtccttggccaggacgcctcaatctggctcgccaacaagccccccgtgttcgccttcgctggccccgccgagctcctctacggcctcggcgtcgccgtctacgccttcgaggggatcggcatggtgctgccgctggaggcggaggccgcggacaagcgaaggttcggcgccacgctcgcgctgtccatggcgttcatcgccgtcatgtacgggctgttcggcgccatgggctacctcgcctttggcgccgccacgcgggacatcatcaccaccaacctcggcaccggctggctctcggtccttgtacagctcggcctctgcatcaacctcttcttcaccatgccggtgatgatgaacccggtgtacgaggtcgccgagcgcctgctctgtggcaagcgctacgcctggtggctgcgctggatacttgtcgtggtcgtcgggctcctggcgatgctcgtgcccaacttcgccgacttcctctcgctcgttggcagcagcgtctgcgtcgtgctcggattcgtgctgcccgctacgttccacctcaaggttttcggcgcagagatcgggtggactgggctcgtcgccgacgtggccgttatcgtaatcgggactgtgctcgcggtgtccgggacatggacgtcacttgtacaaatcttcagttcttccaacctgtaa

SEQ ID NO: 327 - protein, 426 aa, Sorghum bicolor
  misc_feature (1)..(426): Ceres ANNOT ID no.6026632
  misc_feature (1)..(426): Bit score of 1101.2 for HMM based on sequences of FIGURE 12.
  misc_feature (34)..(418): Pfam Name: Aa_trans Pfam Description: Transmembrane amino acid transporter protein
  misc_feature (1)..(426): Functional Homolog Of Ceres SEEDLINE ID no. ME04507 at SEQ ID NO: 300
MGFDKEASSSSSRLDAAPLLPQHGLHGGGGGGGHLSSQPKTFANVFIAVVGSGVLGLPYTFSRTGWAAGTLLLLAVAALTFHCMMLLVATRRRIADEHPKIASFGDLGHAVYGAPGRHAVDAMLVLSQASFCVGYLIFISNTMAHLYPIGAESPASPLLTAKALFIWAMLPFQLGLNSIKTLTLLAPLSIFADVVDLGAMGVVLGQDASIWLANKPPVFAFAGPAELLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVVVGLLAMLVPNFADFLSLVGSSVCVVLGFVLPATFHLKVFGAEIGWTGLVADVAVIVIGTVLAVSGTWTSLVQIFSSSNL

SEQ ID NO: 328 - DNA, 1290 bp, Sorghum bicolor
  misc_feature (1)..(1290): Ceres ANNOT ID no.6026633
  misc_feature (1)..(1290): Encodes the peptide sequence at SEQ ID NO 329
atggaattcgacaaagaggcgagctcctcgtcctcgcggctcgacgcggcgccgctactcccgcagtacgggctgcactgcggcggcgccggggccggcgcgggcgggcacctgtcgtcgcagcccaagacgttcgccaacgtcttcatcgccgtcgtcggcacgggcgtgctgggcctcccctacaccttctcccgcacgggctgggcggcggggacgctgctcctcctcgccgtcgccgcgctcaccttccactgcatgatgctcctcgtcgccacgcgccgccggatcgccgacgagcacaccaagatcgcctccttcggggacctgggccacggcatctacggcgccccgggccgccacgcggtcgacgccatgctcgttctcagccaggtcagcttctgcgtcggctacgtaatcttcatctccaacaccatggcgcacctatacccgatcgtggccgactccccggcgtccccgctcctcacggccaaggcgctcttcatctgggccatgctgccgttccagctgggactcaactccatcaagacgctcacgctcctcgcgccgctcagcatcttcgccgacgtcgttgacctcggcgccatgggcgtcgtactgagccaggacgcctccatctggctcgccaacaagcctcccgtgttcgccttcgctggccctgccgagctcctctacggccttggcgtcgccgtctacgccttcgaggcgatcggaatggtcctgccgctggaggcggaggctgcggacaagcgcaggttcggcgccacgctcgcgctgtccatggcgttcatcgccgtcatgtacgttctgttcggcgccatgggctacctcgccttcggctccgccacgcgggacatcatcaccaccaacctcggtaccggctggttctcggtcctcgtgcagctcggcctatgcatcagcctcttcttcgcgatgccggtgtcgatgaacccggtctacgaggtcgccgagcgcctgatctgcggcaggcgctacgcctggtggctgcgctggatcctcgtcgtggtcgtcgggctcctggcgatgctcgtgcccaacttcgctgacttcatctcgctcgtcggcagcagcgtctgcgtcgtgctcttgttcgtgctgcccgccgccttccacatcaaggtcttcggcgctgagatcgggtggaccgggctcgtcggcgacgtgaccgtcatcgttatcgggattgcgctcgcggtgttcgggacatggacgtcccttgtacaaatcttcagttcttctaacgtgtaa

SEQ ID NO: 329 - protein, 429 aa, Sorghum bicolor
  misc_feature (1)..(429): Ceres ANNOT ID no.6026633
  misc_feature (1)..(429): Bit score of 1019.3 for HMM based on sequences of FIGURE 12.
  misc_feature (37)..(421): Pfam Name: Aa_trans Pfam Description: Transmembrane amino acid transporter protein
  misc_feature (1)..(429): Functional Homolog Of Ceres SEEDLINE ID no. ME04507 at SEQ ID NO: 300
MEFDKEASSSSSRLDAAPLLPQYGLHCGGAGAGAGGHLSSQPKTFANVFIAVVGTGVLGLPYTFSRTGWAAGTLLLLAVAALTFHCMMLLVATRRRIADEHTKIASFGDLGHGIYGAPGRHAVDAMLVLSQVSFCVGYVIFISNTMAHLYPIVADSPASPLLTAKALFIWAMLPFQLGLNSIKTLTLLAPLSIFADVVDLGAMGVVLSQDASIWLANKPPVFAFAGPAELLYGLGVAVYAFEAIGMVLPLEAEAADKRRFGATLALSMAFIAVMYVLFGAMGYLAFGSATRDIITTNLGTGWFSVLVQLGLCISLFFAMPVSMNPVYEVAERLICGRRYAWWLRWILVVVVGLLAMLVPNFADFISLVGSSVCVVLLFVLPAAFHIKVFGAEIGWTGLVGDVTVIVIGIALAVFGTWTSLVQIFSSSNV

SEQ ID NO: 330 - DNA, 1631 bp, Arabidopsis thaliana
  misc_feature (1)..(1631): Ceres SEEDLINE ID no.ME04587
  misc_feature (1)..(1631): Genomic Sequence
  misc_feature (1)..(1631): Expected Sequence
  misc_feature (1)..(1631): Encodes the peptide sequence at SEQ ID NO. 332
atggaagcaataatgaacgttgactttcaaaactgtttgatcttaatcctcctctgcctcctttccttcctctgttactctttcttcttcaagaaaccaaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcgtctccctcaatagcctatgagatctttaggacacaagacgtaaacgtttcctcgcgcgactttcctacgaacgaagggtctctcctcttcggatcctttggcttcggcaccgcaccgtacggagaatactggaagttcatgaagaagctcattgtcaccaagttcctcgggcctcaagcactcgagaggtcacaaaaagtccgtgcagaggagttattacttaaacctattagataaggcggtgaagaaggagagcgttgagattgctgaggaagctatgaagctggtcaacaataccgtttgccagatgattatggggaggagttgttcagaggaaaacggtgaagcagagagagtcagaggcttggtgaccaagacagatgccttgacgaagaagtttatcttggcaggcatcttgcggaaaccgcttcagaagattgggatctcactgttcaaaaaggagttaatggatgcttcctgcaagttcaacgaggtgttggagaagattcttgtagaatataaagagaaagttgaagagcatcatcaaggtactgacatgatggataagctcttagaagtttatggagacgaaaaagcagagtataagatcactagagaccatatcaagtccttgtttgtggtaaatattcatctcttatgagaaatttagcgaacaccattagtttgtcttgactaagaaacgtttgatactgcaggatcttttctttgcaggcactgacacctggacgcacgctatacaatggattatggccgagatcattaacaactcgtacattcttgagagattgagagaagaaattgattctgttgtaggaaaaacaaggttgattcaagaaactgatctaccgaacctcccgtgcttgcaagcaaccgtcaaagaagggctaaggttgcaccctccggttcctcttgtgttaagaacgtttaaagaagggtgtacgattggaggcttttatgttccggagaagacaacacttgttgttaatgggtatgctatgatgagagatcctgaatactgggaagatcctcaagaatttaagccagagagatttctagcttcttcaagatcaagccaaaatgatgagataagagacgaactcctaaaataccttcctttcgggaatggaagaagagcctgtccaggagctaacctagcttatatctctgtaggaaccgcgattggagtgatggttcagtgctttgactgggagatcaaaggagataagatcaacatggatgaggctcctggaaaaataacgttgaccatggctcatcctcttaactgcactcttgttcctcgaaccctaatccctgttacttcaactgtacagattcctagttcttga

SEQ ID NO: 331 - DNA, 1625 bp, Arabidopsis thaliana
  misc_feature (1)..(1625): Ceres SEEDLINE ID no.ME04587
  misc_feature (1)..(1625): Genomic Sequence
  misc_feature (1)..(1625): Inplanta Sequence
  misc_feature (1)..(1625): Encodes the peptide sequence at SEQ ID NO. 332
atgaacgttgactttcaaaactgtttgatcttaatcctcctctgcctcctttccttcctctgttactttttcttcttcaagaaaccaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcgtctccctcaatagcctatgagatctttaggacacaagacgtaaacgtttcctcgcgcgactttcctacgaacgaagggtctctcctcttcggatccttggcttcggcaccgcaccgtacggagaatactggaagttcatgtagaagctcattgtcaccaagttcctcgggcctcaagcactcgagaggtcacaaaaagtccgtgcagaggagttaaaacgattttacttaaacctattagataaggcggtgaagaaggagagcgttgagattgctgaggaagctatgaagctggtcaacaataccgtttgccagatgattatggggaggagttgttcagaggaaaacggtgaagcagagagagtcagaggcttggtgaccaagacagatgccttgacgaagaagtttatcttggcaggcatcttgcggaaaccgcttcagaagattgggatctcactgttcaaaaaggagttaatggatgcttcctgcaagttcaacgaggtgttggagaagattcttgtagaatataaagagaaagttgaagagcatcatcaaggtactgacatgatggataagctcttagaagtttatggagacgaaaaagcagagtataagatcactagagaccatatcaagtccttgtttgtggtaaatattcatctcttatgagaactttagcgaacaccattagtttgtctttactaagaaacgtttgatactgcaggatcttttctttgcaggcactgacacctcgacgcacgctatacaatggattatggccgagatcattaacaactcgtacattcttgagagattgagagaagaaattgattctgttgtaggaaaaacaaggttgattcaagaaactgatctaccgaacctcccgtgcttgcaagcaaccgtcaaagaagggctaaggttgcaccctccggttcctattgtgttaagaacgtttaaagaagggtgtacgattggaggcttttatgttccggagaagacaacacttgttgttcatgggtatgctatgatgagagatcctgaatactgggaagatcctcaagaatttaagccagagagatttctagcttcttcaagatcaagccaaaatgatgagataagagacgaactcctaaaataccttcctttcgggaatggaagaagagcctgtccaggagctaacctagcttatatctctgtaggaaccgcgattggagtgatggttcagtgctttgactgggagatcaaaggagataagatcaacatggatgaggctcctggaaaaataacgttgaccatggctcatcctcttaactgcactcttgttcctcgaaccctaatccctgttacttcaactgtacagattcctagttcttga

SEQ ID NO: 332 - protein, 337 aa, Arabidopsis thaliana
  misc_feature (1)..(337): Ceres SEEDLINE ID no.ME04587
  misc_feature (1)..(337): Bit score of 482.7 for HMM based on sequences of FIGURE 13.
  misc_feature (6)..(321): Pfam Name: p450 Pfam Description: Cytochrome P450
MKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTSTHAIQWIMAEIINNSYILERLREEIDSVVGKTRLIQETDLPNLPCLQATVKEGLRLHPPVPIVLRTFKEGCTIGGFYVPEKTTLVVHGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 333 - DNA, 1536 bp, Populus balsamifera subsp. trichocarpa
  misc_feature (1)..(1536): Ceres ANNOT ID no.1474882
  misc_feature (1)..(1536): Encodes the peptide sequence at SEQ ID NO 334
atggctgatatccaaggctatatcatacttttcctattatggctactctccaccattttggtcagagcaatactaaacaagactcgagccaaacctcgccttccaccgagcccattggccttaccaatcattggacacctccatctccttgccccaataccccaccaagctcttcataagctctcaacccggtatggaccattgattcatttattccttggttctgtcccttgtgttgttgcttctacacctgagactgcaaaggagttcctcaaaactcatgaaaattctttctgcgatcgtcctaagtcaaccgcagtcgattttctaacatatggatcagctgatttctcatttgccccttatggaccttactggaaattcatgaagaaaatttgtatgactgaacttcttggaggtcgaatgttagaccagcttcttccagttaagcatgaagagattaggcagtttttacagttcttgctaaagaaagcaaatgcaagagagtcaattgatgttggaagtcaacttataaggctaactaataatgttatatcgagaatggcaatgagccaaaggtgttcagataatgatgatgaagcagatgaggtcaggaatttggtgcatgaggtagctgatcttacagggaagtttaatttgtcagattttatttggttttgcaagaacttggatttgcagggatttggaaaaaggctgaaggaagtccgcaaaaggttcgacacgatgacggaaaggatcataatggagcatgaagaggcgaggaagaaaaagaaagaaactggtgaaggtgaccccgtgaaggatctacttgatattttacttgatatatcagaagatgatagctcagaaatgaaattgaccagagaaaatatcaaggcgttcatactggacatattcgcggcggggacagacacctctgctgttaccatggaatgggcactagcagagctcatcaataacccaaacatcttggagagagcaagagaagagatagattctgttgtaggacaaagcagactagtacaagaatcagacatcgctaacctgccctacgttcaagctatactaaaggaaacactgaggcttcaccccactggtccaataattctgagggaatcaagtgaaagctgcaccatcaatggctatgaaattccagcaagaaccaggctattcgttaacgtgtgggctattaatagagatccaaactactgggagaacccacttgagttcgaaccggaaaggtttctttgcgcaggagaaaatggaaagagtcagctggatgtgaggggtcagcattttcactttcttccatttgggagtggaagaagagggtgccctggaactacactggcacttcaaatggttcaaacaggccttgctgctatgattcaatgctttgattggaaagttaatggcactgttgacatgcaagaaggaactggtataacacttccaagggcccatcccttaatttgtgtcccagtggcaaggctcaatccatttccatcgttctga

SEQ ID NO: 334 - protein, 511 aa, Populus balsamifera subsp. trichocarpa
  misc_feature (1)..(511): Ceres ANNOT ID no.1474882
  misc_feature (1)..(511): Bit score of 1281.5 for HMM based on sequences of FIGURE 13.
  misc_feature (35)..(500): Pfam Name: p450 Pfam Description: Cytochrome P450
  misc_feature (1)..(511): Functional Homolog Of Ceres SEEDLINE ID no. ME04587 at SEQ ID NO: 332
MADIQGYIILFLLWLLSTILVRAILNKTRAKPRLPPSPLALPIIGHLHLLAPIPHQALHKLSTRYGPLIHLFLGSVPCVVASTPETAKEFLKTHENSFCDRPKSTAVDFLTYGSADFSFAPYGPYWKFMKKICMTELLGGRMLDQLLPVKHEEIRQFLQFLLKKANARESIDVGSQLIRLTNNVISRMAMSQRCSDNDDEADEVRNLVHEVADLTGKFNLSDFIWFCKNLDLQGFGKRLKEVRKRFDTMTERIIMEHEEARKKKKETGEGDPVKDLLDILLDISEDDSSEMKLTRENIKAFILDIFAAGTDTSAVTMEWALAELINNPNILERAREEIDSVVGQSRLVQESDIANLPYVQAILKETLRLHPTGPIILRESSESCTINGYEIPARTRLFVNVWAINRDPNYWENPLEFEPERFLCAGENGKSQLDVRGQHFHFLPFGSGRRGCPGTTLALQMVQTGLAAMIQCFDWKVNGTVDMQEGTGITLPRAHPLICVPVARLNPFPSF

SEQ ID NO: 335 - protein, 498 aa, Arabidopsis thaliana
  misc_feature (1)..(498): Public GI ID no.15225834
  misc_feature (1)..(498): Bit score of 806.6 for HMM based on sequences of FIGURE 13.
  misc_feature (36)..(482): Pfam Name: p450 Pfam Description: Cytochrome P450
  misc_feature (1)..(498): Functional Homolog Of Ceres SEEDLINE ID no. ME04587 at SEQ ID NO: 332
MNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPSSGLKHSRGHKKSVQRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 336 - protein, 514 aa, Arabidopsis thaliana
  misc_feature (1)..(514): Public GI ID no.15225832
  misc_feature (1)..(514): Bit score of 808.5 for HMM based on sequences of FIGURE 13.
  misc_feature (40)..(503): Pfam Name: p450 Pfam Description: Cytochrome P450
  misc_feature (1)..(514): Functional Homolog Of Ceres SEEDLINE ID no. ME04587 at SEQ ID NO: 332
MGEIMNVDFVNCLILILLCLLSILCYSFFFKKPKDGFNLPPSPPSLPIIGHLHHLLSLFMHRSLQKLSSKYGPLLYLHVFNVPILLVSSPSIAYEIFRAQDVNVSTRDFPTNEGSLFLGSFSFITAPYGEYWKFMKKLIVTKLLGPQALERSQRIRANEVERFYSNLLDKAMKKESVEIADEAMKLVNNIICKMIMGRTCSEENGEAERIRGLVTKSDALLKKFLLAAILRKPLKKIGITLFKKVFMDISLKFDEVLEKILVENEERLEENQQGTDIMDKLLEVYGDKTSEYKITRDHIKSLFVDLFFAGTDTATHTIEWTMAEIMNNSLILERLREEIDSVVGKTRLIQETDLPNLLYLQATVKEGLRLHPTIPLVLRTFQDGCTIGGFSIPKKTKLVVNGYAIMRDPDNWEDPLEFKPERFLASSRSSQKDAIKEEVLKYLSFGSGRRGCPGVNLAYVSVETAIGVMVQCFDWKIDGHKINMNEVAGKGTLSMAHPLKCTLVPRSVTPLTSK

SEQ ID NO: 337 - DNA, 1551 bp, Arabidopsis thaliana
  misc_feature (1)..(1551): Ceres ANNOT ID no.553243
  misc_feature (1)..(1551): Encodes the peptide sequence at SEQ ID NO 338
atggaagcaataatgaacgttgactttcaaaactgtttgatcttaatcctcctctgcctcctttccttcctctgttactctttcttcttcaagaaaccaaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcgtctccctcaatagcctatgagatctttaggacacaagacgtaaacgtttcctcgcgcgactttcctacgaacgaagggtctctcctcttcggatcctttggcttcggcaccgcaccgtacggagaatactggaagttcatgaagaagctcattgtcaccaagttcctcgggcctcaagcactcgagaggtcacaaaaagtccgtaggagttattacttaaacctattagataaggcggtgaagaaggagagcgttgagattgctgaggaagctatgaagctggtcaacaataccgtttgccagatgattatggggaggagttgttcagaggaaaacggtgaagcagagagagtcagaggcttggtgaccaagacagatgccttgacgaagaagtttatcttggcaggcatcttgcggaaaccgcttcagaagattgggatctcactgttcaaaaaggagttaatggatgcttcctgcaagttcaacgaggtgttggagaagattcttgtagaatataaagagaaagttgaagagcatcatcaaggtactgacatgatggataagctcttagaagtttatggagacgaaaaagcagagtataagatcactagagaccatatcaagtccttgtttgtggatcttttctttgcaggcactgacacctggacgcacgctatacaatggattatggccgagatcattaacaactcgtacattcttgagagattgagagaagaaattgattctgttgtaggaaaaacaaggttgattcaagaaactgatctaccgaacctcccgtgcttgcaagcaaccgtcaaagaagggctaaggttgcaccctccggttcctcttgtgttaagaacgtttaaagaagggtgtacgattggaggcttttatgttccggagaagacaacacttgttgttaatgggtatgctatgatgagagatcctgaatactgggaagatcctcaagaatttaagccagagagatttctagcttcttcaagatcaagccaaaatgatgagataagagacgaactcctaaaataccttcctttcgggaatggaagaagagcctgtccaggagctaacctagcttatatctctgtaggaaccgcgattggagtgatggttcagtgctttgactgggagatcaaaggagataagatcaacatggatgaggctcctggaaaaataacgttgaccatggctcatcctcttaactgcactcttgttcctcgaaccctaatccctgttacttcaactgtacagattcctagttcttga

SEQ ID NO: 338 - protein, 516 aa, Arabidopsis thaliana
  misc_feature (1)..(516): Ceres ANNOT ID no.553243
  misc_feature (1)..(516): Bit score of 899.4 for HMM based on sequences of FIGURE 13.
  misc_feature (40)..(500): Pfam Name: p450 Pfam Description: Cytochrome P450
  misc_feature (1)..(516): Functional Homolog Of Ceres SEEDLINE ID no. ME04587 at SEQ ID NO: 332
MEAIMNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPYGEYWKFMKKLIVTKFLGPQALERSQKVRRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 339 - protein, 525 aa, Cicer arietinum
  misc_feature (1)..(525): Public GI ID no.5514645
  misc_feature (1)..(525): Bit score of 1212.8 for HMM based on sequences of FIGURE 13.
  misc_feature (36)..(477): Pfam Name: p450 Pfam Description: Cytochrome P450
  misc_feature (1)..(525): Functional Homolog Of Ceres SEEDLINE ID no. ME04587 at SEQ ID NO: 332
MRLVEIAVTLVLIALFIHFRPTPTAKSKALRHLPNPPSPKPRLPFVGHLHLLDHPLLHQSLIRLGERYGPLYSLYFGSMPTIVASTPDLFKLFLQTHEAVSFNTRFQTSAIRRLTYDNSVAMVPFAPYWKFIRKLIMNDLLNATTVNKLRPLRSQEIRKVLNVMAKSAQTQEPLNVTEELLKWTNSTISRMMLGEAEEIRDIARDVLKIFGEYSLTDFIWPLKKLKVGKYEKKIEEIFNRFDPVIEKVIKKRQDVRRRRKERNGELEEGEQSVVFLDTLLDFAEDETMEIKITKEQIKGLVVDFFSAGTDSTAVATDWCLSELINNPRVMKKAREEVDSVVGKDRLVDESDIQNLPYIRAVVKETFRMHPPLPVVKRKCTEECEINGYVIPEGALVLFNVWAVGRDPKYWDRPLEFRPERFLENAGEGDAGSIDLRGQHFQLLPFGSGRRMCPGVNLATAGMATLLSSVLQCFELQVAGPNGQILKGADAKVSMDERPGLTVPRAHNLVCVPLARPGAAAKLLSS

SEQ ID NO: 340 - DNA, 1630 bp, Glycine max
  misc_feature (1)..(1630): Ceres CLONE ID no.464376
  misc_feature (1)..(1630): Encodes the peptide sequence at SEQ ID NO 341
  misc_feature (106)..(106): r is g or a
atgatgagcagatagcatgattgagatgatagtgttcctcttccttgtcttgcttatatcccttatcttgagcagcagttccaataatagcctccagcttcccccragcccaccaagcattcctctgctaggtcacctccaccacctcaccccttccctatacaaatccctctacaccctctcatccaagcacggtcccctcctcctcctccgcctcggcccctcccgccgcctcctcctccttgtctcctccgccgccgtcgctaccgatgtcttcaagacccacgacctcgccttctcgtcgcgccccgccttcgccttcgccgagaggctccccttcggcacctccggcttcgtcaccgccccctatgggccctactggcgcttcatgaagaaactctgcgtcacggagcttctctccacgcgccaacttgagcgctccaggagcataaggagggaagagatactacgttccatcaaaagggttattgacaatgctcgtgagactgttgcacttgatttgggctccgagttcaccaaattcaccaacaatgtcacttgcaggacggccatgagcaccagttgtgcggaaaaatgcgaggatgctgagaggatcaggaagctagtaaaggagtcctttgagctagctgcgaaattgtgctttggtgatgtgttgggccctttcaaggagttgagtttttgggtgtatgggaaaaaggccatagacatgagcacaaggtacgatgagttgttggaagaggtgctcaaggagcatgaacacaaaagattatcgcgtgcaaatggtgatcaaagtgaaagggatttgatggatattctgttagatgtttatcatgatgctcatgcagagttcaagatcacaatggctcatattaaagccttctttatggatctcttcattgcaggcacacacacctcagcagaagcaacacagtgggcaatggccgagctcctcaaccaccctgaagcatttcaaaaggtgagaaaggagatagagttagtcactggcaatgttaggcttgttgatgaatccgatatcacaaacttgccatatttgcaagcagttgtgaaggaaacactaagactctacccgccggcaccaatcacgacaagagagtgtcgccaacactgcaaaataaacagcttcgatgtgccaccaaagacagcagtggcaatcaatttgtatgccataatgagagaccctgattcttgggacaatcctaatgagttttgccctgaaaggttcttgcaagaacaagatcatgaggatttgagtgatgatggtaagagaatgaagttcaattttgttccatttggaggtgggaggagaggttgtccagggacagcactggcattcagcttgatgaacactgcagttgctgctatggtgcagtgctttgattggaaaattggtaaagatggaaaaggagaaaaggttgatatggaatctgggtctggtatgtctttgagcatggttcacccccttatttgcgttcccgtagtacattttatcccatatgatatataatataattcaatataatgaagactcaccaaggaagaacttatattatgatatgatgggtaatatataatataacccttatcttcg

SEQ ID NO: 341 - protein, 509 aa, Glycine max
  misc_feature (1)..(509): Ceres CLONE ID no.464376
  misc_feature (1)..(509): Bit score of 1059.7 for HMM based on sequences of FIGURE 13.
  misc_feature (29)..(499): Pfam Name: p450 Pfam Description: Cytochrome P450
  misc_feature (1)..(509): Functional Homolog Of Ceres SEEDLINE ID no. ME04587 at SEQ ID NO: 332
  misc_feature (30)..(30): Xaa is any aa, unknown or other
MIEMIVFLFLVLLISLILSSSSNNSLQLPXSPPSIPLLGHLHHLTPSLYKSLYTLSSKHGPLLLLRLGPSRRLLLLVSSAAVATDVFKTHDLAFSSRPAFAFAERLPFGTSGFVTAPYGPYWRFMKKLCVTELLSTRQLERSRSIRREEILRSIKRVIDNARETVALDLGSEFTKFTNNVTCRTAMSTSCAEKCEDAERIRKLVKESFELAAKLCFGDVLGPFKELSFWVYGKKAIDMSTRYDELLEEVLKEHEHKRLSRANGDQSERDLMDILLDVYHDAHAEFKITMAHIKAFFMDLFIAGTHTSAEATQWAMAELLNHPEAFQKVRKEIELVTGNVRLVDESDITNLPYLQAVVKETLRLYPPAPITTRECRQHCKINSFDVPPKTAVAINLYAIMRDPDSWDNPNEFCPERFLQEQDHEDLSDDGKRMKFNFVPFGGGRRGCPGTALAFSLMNTAVAAMVQCFDWKIGKDGKGEKVDMESGSGMSLSMVHPLICVPVVHFIPYDI

SEQ ID NO: 342 - protein, 511 aa, Medicago truncatula
  misc_feature (1)..(511): Public GI ID no.92899315
  misc_feature (1)..(511): Bit score of 1280.4 for HMM based on sequences of FIGURE 13.
  misc_feature (35)..(500): Pfam Name: p450 Pfam Description: Cytochrome P450
  misc_feature (1)..(511): Functional Homolog Of Ceres SEEDLINE ID no. ME04587 at SEQ ID NO: 332
MVDYQGYILLFIIWLVSTIFVKAILTRKYKKSKLPPSPLSLPIIGHLHLIGSIPHQGLHKLSTKYGPIIHLFLGSMPCVVASTPESAKEFLKTHETYFSNRPQSSAVDYLTYGSQDFSFAPYGPYWKFIKKICMSELLGGNTLSQLLPLRRQETTRFVSFLLKKGKENEVIDVGRELLKLSNNVISRMIMSQTCSENDGEAEEVRKLVQDTVHLTGKFNISDFIWFFKNWDVQGFSKGLEEIRDRFDSMMERIIKEHQEVRRRRKEVGGGEGQIKDLLDILLDILEDESSEIKLKMENIKAFILDIFIAGTDTSALTIEWALAELINNPHMMEIARQEINDVVGNNRIVEESDIINLPYLQAIVKETLRIHPTGPLIVRESSEKCTIQGYEIPAKTQLFVNIWSIGRDPNYWDNPLEFRPERFINEVGNLDVRGQHFHLIPFGSGRRACPGTSLALHVVQTNLAAMIQCFEWKVKGGNGIVNMEEKPGLTLSRAHPLICVPVPRFNHFPSM

SEQ ID NO: 343 - protein, 521 aa, Pisum sativum
  misc_feature (1)..(521): Public GI ID no.6979548
  misc_feature (1)..(521): Bit score of 1212.7 for HMM based on sequences of FIGURE 13.
  misc_feature (35)..(499): Pfam Name: p450 Pfam Description: Cytochrome P450
  misc_feature (1)..(521): Functional Homolog Of Ceres SEEDLINE ID no. ME04587 at SEQ ID NO: 332
MLLELALGLFVLALFLHLRPTPSAKSKALRHLPNPPSPKPRLPFIGHLHLLKDKLLHYALIDLSKKHGPLFSLSFGSMPTVVASTPELFKLFLQAHEATSFSTRFQTSAVRRLTYDNSVAMVPFGPYWKFVRKLIMNDLLNATTVNELRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGKDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIGVASKLLS

SEQ ID NO: 344 - protein, 524 aa, Pisum sativum
  misc_feature (1)..(524): Public GI ID no.53988152
  misc_feature (1)..(524): Bit score of 1154.4 for HMM based on sequences of FIGURE 13.
  misc_feature (35)..(501): Pfam Name: p450 Pfam Description: Cytochrome P450
  misc_feature (1)..(524): Functional Homolog Of Ceres SEEDLINE ID no. ME04587 at SEQ ID NO: 332
MLVELALALMVIALFIHLRPTPTAKSKALRHLPNPPCPKPRLPFIGHLHLLDNPLLHHSLIRLGERYGPLYSLYFGSMPTIVVSTPDLFKLFLQTHEASSFNTRFQTSAIRRLTYDNSVAMDPFGPYWKFIRKLIMNDLFNASTINKLRPLRTREIRRVLKVMAQSAETQEPLNVTEELLKWTNNTISTMMLGEAEEVRDIARDVLKIFGEYSLTDFIWPLKMFKFGNYEKRTEAIFNKYDPIIEKVIKKRQEIVNKRKEKNGEIQESEQSVVFLDTLLEFAQDETMEIKITKEQIKGLVVDFFSAGTDSTAVATEWTLAELINNPRVLKKAREEIDSVIGKDRLVDESDVQNLPYIRAMVKEVFRMHPPLPVVKRKCTEECEINGYVIPEGALVLFNVWAVGRDPKYWKRPLEFRPERFLENAGEGEAGSVDLRGQHFQLLPFGSGRRMCPGVNLATAGMATLLASIIQCFDLQVPGPDGKILKGDDAKVSMKERAGLSVPRAQNLVCVPLARDGLAAKLLSS

SEQ ID NO: 345 - protein, 521 aa, Pueraria lobata
  misc_feature (1)..(521): Public GI ID no.20147512
  misc_feature (1)..(521): Bit score of 1222.5 for HMM based on sequences of FIGURE 13.
  misc_feature (35)..(499): Pfam Name: p450 Pfam Description: Cytochrome P450
  misc_feature (1)..(521): Functional Homolog Of Ceres SEEDLINE ID no. ME04587 at SEQ ID NO: 332
MLLELALGLLVLALFLHLRPTPTAKSKALRHLPNPPSPKPRLPFIGHLHLLKDQLLHHALIDLSKKYGPLYSLYFGSMPTVVASTPELFKLFLQTHEATSFNTRFQTSAIRRLTYDNSVAMVPFGPYWKFIRKLIMNDLLNATTVNKLRPLRTEQIRKFLRVMAQSAEAQQPLNVTEELLKWTNSTISMMMLGEAEEIRDIAREVLKIFGEYSVTNFIWPLMYLKVGKYEKRIDDIFNKFDPVIERVIKKRREIVRRRKNGEVVEGEASGVFLDTLLEFAEDETMEIKITKEQIKGLVVDFFSAGTDSTAVATEWALAELINNPRVLQKARDEVYSVVGKDRLVDEVDTQNLPYIRAIVKETFRMHPPLPVVKRKCVEECEVNGFVIPEGALILFNVWAVGRDPKYWDRPLEFRPERFLESGAEGEVGPIDLRGQHFQLLPFGSGRRMCPGVNLATSGMATLLASLIQCFDLQVVGPKGEILKGNDAKVSMEESAGLTVPRAHNLRCVPLARTSVAAKLLS

SEQ ID NO: 346 - protein, 508 aa, Petunia x hybrida
  misc_feature (1)..(508): Public GI ID no.1345643
  misc_feature (1)..(508): Bit score of 1045.9 for HMM based on sequences of FIGURE 13.
  misc_feature (34)..(495): Pfam Name: p450 Pfam Description: Cytochrome P450
  misc_feature (1)..(508): Functional Homolog Of Ceres SEEDLINE ID no. ME04587 at SEQ ID NO: 332
MVLLSELAAATLIFLTTHIFISTLLSITNGRRLPPGPRGWPVIGALPLLGAMPHVSLAKMAKKYGAIMYLKVGTCGMVVASTPDAAKAFLKTLDLNFSNRPPNAGATHLAYGAQDMVFAHYGPRWKLLRKLSNLHMLGGKALENWANVRANELGHMLKSMFDMSREGERVVVAEMLTFAMANMIGQVILSKRVFVNKGVEVNEFKDMVVELMTTAGYFNIGDFIPCLAWMDLQGIEKGMKRLHKKFDALLTKMFDEHKATSYERKGKPDFLDCVMENRDNSEGERLSTTNIKALLLNLFTAGTDTSSSAIEWALAEMMKNPAILKKAQGEMDQVIGNNRRLLESDIPNLPYLRAICKETFRKHPSTPLNLPRISNEPCIVDGYYIPKNTRLSVNIWAIGRDPEVWENPLEFYPERFLSGRNSKIDPRGNDFELIPFGAGRRICAGTRMGIVMVEYILGTLVHSFDWKLPSEVIELNMEEAFGLALQKAVPLEAMVTPRLPIDVYAPLA

SEQ ID NO: 347 - protein, 506 aa, Antirrhinum majus
  misc_feature (1)..(506): Public GI ID no.5832707
  misc_feature (1)..(506): Bit score of 1260.9 for HMM based on sequences of FIGURE 13.
  misc_feature (29)..(493): Pfam Name: p450 Pfam Description: Cytochrome P450
  misc_feature (1)..(506): Functional Homolog Of Ceres SEEDLINE ID no. ME04587 at SEQ ID NO: 332
MSTLVYSTLFILSTLLLTLLTRTRRKTRPPGPLALPLIGHLHLLGPKLHHTFHQFSQRYGPLIQLYLGSVPCVVASTPELAREFLKTHELDFSSRKHSTAIDIVTYDSSFAFAPYGPYWKFIKKLCTYELLGARNLSHFQPIRALEVNSFLRILYEKTEQKQSVNVTEELVKLTSNVISNMMLGIRCSGTEGEAEVARTVIREVTQIFGEFDVSEIVWFCKNLDLQGIRKRSEDIRRRYDALLEKIISDRERLRLRGGGGGGGGEVKDFLDMLLDVMESEKSEVEFTREHLKALILDFFTAGTDTTAITTEWAIAELISNPNVLKKAQEEMDKVIGSQRLLQESDAPNLPYLNAIIKETFRLHPPIPMLTRKSISDVVVNGYTIPAKTLLFVNLWSMGRNPNYWENPMEFRPERFLEKGTGSIDVKGQHFELLPFGTGRRGCPGMLLGMQELFSIIGAMVQCFDWKLPDGVKSVDMTERPGLTAPRANDLVCQLVPRIDPVVVSGP

SEQ ID NO: 348 - protein, 506 aa, Sesamum indicum
  misc_feature (1)..(506): Public GI ID no.81157968
  misc_feature (1)..(506): Bit score of 963.1 for HMM based on sequences of FIGURE 13.
  misc_feature (36)..(489): Pfam Name: p450 Pfam Description: Cytochrome P450
  misc_feature (1)..(506): Functional Homolog Of Ceres SEEDLINE ID no. ME04587 at SEQ ID NO: 332
MEAEMLYSALALTFAIFMVYRILSNSQDKRSLTKLPPSPPGWLPVIGHAHLMKNLLHRTLYDFSQKLGPIFSIRFGSRLVVVVSSSSLVEECFTKYDIVLANRPQASVDRRSLGFSTTSVIGAPYGDHWRNLRKLCDLEVFAPTRLASFLSIRLDERDRMISALYKISSAGFAKVNLEAKIVELTFNNIMRMVAAKRYYGEEAEDDEEAKRFRDLTKEALELTSASNPGEIFPILRWLGCNGLEKKLAVHSRKTDEFMQGLLDEHRRGERQNTMVDHLLSLQESQPEYYTDEIITGLIVALIIAGTDASVVTTEWAMSLLLNHPKVLEKARKELDTLVGHERMVDEHDLPKLRYLHCIVLETLRLFPSVPTLVPHEPSEDCKIGGYNVPKGTMVLVNAWAIHRDPKVWDDPLSFKPDRFEIMEVETHKLLPFGMGRRACPGAGLAQKFVGLALGSLIQCFDWERTSPEKIDLNEGSGITLPKAKTLEAMCKPRHVMEKVLRQVSNV

SEQ ID NO: 349 - protein, 514 aa, Callistephus chinensis
  misc_feature (1)..(514): Public GI ID no.6118407
  misc_feature (1)..(514): Bit score of 1264.3 for HMM based on sequences of FIGURE 13.
  misc_feature (39)..(499): Pfam Name: p450 Pfam Description: Cytochrome P450
  misc_feature (1)..(514): Functional Homolog Of Ceres SEEDLINE ID no. ME04587 at SEQ ID NO: 332
MNIFEVFQSVSPAIIAIFFISSLFIYLVLIRNQKSLSLPPSPPALPIIGHLHHLGPLIHHSFHDLSTRYGPLIHLRLGSVPCVVASTPDLARDFLKTNELAFSSRKHSLAIDHVTYGVSFAFAPYGPYWKFIKKTSIVELLGNQNLSNFLPIRTQEVHELLQTLMVKSKKNESVNLSEELLKLTNNVICQMMMSIRCSGTNNEADEAKNLVREVTKIFGEFNISDFICLFKNIDLQGFKKRYVDTHTRYNALLEKMIFEREEKRKQKKSEDGKGKDFLDILLDVLEDENAEIKITRDHIKALILDFFTAATDTTAISIEWTLVELTNNPKVLENARKEIAEVVGDERLVQESDIPNLPYIQAIIKETLRMHPPIPMVIRKSIDNVTVQGYDIRAGTMLFVNIWSIGRNPLYWESPLEFKPHRFLDGHARNLDVKGQCFQLLPFGTGRRGCPGISLAMRELPVVIAGLIQCFEWNANDKEVLSMDERAGLTAPRAVDLEFVPLMRQNCPNIFVSA

SEQ ID NO: 350 - protein, 511 aa, Lobelia erinus
  misc_feature (1)..(511): Public GI ID no.133874240
  misc_feature (1)..(511): Bit score of 1304.0 for HMM based on sequences of FIGURE 13.
  misc_feature (29)..(498): Pfam Name: p450 Pfam Description: Cytochrome P450
  misc_feature (1)..(511): Functional Homolog Of Ceres SEEDLINE ID no. ME04587 at SEQ ID NO: 332
VAIPTIFLFFTSLFFLQRTKSKTNHLPLPPSPWALPIIGHLHHLGPLIHHSFHDLSSRYGPLIHLRLGSVPCVVASTPELARDFLKTNELTFSSRKHSAAIKRLSYDVAFAFAPYGPYWKFIKKMSTFELLGVRNLSHFLPIRTREIHGLIHLLMKKSKGKERVNVTEELVRLTNNVISQMMMSIRCSGTDGEADEAKNLVREVTQIFGQFNLSDFVWFCRNVDLQGIKKRYEDTHRRYDALLEKIISEREEKRRGKMGGGKIGEGEGEGKDFLDMLLDVLEDKKAEVKITRDHIKALILDFFTAATDTTAISIEWALAELMNNPKVLAKAQEEIDRVIGNKRLAQETDYPNLPYIQAIIKENFRLHPPIPMLIRKSIDDCTVQGYSIPSHTLLFVNIWSIGRNPNYWESPLEFKPERFLEKNSPVSSIDIKGHDFQLLPFGTGRRGCPGVALAMRELPTALAALIQCFEWKAEGGEALDMSERAGLTAPRAHDLVCVPVARINSPDIFDC

SEQ ID NO: 351 - protein, 511 aa, Gerbera hybrida
  misc_feature (1)..(511): Public GI ID no.5081817
  misc_feature (1)..(511): Bit score of 1280.2 for HMM based on sequences of FIGURE 13.
  misc_feature (34)..(497): Pfam Name: p450 Pfam Description: Cytochrome P450
  misc_feature (1)..(511): Functional Homolog Of Ceres SEEDLINE ID no. ME04587 at SEQ ID NO: 332
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 352 - protein, 518 aa, Lotus japonicus
  misc_feature (1)..(518): Public GI ID no.7415992
  misc_feature (1)..(518): Bit score of 1192.2 for HMM based on sequences of FIGURE 13.
  misc_feature (35)..(470): Pfam Name: p450 Pfam Description: Cytochrome P450
  misc_feature (1)..(518): Functional Homolog Of Ceres SEEDLINE ID no. ME04587 at SEQ ID NO: 332
MLVEIALALLALALFLQFRPTPTAKSKALRHLPNPPSPKPRLPFVGHLHLLDQPLLHNSLIKLGEKYGPLYTLYFGSMPTVVASTPELFKLFLQTHEATSFSTRFQTSAIRRLTYDNSVAMVPFAPYWKFIRKVIMNDLLNATTVNKLRPLRSQEIRKVLKAMAQSAESQKPLNVTEELLKWTNSTISRMMLGEAEHVKDIVREVLKIFGEYSLTDFIWPLKKLRVGQYEKRIDEIFNKFDPVIEKVIKKRQEIIKRRKERNGELEEGEQSVVFLDTLLEYAADENMEIKITKEQIKGLVVDFFSAGTDSTAVATDWALAELINNPRVLKKAREEVDSVVGKDRLVDESDIQNLPYIRAIVKETFRMHPPLPVVKRKCVQECELNGYVIPEGALVLFNVWAVQRDPKYWKTPLEFRPERFLEEADIDLKGQHFELLPFGSGRRMCPGVNLATAGMATLLSSVIQCFELQVVGPKGQILKGSDAKANMEERAGLTVPRANSLMCVPLARSKVAAELLSS

SEQ ID NO: 353 - protein, 527 aa, Oryza sativa subsp. indica
  misc_feature (1)..(527): Public GI ID no.125556057
  misc_feature (1)..(527): Bit score of 1166.9 for HMM based on sequences of FIGURE 13.
  misc_feature (41)..(510): Pfam Name: p450 Pfam Description: Cytochrome P450
  misc_feature (1)..(527): Functional Homolog Of Ceres SEEDLINE ID no. ME04587 at SEQ ID NO: 332
MDHQLVARGLFKPLLLFVAGLIVLYALRRRRHRRSSDLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRACVHELLAGRTLDRLRHVRREEVARLVGSLRASADGGERVDVDAALMGLTGDIVSRMVMGRRWTGDDNDAEEMRSVVAETAELTGTFNLQDYIGVFKYWDVQGLGKRIDAVHRKFDAMMERILTPREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 354 - protein, 528 aa, Oryza sativa subsp. japonica
  misc_feature (1)..(528): Public GI ID no.115468946
  misc_feature (1)..(528): Bit score of 1163.9 for HMM based on sequences of FIGURE 13.
  misc_feature (42)..(511): Pfam Name: p450 Pfam Description: Cytochrome P450
  misc_feature (1)..(528): Functional Homolog Of Ceres SEEDLINE ID no. ME04587 at SEQ ID NO: 332
MDHQLVARGLFKPLLLFVAGLIVLYALRRRRRHRRSSGLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRACVHELLAGRTLDRLRHVRREEVARLVGSLRASADGGERVDVDAALMGLTGDIVSRMVMGRRWTGDDNDAEEMRSVVAETAELTGTFNLQDYIGVFKYWDVQGLGKRIDAVHRKFDAMMERILTAREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 355 - protein, 496 aa, Oryza sativa subsp. japonica
  misc_feature (1)..(496): Public GI ID no.125597853
  misc_feature (1)..(496): Bit score of 1052.3 for HMM based on sequences of FIGURE 13.
  misc_feature (42)..(479): Pfam Name: p450 Pfam Description: Cytochrome P450
  misc_feature (1)..(496): Functional Homolog Of Ceres SEEDLINE ID no. ME04587 at SEQ ID NO: 332
MDHQLVARGLFKPLLLFVAGLIVLYALRRRRRHRRSSGLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRAADGGERVDVDAALMGLTGDIVSRMVMGRRWTGDDNDAEEMRSVVAETAELTGTFNLQDYIGVFKYWDVQGLGKRIDAVHRKFDAMMERILTAREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 356 - protein, 523 aa, Glycyrrhiza echinata
  misc_feature (1)..(523): Public GI ID no.5915860
  misc_feature (1)..(523): Bit score of 1253.4 for HMM based on sequences of FIGURE 13.
  misc_feature (33)..(498): Pfam Name: p450 Pfam Description: Cytochrome P450
  misc_feature (1)..(523): Functional Homolog Of Ceres SEEDLINE ID no. ME04587 at SEQ ID NO: 332
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQGSGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFRPERFLKLEGDSSGVVDVRGSHFQLLPFGSGRRMCPGVSLAMQEVPALLGAIIQCFDFHVVGPKGEILKGDDIVINVDERPGLTAPRAHNLVCVPVDRTSGGGPLKIIEC

SEQ ID NO: 357 - protein, 523 aa, Glycyrrhiza echinata
  misc_feature (1)..(523): Public GI ID no.4200046
  misc_feature (1)..(523): Bit score of 1247.9 for HMM based on sequences of FIGURE 13.
  misc_feature (33)..(498): Pfam Name: p450 Pfam Description: Cytochrome P450
  misc_feature (1)..(523): Functional Homolog Of Ceres SEEDLINE ID no. ME04587 at SEQ ID NO: 332
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQESGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFCPERFLKLEGDSSGVVDVRGSHFQLLPFGSGRRMCPGVSLAMQEVPALLGAIIQCFDFQVVGPKGEILKGDDIVINVDERPGLTAPRAHNLVCVPVERRSGGGPLKIIEC

SEQ ID NO: 358 - protein, 521 aa, Trifolium pratense
  misc_feature (1)..(521): Public GI ID no.6979544
  misc_feature (1)..(521): Bit score of 1211.1 for HMM based on sequences of FIGURE 13.
  misc_feature (35)..(499): Pfam Name: p450 Pfam Description: Cytochrome P450
  misc_feature (1)..(521): Functional Homolog Of Ceres SEEDLINE ID no. ME04587 at SEQ ID NO: 332
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPIGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVDEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 359 - protein, 512 aa, Torenia hybrida
  misc_feature (1)..(512): Public GI ID no.5832709
  misc_feature (1)..(512): Bit score of 1256.9 for HMM based on sequences of FIGURE 13.
  misc_feature (31)..(499): Pfam Name: p450 Pfam Description: Cytochrome P450
  misc_feature (1)..(512): Functional Homolog Of Ceres SEEDLINE ID no. ME04587 at SEQ ID NO: 332
MDTVLITLYTALFVITTTFLLLLRRRGPPSPPGPLSLPIIGHLHLLGPRLHHTFHEFSLKYGPLIQLKLGSIPCVVASTPELAREFLKTNELAFSSRKHSTAIDIVTYDSSFAFSPYGPYWKYIKKLCTYELLGARNLGHFQPIRNLEVRSFLQLLMHKSFKGESVNVTDELVRLTSNVISHMMLSIRCSEDEGDAEAARTVIREVTQIFGEFDVTDIIWFCKKFDLQGIKKRSEDIQRRYDALLEKIISDRERSRRQNRDKHGGGNNEEAKDFLDMLLDVMESGDTEVKFTREHLKALILDFFTAGTDTTAIATEWAIAELINNPNVLKKAQEEISRIIGTKRIVQESDAPDLPYLQAIIKETFRLHPPIPMLSRKSTSDCTVNGYKIQAKSLLFVNIWSIGRNPNYWESPMEFRPERFLEKGRESIDVKGQHFELLPFGTGRRGCPGMLLAIQEVVSIIGTMVQCFDWKLADGSGNNVDMTERSGLTAPRAFDLVCRLYPRVDPATISGA

SEQ ID NO: 360 - protein, 521 aa, Vigna radiata
  misc_feature (1)..(521): Public GI ID no.6979542
  misc_feature (1)..(521): Bit score of 1214.8 for HMM based on sequences of FIGURE 13.
  misc_feature (35)..(499): Pfam Name: p450 Pfam Description: Cytochrome P450
  misc_feature (1)..(521): Functional Homolog Of Ceres SEEDLINE ID no. ME04587 at SEQ ID NO: 332
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAEATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 361 - protein, 429 aa, Oryza sativa subsp. indica
  misc_feature (1)..(429): Public GI ID no.125542223
  misc_feature (1)..(429): Bit score of 980.8 for HMM based on sequences of FIGURE 56.
  misc_feature (276)..(330): Pfam Name: bZIP_2 Pfam Description: Basic region leucine zipper
  misc_feature (1)..(429): Functional Homolog Of Ceres SEEDLINE ID no. ME20628 at SEQ ID NO: 1681
MNGGIGDALMQPQHVQVMSSSLPMVASTFVAEPAAAAAAANKPRAAGLPPTPPQVFAAQRAAAAAGGDVCMEESAQGGGGGLPPRKAHRRSSSDVPFGYLAGQHQLLPPKVEAGWGHLGAGAGGAAAADDLFNAYLNLDGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 362 - protein, 521 aa, Vigna radiata
  misc_feature (1)..(521): Public GI ID no.6979538
  misc_feature (1)..(521): Bit score of 1216.0 for HMM based on sequences of FIGURE 13.
  misc_feature (35)..(499): Pfam Name: p450 Pfam Description: Cytochrome P450
  misc_feature (1)..(521): Functional Homolog Of Ceres SEEDLINE ID no. ME04587 at SEQ ID NO: 332
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRAMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 363 - protein, 522 aa, Vigna radiata
  misc_feature (1)..(522): Public GI ID no.6979536
  misc_feature (1)..(522): Bit score of 1214.0 for HMM based on sequences of FIGURE 13.
  misc_feature (35)..(499): Pfam Name: p450 Pfam Description: Cytochrome P450
  misc_feature (1)..(522): Functional Homolog Of Ceres SEEDLINE ID no. ME04587 at SEQ ID NO: 332
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEAYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLSK

SEQ ID NO: 364 - protein, 506 aa, Perilla frutescens var. crispa
  misc_feature (1)..(506): Public GI ID no.14278923
  misc_feature (1)..(506): Bit score of 1244.7 for HMM based on sequences of FIGURE 13.
  misc_feature (29)..(493): Pfam Name: p450 Pfam Description: Cytochrome P450
  misc_feature (1)..(506): Functional Homolog Of Ceres SEEDLINE ID no. ME04587 at SEQ ID NO: 332
MALYAALFLLSAAVVRSVLDRKRGRPPYPPGPFPLPIIGHLHLLGPRLHQTFHDLSQRYGPLMQLRLGSIRCVIAASPELAKECLKTHELVFSSRKHSTAIDIVTYDSSFAFSPYGPYWKFIKKLCTYELLGARNLAHFQPIRTLEVKSFLQILMRKGESGESFNVTEELVKLTSNVISHMMLSIRCSETESEAEAARTVIREVTQIFGEFDVSDIIWLCKNFDFQGIRKRSEDIQRRYDALLEKIITDREKQRRTHGGGGGGGEAKDFLDMFLDIMESGKAEVKFTREHLKALILDFFTAGTDTTAIVCEWAIAEVINNPNVLKKAQEEIANIVGFDRILQESDAPNLPYLQALIKETFRLHPPIPMLARKSISDCVIDGYMIPANTLLFVNLWSMGRNPKIWDYPTAFQPERFLEKEKAAIDVKGQHFELLPFGTGRRGCPGMLLAIQEVVIIIGTMIQCFDWKLPDGSGHVDMAERPGLTAPRETDLFCRVVPRVDPLVVSTQ

SEQ ID NO: 365 - protein, 506 aa, Sesamum radiatum
  misc_feature (1)..(506): Public GI ID no.81157970
  misc_feature (1)..(506): Bit score of 960.9 for HMM based on sequences of FIGURE 13.
  misc_feature (36)..(489): Pfam Name: p450 Pfam Description: Cytochrome P450
  misc_feature (1)..(506): Functional Homolog Of Ceres SEEDLINE ID no. ME04587 at SEQ ID NO: 332
MEAEMLYSALALTFAIFMVYRILSNSQEKSSLIKLPPSPPGWLPVIGHVHLMKNLLHRTLYDFSQKLGPIFSLRFGTRLVVVVSSSSLVEECFTKYDIVLANRPQPSVDRRSLGFSTTSVIGAPYGDHWRNLRKLCDLEVFAPTRLASFLSIRLDERDRMISSLYKISSAGFAKVNLETKIVELTFNNIMRMVAGKRYYGEEAEDDEEAKRFRDLTKEALELTSASNPGEIFPILRWLGFNGLEKKLAVHARKTDEFMQGLLDEHRRGERQNTMVDHLLSLQESQPEYYTDEIITGLIVALIIAGTDASVVTTEWAMSLILNHPQVLEKARKELDTLVGHERMVDEHDLPKLRYLHCIVLETLRLFPSVPTLVPHEPSEDCKIGGYNVPKGTMILVNAWAIHRDPKVWDDPLSFKPDRFETMEVETHKLLPFGMGRRACPGAGLAQKFVGLALGSLIQCFEWERMSAEKIDLNEGSGITLPKAKTLEAMCKPRHIMERVLRQVSNV

SEQ ID NO: 366 - protein, 507 aa, Sesamum alatum
  misc_feature (1)..(507): Public GI ID no.81157972
  misc_feature (1)..(507): Bit score of 813.9 for HMM based on sequences of FIGURE 13.
  misc_feature (36)..(487): Pfam Name: p450 Pfam Description: Cytochrome P450
  misc_feature (1)..(507): Functional Homolog Of Ceres SEEDLINE ID no. ME04587 at SEQ ID NO: 332
MEAEMLYSALALTFAIIMVHRILSNSQNKRSLINLPPSPPGWLPIIGHLHLIKNPLHRTLYDCSQKLGSIFSVWFGSRLVVVVSSSSLVEECFTKYDIVLANRPDLHLDLRSLGASTISVIGAPYGDHWRNLRKLCDLEVFAPTRLASFLSIRRDERDRMISGLYKISSAGLAKVNLEAKIAELTFNNLMRMLAGKIYYGEEAEDEEEAKRFRDMTKEALELMNTFNLAEIFPILRWIGCNGFEKQLPVHSRKTDEIMQGLLDEHRRGERQNTMVGHLLSLQESQPDYYTDEIITGLIISLIIAGTDASVVTTEWAMSLLLNHPKVLEKARQEMDTLVGHERMVEEDDLPKLRYLHYIILETLRLFPSVPTLVPHEPSEDCNIGGYNVPKGTMIIVNAWAIHRDPKVWDDPMSFKPDRFETLEVETHKLLPFGMGRRGCPGAGLAKKFVGLALASLIQCFDWERISAEKIDLKEGASRITLPKATTLEAMCKPRHVMEKVLRQVSNV

SEQ ID NO: 367 - DNA, 679 bp, Arabidopsis thaliana
  misc_feature (1)..(679): Ceres SEEDLINE ID no.ME04753
  misc_feature (1)..(679): Ceres CLONE ID no.1011900
  misc_feature (1)..(679): Inplanta Sequence
  misc_feature (1)..(679): Encodes the peptide sequence at SEQ ID NO. 368
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctc

SEQ ID NO: 368 - protein, 148 aa, Arabidopsis thaliana
  misc_feature (1)..(148): Ceres SEEDLINE ID no.ME04753
  misc_feature (1)..(148): Ceres CLONE ID no.1011900
  misc_feature (1)..(148): Bit score of 279.3 for HMM based on sequences of FIGURE 14.
  misc_feature (10)..(81): Pfam Name: RRM_1 Pfam Description: RNA recognition motif (RRM, RBD, or RNP domain)
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYGGGEGGGYGGSGGGGGW

SEQ ID NO: 369 - protein, 162 aa, Physcomitrella patens
  misc_feature (1)..(162): Public GI ID no.21388658
  misc_feature (1)..(162): Bit score of 265.3 for HMM based on sequences of FIGURE 14.
  misc_feature (9)..(80): Pfam Name: RRM_1 Pfam Description: RNA recognition motif (RRM, RBD, or RNP domain)
  misc_feature (1)..(162): Functional Homolog Of Ceres SEEDLINE ID no. ME04753 at SEQ ID NO: 368
MAGGEEFRCFVGGLAWATTDGRLEGAFRPFGEVVQSKVISDRETGRSRGFGFVTFADENSMNAAIKEMNGQELDGRNITVNQAQSRGGGGGGGGGGGGYGRREQGGGGYGGGYGGSRGGGDREGSGYGGSRGGGYGGGGGGGYGGRGGPSSGNWRNDRQPEY

SEQ ID NO: 370 - protein, 178 aa, Physcomitrella patens
  misc_feature (1)..(178): Public GI ID no.21388660
  misc_feature (1)..(178): Bit score of 259.4 for HMM based on sequences of FIGURE 14.
  misc_feature (7)..(78): Pfam Name: RRM_1 Pfam Description: RNA recognition motif (RRM, RBD, or RNP domain)
  misc_feature (1)..(178): Functional Homolog Of Ceres SEEDLINE ID no. ME04753 at SEQ ID NO: 368
MGEEFRCFVGGLAWATTDGSLEEAFRPFGEVVQCKVITDRETGRSRGFGFVTFADENSMNEAIKDMNGKELDGRNITVNQAQSRGGGSGGGGGGGYNNRQGGGGGYGGGGYGGGGGGGYGAGGGGAYGSRSSYDREGGGGGGYGGSRGGGGYGSGGGGGGGRGGSGSGNWRGGRENAY

SEQ ID NO: 371 - protein, 155 aa, Picea glauca
  misc_feature (1)..(155): Public GI ID no.4704605
  misc_feature (1)..(155): Bit score of 292.4 for HMM based on sequences of FIGURE 14.
  misc_feature (10)..(81): Pfam Name: RRM_1 Pfam Description: RNA recognition motif (RRM, RBD, or RNP domain)
  misc_feature (1)..(155): Functional Homolog Of Ceres SEEDLINE ID no. ME04753 at SEQ ID NO: 368
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 372 - protein, 181 aa, Cryptomeria japonica
  misc_feature (1)..(181): Public GI ID no.90704785
  misc_feature (1)..(181): Bit score of 298.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(181): Functional Homolog Of Ceres SEEDLINE ID no. ME04753 at SEQ ID NO: 368
MASADVEFRCFVGGLSWSTDDRSLKDAFTAFGEVMDSKVVSDRETGRSRGFGFVTFMDEQSMRDAIEGMNGRDLDGRNITVNRAQARGGGGGGGGGGGGYRGGGGGSGGYGGGGSGGYESRRSGGGGSGGGGYSGGGRERSERGYGGGSRNGGGYGGYSGGGGGGSRYGGGGVSDDGGWRS

SEQ ID NO: 373 - protein, 163 aa, Dianthus caryophyllus
  misc_feature (1)..(163): Public GI ID no.115529229
  misc_feature (1)..(163): Bit score of 301.5 for HMM based on sequences of FIGURE 14.
  misc_feature (8)..(79): Pfam Name: RRM_1 Pfam Description: RNA recognition motif (RRM, RBD, or RNP domain)
  misc_feature (1)..(163): Functional Homolog Of Ceres SEEDLINE ID no. ME04753 at SEQ ID NO: 368
MAEVEYRCFVGGLSWGTDDRSLAEAFNKFGEVTDSKIINDRETGRSRGFGFVTFANEQSMRDAIDEMNGKELDGRSITVNEAQSRGSGGGGGGGGYRSGGGGGGGYGGGGGGYGGRREGGGGGGYGGGSGGGYGGRREGGGGGGYGGGGGGGYRGNSDGNWRN

SEQ ID NO: 374 - protein, 168 aa, Rumex obtusifolius
  misc_feature (1)..(168): Public GI ID no.20152613
  misc_feature (1)..(168): Bit score of 332.2 for HMM based on sequences of FIGURE 14.
  misc_feature (9)..(80): Pfam Name: RRM_1 Pfam Description: RNA recognition motif (RRM, RBD, or RNP domain)
  misc_feature (1)..(168): Functional Homolog Of Ceres SEEDLINE ID no. ME04753 at SEQ ID NO: 368
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 375 - DNA, 765 bp, Gossypium hirsutum
  misc_feature (1)..(765): Ceres CLONE ID no.1916226
  misc_feature (1)..(765): Encodes the peptide sequence at SEQ ID NO 376
atcgtcaatttcttcattccctctctccctagtgttttccgatatggcttcagctgatgttgagtaccgatgcttcgtcggagggctcgcttgggccaccgatgaccgggctctcgaagaagccttcagtgtgtatggcgagatcgtcgaatcgaagattatcaatgaccgtgaatctggaagatcccgaggctttgggttcgtaactttccgtgacgagaaatctatgagagacgctattgaaggaatgaacggtcagaatcttgacggaaggaacattaccgtaaacgaagcccaatcacgccgaagcggtggaggcggcggtgaaggatacggaggaggaagcggaggctacaaaagaagtggaggaggcggaggatatggtcgccgtgaaggaggctatggaggtggccgtcgtgagggtgtattctggaatggtggaggatatgacggcggaggcggtggtggcggatatggcggaggcggtggcggatatggcggcggtggcggtggtggatatggaggttgacgctgagatggtgggtctcgttactcgaggaggcggagcgtctgatgggagctggaagacttagggtcgtagggttagcatttaagtgggctttgggctttgctttttcagttggatgatgacgtgtttcaaatattggtgctttattgttgttttgtagcagtttggattctctcgtttttgaccgatgtttatgtgacaaaaaacaatggagggaagtatactatcttcttttc

SEQ ID NO: 376 - protein, 161 aa, Gossypium hirsutum
  misc_feature (1)..(161): Ceres CLONE ID no.1916226
  misc_feature (1)..(161): Bit score of 292.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(161): Functional Homolog Of Ceres SEEDLINE ID no. ME04753 at SEQ ID NO: 368
MASADVEYRCFVGGLAWATDDRALEEAFSVYGEIVESKIINDRESGRSRGFGFVTFRDEKSMRDAIEGMNGQNLDGRNITVNEAQSRRSGGGGGEGYGGGSGGYKRSGGGGGYGRREGGYGGGRREGVFWNGGGYDGGGGGGGYGGGGGGYGGGGGGGYGG

SEQ ID NO: 377 - DNA, 1307 bp, Gossypium hirsutum
  misc_feature (1)..(1307): Ceres CLONE ID no.1834392
  misc_feature (1)..(1307): Encodes the peptide sequence at SEQ ID NO 378
aaccattcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggtatggtggaggtggatacggaggtggacgccgtgaaggaggatacggtgacggcggatctcgttactcaagaggcggcggtgcatctgaaggcaactggaggtcttaaatttagggtttcaaagtgggcttgggcctatattgttatgggtttggttaaaaagcccacttaactgaaccttttctgcccccaaaatggcgatttcaacaatccaaaagctcacttcccaaatccaccgtctcccacctgtatcctgccacatcctcacccgatcctccgccaccttgtcctcctccaagaaggttgtcgacaggatcgtcaagctcttcgccatcgacccagaaggccaaaagcgggaggttgtgggcctagccggccacagcttacttcgggccttgactaacagcgggctgattgatccggcgtctcaccggctcgaggagattgatgcttgctccgccgaatgcgaggtcaacatcgcccaggaatggctcgagaagcttccaccccgtacctacgatgaggaatatgtgttggtaaggaattcgaggggtcgtatcttgaacaagcattccaggcttgggtgtcaggtcgtgcttacgcctcagctccaaggtatggttgtcgctgtccccgagcctaagccgtgggatattccataaaaatatatatagaactagacggaagtgagggtgctttctaatgtatttctgttgtttttatgggagtaataataattttggtactctgaaagaaacggatttttttccatgtaatttgggtcgcttcgaagttaaatgcaagttattctatggattttggtgtttt

SEQ ID NO: 378 - protein, 168 aa, Gossypium hirsutum
  misc_feature (1)..(168): Ceres CLONE ID no.1834392
  misc_feature (1)..(168): Bit score of 329.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(168): Functional Homolog Of Ceres SEEDLINE ID no. ME04753 at SEQ ID NO: 368
MAAADVEFRCFVGGLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSRGGGASEGNWRS

SEQ ID NO: 379 - DNA, 1540 bp, Gossypium hirsutum
  misc_feature (1)..(1540): Ceres CLONE ID no.1855348
  misc_feature (1)..(1540): Encodes the peptide sequence at SEQ ID NO 380
gccgcagctcaaaaaccctaaacccggaatcaatcaatctcatacaatgctggtgttcttctcttacactcgcaacctcctcaaacccagaagctcgtcgcctctccctttcacctccataatgcacatgtcccagtccacctctatccctaaaaaacaggacagagtacgcgaccacggtttcgacaactacatggaagcggagaaaaagacccggaaagtcctcaaattccaatctctcattctttcccagccaagtcaaaccttgcccatctctcgtttcgactctctcgctcgtcgccttggtctcggcttcaaagaaaacgaagccgctgcttatctccttaaattcccccacgttttcgaaatctacgagcaccctgttctcagaatcctcttttgcaggctaacccagaaggcccatctccaaattgagcaagaaaaacaagcactccatgcccagttacctgatgccgtcacccggttaaggaagttggttatgatgtcgaacacgggccgtttgagactggaacacgttcggattgccaggaaagaatttgggttgcctgatgattttgagtactcggtaattctcaaataccctgaattttttagattgtttgatgctcgagatgcaaggaataagtacattgagattgttgaaagagatcccgagttagctatttgtgccatagagaaagttagagagagagagtacagagaaaaaggacttgacgctgaggatgttaggttctcatttcttgttaactttccacctggattttctctccaaaatatctgctttttcttagttttcctttttgtcccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggtatggtggtggtgggtacggaggtggacgccgtgaaggaggatatggtgacggcggatctcgttactcaaaaggcggcggtgcatctgaaggcagctggaggtcttaagtttaggtttcaaagtgggcttgggcctatattgttatgggtttggtttgggtttagtagttagtaattttaagtttctctattagtgtttggtttgggttctctcttttttgatcgatgttgttactgttctcttaaaatcataaaaatggaatgaagtatcttttcaattttctgcctt

SEQ ID NO: 380 - protein, 168 aa, Gossypium hirsutum
  misc_feature (1)..(168): Ceres CLONE ID no.1855348
  misc_feature (1)..(168): Bit score of 327.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(168): Functional Homolog Of Ceres SEEDLINE ID no. ME04753 at SEQ ID NO: 368
MAAADVEFRCFVGGLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSKGGGASEGSWRS

SEQ ID NO: 381 - DNA, 1801 bp, Gossypium hirsutum
  misc_feature (1)..(1801): Ceres CLONE ID no.1944006
  misc_feature (1)..(1801): Encodes the peptide sequence at SEQ ID NO 382
atttatttctacatcaactgaacgaaagggaaaaggaaccaagagaagaaaaaagaaaataaatttgataagcatttccagaagaacccaaaaaaagaattaagtgcattgaaaagggtgattatattgtcacagttgatccgtgacgcccaaatgaaactatcagcggtgttttcatccagctgttactcatcggcaatcgctaagaacgccttgcaaccaccgtctctcattactctatccgcctccacctttttgccgccgctgtcccgccagctatcttgccgtcatggcgtttcatacaaccgcctttcgtttcgcgggaattcttcattttcttccaccgccgtatccgcctctaaatcggacagtcaatcccaggtgatcctcctcttgtttttggtaaaaaattcaattattttaacaaaatgcttctgaatttaatttcttttggaatttggtgcttgtatgcatacgaacagttaagataggttttcttttttgttagttacgaggttgaattataaattttggagccagatagcaattttacaaatacttctggggccaaatagcagttttacccatatttgaagtagtggccaagaccctgccttgcacctctgctgccgtccctgcttctacgaatagtgttaagagaatgccaagttttaatcttttaaaaaacttcatcgattttgtattttaaacaaataattttagatattttttttcatgcttaatataagactccagatatcatcagaaattcatataggatataagcatcaccttttttttctttttcataaaaataattaattaatgcttggactcatacctgaattgtttgatagtgcgttatagagtacttaatatgctatgggatttacacttctaatagtcttttggaaaattttctgtgatttcgtttcataaagttctatgaactatcaacaatcaacataaaaatacaatgaagtatcttttcaattttctgccttaaaaaaaaaaaaaaaaaaaaaaaaaaaaaaaattcacagttctctccaaaatatctgctttttcttagttttcctttttgtcccttttttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaagctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggtatggtggtggtgggtacggaggtggacgccgtgaaggaggatatggtgacggcggatctcgttactcaaaaggcggcggtgcatctgaaggcagctggaggtcttaagtttaggtttcaaagtgggcttgggcctatattgttatgggtttggtttgggtttagtagttagtaattttaagtttctctattagtgtttggtttgggttctctcttttttgatcgatgttgttactgttctcttaaaatcataaaaatggaatgaagtatcttttcaattttctgccttg

SEQ ID NO: 382 - protein, 168 aa, Gossypium hirsutum
  misc_feature (1)..(168): Ceres CLONE ID no.1944006
  misc_feature (1)..(168): Bit score of 322.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(168): Functional Homolog Of Ceres SEEDLINE ID no. ME04753 at SEQ ID NO: 368
MAAADVEFRCFVGGLAWATDDRALEEAFSAFGEIVESKIINDRETGRSRSFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSKGGGASEGSWRS

SEQ ID NO: 383 - DNA, 1272 bp, Gossypium hirsutum
  misc_feature (1)..(1272): Ceres CLONE ID no.1848150
  misc_feature (1)..(1272): Encodes the peptide sequence at SEQ ID NO 384
attctagccccgaaagttttgttttttttatgtaatgtagtgttttgatagtgattcttaaattttgatattgaataacttgatgctttgaaatttatgtttttataatatttgttgtcttcttgcttgcagtactaactggaatattcgatatttattgtatttgtacagtgagtcaatgatattatatttaatttaaatctaatttgatctggtatggttcgttcatttataatttcaaagtttctattttttttaatatcgaattggcacaatggatctcgaatatttaatatttaagtttgtagttgtaactttctactggttttctttgttattagtctgaccctacattttgaaggcagcagataattgggtttctattttataagtttgtatagtaattctccttaaaaactaatgaaagcatgatcatcttttgtacctatcttcatctgttttatgcaatttaaattaagggtctccttcataatgttgatagttgattggacagatcaccaattcacagttctctccaaaatatctgctttttcttagttttcctttttgtcccttgtttatttgatatttccccctcatggccgccgctgatgtcgagttccggtccttcgtcggatggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggtatggtggtggtgggtacggaggtggacgccgtgaaggaggatatggtgacggcggatctcgttactcaaaaggcgcggtgcatctgaaggcagctggaggtcttaagtttaggtttcaaagtgggcttgggcctatattgttatgggtttggtttgtgtttagtagttagtaattttaagtttctctattagtgtttggtttgggttctctcttttttgatcgatgttgttactgttctcttaaaatcataaaaatggaatgaagtatcttttc

SEQ ID NO: 384 - protein, 189 aa, Gossypium hirsutum
  misc_feature (1)..(189): Ceres CLONE ID no.1848150
  misc_feature (1)..(189): Bit score of 295.8 for HMM based on sequences of FIGURE 14.
  misc_feature (11)..(81): Pfam Name: RRM_1 Pfam Description: RNA recognition motif (RRM, RBD, or RNP domain)
  misc_feature (1)..(189): Functional Homolog Of Ceres SEEDLINE ID no. ME04753 at SEQ ID NO: 368
MAAADVEFRSFVGWLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRREGGYGNGGGYGGGGYGGGRREGGYGDGGSRYSKGAVHLKAAGGLKFRFQSGLGPILLWVWFVFSS

SEQ ID NO: 385 - DNA, 681 bp, Gossypium hirsutum
  misc_feature (1)..(681): Ceres CLONE ID no.1898837
  misc_feature (1)..(681): Encodes the peptide sequence at SEQ ID NO 386
attcacagctctttacaaaatatctgctcctcttagtttccctttttgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgacggcggatctcgttactcaagaggcggcggtgcatctgaaggcaactggaggtcttaaatttagggtttcaaagtgggcttgggcctatattgttatgggtttggtttgggtttggtagttggtaattctaaagttactctgttactgtttggtttgggttctctcgtttttgatcgatgttgttactgttctcttaaaagcataaaaatggaatgaagtatcttcttttc

SEQ ID NO: 386 - protein, 143 aa, Gossypium hirsutum
  misc_feature (1)..(143): Ceres CLONE ID no.1898837
  misc_feature (1)..(143): Bit score of 297.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(143): Functional Homolog Of Ceres SEEDLINE ID no. ME04753 at SEQ ID NO: 368
MAAADVEFRCFVGGLAWATDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGRRDGGSRYSRGGGASEGNWRS

SEQ ID NO: 387 - DNA, 684 bp, Gossypium hirsutum
  misc_feature (1)..(684): Ceres CLONE ID no.1832547
  misc_feature (1)..(684): Encodes the peptide sequence at SEQ ID NO 388
tcattctcttctatctccaaaataccctttccattttccctttatttcctttgccgcccctagggtttaattacattccgcacatggcttctgcagatgtcgagtaccagtgctttgtcggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatcgatgagagatgctattgaaggaatgaacggtcggagtctcgatggaaggaatataaccgtcaacgaagcacaatctcgccgaagcggcggcggaggtggtggtggaggatttggaggaaaaggtgggtacaaccgtggtggaggcggtggatatggtggtcgccgtgaaggtggatatggaggtggtggatacggaggtggacgccgtgatggtggtggatacggtgatggtggatctcgttactcaggtggcggcggttcttgggcttaggttaaggcgttttagggtttgagtgagcttcggcgcttattttagggtttaatgggtttgcttgttagtgtctggtttctatcgatattttttcttgtattatcaggagttttaaaacatgaaagtggaatgaagtaaatgctttcttttt

SEQ ID NO: 388 - protein, 149 aa, Gossypium hirsutum
  misc_feature (1)..(149): Ceres CLONE ID no.1832547
  misc_feature (1)..(149): Bit score of 267.1 for HMM based on sequences of FIGURE 14.
  misc_feature (10)..(80): Pfam Name: RRM_1 Pfam Description: RNA recognition motif (RRM, RBD, or RNP domain)
  misc_feature (1)..(149): Functional Homolog Of Ceres SEEDLINE ID no. ME04753 at SEQ ID NO: 368
MASADVEYQCFVGLAWTINDRALEEAFSAYGEIVDSKIINDRETGRSRGFGFVTFRDEKSMRDAIEGMNGRSLDGRNITVNEAQSRRSGGGGGGGGFGGKGGYNRGGGGGYGGRREGGYGGGGYGGGRRDGGGYGDGGSRYSGGGGSWA

SEQ ID NO: 389 - DNA, 1009 bp, Gossypium hirsutum
  misc_feature (1)..(1009): Ceres CLONE ID no.1807968
  misc_feature (1)..(1009): Encodes the peptide sequence at SEQ ID NO 390
aaaatcggtatcgccaaaacacccccaatctcacccctccgttgctcttttcaatcaagaaactctccagcagcgtctccaagctcttatcgaaggaaccctagctgtctcaagtccctactaacagtttgctagttcgttcccattcgcattcccacttccacacactcatttcaatgaaagattgacaaacccacccgcaaattttcgactgttaaagaatcgttgaataaaaacaaaatgcttcgttaggaattcacagctctttacaaaatatctgctcctcttagtttccctttttgtcccttgtttatttgatactcccccctcatggctgccgctgatgtcgagttccggtgcttcgtcggagggctcgcatgggcaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacaccgtgaaggtggatacggaaacggtggggggtatggtggaggtggatacggaggtggacgccgtgaaggaggatacggtgacggcggatctcgttactcaagaggcggcggtgcatctgaaggcaactggaggtcttaaatttagggtttcaaagtgggcttgggcctatattgttatgggtttggtttgggtttggtagttggtaattctaaagttactctgttactgtttggtttgggttctctcgtttttgatcgatgttgttactgttctcttaaaagcataaaaatggaatgaagtatcttcttttc

SEQ ID NO: 390 - protein, 152 aa, Gossypium hirsutum
  misc_feature (1)..(152): Ceres CLONE ID no.1807968
  misc_feature (1)..(152): Bit score of 245.9 for HMM based on sequences of FIGURE 14.
  misc_feature (2)..(65): Pfam Name: RRM_1 Pfam Description: RNA recognition motif (RRM, RBD, or RNP domain)
  misc_feature (1)..(152): Functional Homolog Of Ceres SEEDLINE ID no. ME04753 at SEQ ID NO: 368
MGTDDRALEEAFSAFGEIVESKIINDRETGRSRGFGFVTFRDEKAMRDAIEGMNGQNLDGRNITVNEAQSRRSGGGGGGFGGGNGGYSRGGGGGGYGGRQGGYGGGHREGGYGNGGGYGGGGYGGGRREGGYGDGGSRYSRGGGASEGNWRS

SEQ ID NO: 391 - DNA, 513 bp, Populus balsamifera subsp. trichocarpa
  misc_feature (1)..(513): Ceres ANNOT ID no.1460836
  misc_feature (1)..(513): Encodes the peptide sequence at SEQ ID NO 392
atgtctgccgaggttgagtacaggtgctttgttggcggcctcgcttgggccaccactgaccaagtcctccaagaggcttttagccagtacggtgaaatcatcgattcgaagattataaatgaccgtgaaaccggaagatctcgtggttttggatttgtgaccttcggcaatgagaaggcaatgagagatgctattgatggaatgaacggtcaggacctcgatggccgtaacatcaccgtgaacgaagctcaatcccgcggaagtggtggaggtggtggtggcggcggtggttacaaccgcaacagcggtggtggcggttatggaggaggtggacgccgtgaaggcggcggtggttacagccgtggcggaggcggctacggaggcggtggaagcggatatggtagtggtggcggcggcggtggttatggcggtggccgtgaccgtggttatggtgacggtggatctaggtactcttcaaggggtgaatccgaaggtggtagctggaggagttag

SEQ ID NO: 392 - protein, 170 aa, Populus balsamifera subsp. trichocarpa
  misc_feature (1)..(170): Ceres ANNOT ID no.1460836
  misc_feature (1)..(170): Bit score of 330.8 for HMM based on sequences of FIGURE 14.
  misc_feature (9)..(80): Pfam Name: RRM_1 Pfam Description: RNA recognition motif (RRM, RBD, or RNP domain)
  misc_feature (1)..(170): Functional Homolog Of Ceres SEEDLINE ID no. ME04753 at SEQ ID NO: 368
MSAEVEYRCFVGGLAWATTDQVLQEAFSQYGEIIDSKIINDRETGRSRGFGFVTFGNEKAMRDAIDGMNGQDLDGRNITVNEAQSRGSGGGGGGGGGYNRNSGGGGYGGGGRREGGGGYSRGGGGYGGGGSGYGSGGGGGGYGGGRDRGYGDGGSRYSSRGESEGGSWRS

SEQ ID NO: 393 - DNA, 498 bp, Populus balsamifera subsp. trichocarpa
  misc_feature (1)..(498): Ceres ANNOT ID no.1450324
  misc_feature (1)..(498): Encodes the peptide sequence at SEQ ID NO 394
atggctgctgaggttgagtacaggtgctttgttggtggcctcgcatgggccactactgaccaatcccttcaagaagcgtttagccagtacggtgaaatcatcgattcgaagattataaacgatcgtgaaactggaagatctcgcggctttggatttgttaccttcaacaacgagaaggcaatgagagatgcgattgatggaatgaacggccaagaccttgatgggcgtaacatcaccgtgaatgaagcacaatcccgcggaagcggcggtggtggcggaggtgggggctacagccgtggaggcggtggcggttacggaggtcgccgtgaaggtggcggaggcggttatagccgtggtggaggtggatacggcggtggtggaggtggatacggcggcggcggtggtggttatggtggtggacgtgaccgtgggtacggtgatggtggatcaaggtattcttccaggggcggatctgatggtggtagctggagggactag

SEQ ID NO: 394 - protein, 165 aa, Populus balsamifera subsp. trichocarpa
  misc_feature (1)..(165): Ceres ANNOT ID no.1450324
  misc_feature (1)..(165): Bit score of 335.0 for HMM based on sequences of FIGURE 14.
  misc_feature (9)..(80): Pfam Name: RRM_1 Pfam Description: RNA recognition motif (RRM, RBD, or RNP domain)
  misc_feature (1)..(165): Functional Homolog Of Ceres SEEDLINE ID no. ME04753 at SEQ ID NO: 368
MAAEVEYRCFVGGLAWATTDQSLQEAFSQYGEIIDSKIINDRETGRSRGFGFVTFNNEKAMRDAIDGMNGQDLDGRNITVNEAQSRGSGGGGGGGGYSRGGGGGYGGRREGGGGGYSRGGGGYGGGGGGYGGGGGGYGGGRDRGYGDGGSRYSSRGGSDGGSWRD

SEQ ID NO: 395 - DNA, 719 bp, Arabidopsis thaliana
  misc_feature (1)..(719): Ceres CLONE ID no.1012104
  misc_feature (1)..(719): Encodes the peptide sequence at SEQ ID NO 396
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggaagacgtgagggaggaggaggatacggtggtggtgaaggaggaggttacggaggaagcggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctatc

SEQ ID NO: 396 - protein, 145 aa, Arabidopsis thaliana
  misc_feature (1)..(145): Ceres CLONE ID no.1012104
  misc_feature (1)..(145): Bit score of 285.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(145): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGRREGGGGYGGGEGGGYGGSGGGGW

SEQ ID NO: 397 - DNA, 664 bp, Arabidopsis thaliana
  misc_feature (1)..(664): Ceres CLONE ID no.42610
  misc_feature (1)..(664): Encodes the peptide sequence at SEQ ID NO 398
  misc_feature (35)..(35): y is t/u or c
ctacacatctcactgctcactactctcactgtaaycccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggaggatacagcggcggcggcggttactcctcaagaggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagcc

SEQ ID NO: 398 - protein, 146 aa, Arabidopsis thaliana
  misc_feature (1)..(146): Ceres CLONE ID no.42610
  misc_feature (1)..(146): Bit score of 275.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(146): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGGGGGW

SEQ ID NO: 399 - protein, 176 aa, Arabidopsis thaliana
  misc_feature (1)..(176): Public GI ID no.15226605
  misc_feature (1)..(176): Bit score of 299.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(176): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGGYSSRGGGGGSYGGGRREGGGGYGGGEGGGYGGSGGGGGW

SEQ ID NO: 400 - DNA, 705 bp, Arabidopsis thaliana
  misc_feature (1)..(705): Ceres CLONE ID no.7420
  misc_feature (1)..(705): Encodes the peptide sequence at SEQ ID NO 401
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggaggatacagcggcggcggcggttactcctcaagaggtggtggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttattcttccgttaatgtaatgaaagagttgtt

SEQ ID NO: 401 - protein, 175 aa, Arabidopsis thaliana
  misc_feature (1)..(175): Ceres CLONE ID no.7420
  misc_feature (1)..(175): Bit score of 296.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(175): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGGGGGSYGGGRREGGGGYGGGEGGGYGGSGGGGGW

SEQ ID NO: 402 - DNA, 810 bp, Arabidopsis thaliana
  misc_feature (1)..(810): Ceres CLONE ID no.13879
  misc_feature (1)..(810): Encodes the peptide sequence at SEQ ID NO 403
  misc_feature (482)..(482): s is g or c
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggtggtagctacggaggtggcggcggtagacgcgagggtggaggaggatacagcggcggcggcggttactcctcaagaggtgstggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctatcc

SEQ ID NO: 403 - protein, 175 aa, Arabidopsis thaliana
  misc_feature (1)..(175): Ceres CLONE ID no.13879
  misc_feature (1)..(175): Bit score of 295.9 for HMM based on sequences of FIGURE 14.
  misc_feature (10)..(81): Pfam Name: RRM_1 Pfam Description: RNA recognition motif (RRM, RBD, or RNP domain)
  misc_feature (1)..(175): Functional Homolog Of Ceres SEEDLINE ID no. ME04753 at SEQ ID NO: 368
  misc_feature (142)..(142): Xaa is any aa, unknown or other
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGXGGGSYGGGRREGGGGYGGGEGGGYGGSGGGGGW

SEQ ID NO: 404 - protein, 159 aa, Arabidopsis thaliana
  misc_feature (1)..(159): Public GI ID no.30681492
  misc_feature (1)..(159): Bit score of 289.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(159): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGSYGGGGGRREGGGGYSGGGGGYSSRGGGGGSYGGGRREGGGGYGGGEGGGYGGSGGGGGW

SEQ ID NO: 405 - DNA, 706 bp, Arabidopsis thaliana
  misc_feature (1)..(706): Ceres CLONE ID no.125977
  misc_feature (1)..(706): Encodes the peptide sequence at SEQ ID NO 406
acacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggataccgcagcggcggtggtggaggttactccggtggaggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctacc

SEQ ID NO: 406 - protein, 140 aa, Arabidopsis thaliana
  misc_feature (1)..(140): Ceres CLONE ID no.125977
  misc_feature (1)..(140): Bit score of 273.1 for HMM based on sequences of FIGURE 14.
  misc_feature (10)..(81): Pfam Name: RRM_1 Pfam Description: RNA recognition motif (RRM, RBD, or RNP domain)
  misc_feature (1)..(140): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGRREGGGGYGGGEGGGYGGSGGGGGW

SEQ ID NO: 407 - DNA, 746 bp, Arabidopsis thaliana
  misc_feature (1)..(746): Ceres CLONE ID no.158026
  misc_feature (1)..(746): Encodes the peptide sequence at SEQ ID NO 408
acatctcactgctcactactctcactgtaatcccttagatcttcttttcaaatttcaatggcgtccgatgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggcggcggtagacgcgagggtggaggaggatacagcggcggcggcggcggttactcctcaagaggtggtggtggcggaagctacggtggtggaagacgtgagggaggaggaggatacggtggtggtgaaggaggaggttacggaggaagcggtggtggtggaggatggtaattcctttaattaggtttaggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattttctaaataacaaatttcttcggagatattatctctgttgattgattctacc

SEQ ID NO: 408 - protein, 154 aa, Arabidopsis thaliana
  misc_feature (1)..(154): Ceres CLONE ID no.158026
  misc_feature (1)..(154): Bit score of 286.4 for HMM based on sequences of FIGURE 14.
  misc_feature (10)..(81): Pfam Name: RRM_1 Pfam Description: RNA recognition motif (RRM, RBD, or RNP domain)
  misc_feature (1)..(154): Functional Homolog Of Ceres SEEDLINE ID no. ME04753 at SEQ ID NO: 368
MASDDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGRREGGGGYSGGGGGYSSRGGGGGSYGGGRREGGGGYGGGEGGGYGGSGGGGGW

SEQ ID NO: 409 - DNA, 713 bp, Arabidopsis thaliana
  misc_feature (1)..(713): Ceres CLONE ID no.98855
  misc_feature (1)..(713): Encodes the peptide sequence at SEQ ID NO 410
acacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggcggttactcctcaagaggtggtggtggcggaagctacggtggtggaagacgtgagggaggaggaggatacggtggtggtgaaggaggaggttacggaggaaacggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctatcatcg

SEQ ID NO: 410 - protein, 141 aa, Arabidopsis thaliana
  misc_feature (1)..(141): Ceres CLONE ID no.98855
  misc_feature (1)..(141): Bit score of 275.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(141): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYSSRGGGGGSYGGGRREGGGGYGGGEGGGYGGNGGGGGW

SEQ ID NO: 411 - DNA, 714 bp, Arabidopsis thaliana
  misc_feature (1)..(714): Ceres CLONE ID no.95453
  misc_feature (1)..(714): Encodes the peptide sequence at SEQ ID NO 412
acacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggtggaggttactccggtggaggtggtagctacggaggtggcggcggtagacgcgagggtggaggaggatacagcggcggcggcggttactcctcaagaggtggtggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctactttgttttgtgtgttctctattttgttctggttctgctttagatttgatgtaacagttcgtgattaggtattttggtatctgg

SEQ ID NO: 412 - protein, 169 aa, Arabidopsis thaliana
  misc_feature (1)..(169): Ceres CLONE ID no.95453
  misc_feature (1)..(169): Bit score of 285.1 for HMM based on sequences of FIGURE 14.
  misc_feature (10)..(81): Pfam Name: RRM_1 Pfam Description: RNA recognition motif (RRM, RBD, or RNP domain)
  misc_feature (1)..(169): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGRREGGGGYSGGGGYSSRGGGGGSYGGGRREGGGGYGGGEGGGYGGSGGGGGW

SEQ ID NO: 413 - DNA, 719 bp, Arabidopsis thaliana
  misc_feature (1)..(719): Ceres CLONE ID no.26796
  misc_feature (1)..(719): Encodes the peptide sequence at SEQ ID NO 414
acatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggtagacgcgagggtggaggaggatacagcggcggcggcggttactcctcaagaggtggtggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttatatttgatgtaacagttcgtgattaggtattttggtatctggaaacgtaatgttaagtcacttgtcattctctaaataacaaatttcttcggagatattatctctgttgattgattctacc

SEQ ID NO: 414 - protein, 145 aa, Arabidopsis thaliana
  misc_feature (1)..(145): Ceres CLONE ID no.26796
  misc_feature (1)..(145): Bit score of 274.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(145): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGSGGGGRREGGGGYSGGGGYSSRGGGGGSYGGGRREGGGGYGGGEGGGYGGSGGGGGW

SEQ ID NO: 415 - DNA, 656 bp, Arabidopsis thaliana
  misc_feature (1)..(656): Ceres CLONE ID no.125485
  misc_feature (1)..(656): Encodes the peptide sequence at SEQ ID NO 416
aacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaaagaggctcagtcacgaggaagcggtggcggcggaggccaccgtggaggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgat

SEQ ID NO: 416 - protein, 125 aa, Arabidopsis thaliana
  misc_feature (1)..(125): Ceres CLONE ID no.125485
  misc_feature (1)..(125): Bit score of 243.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(125): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVKEAQSRGSGGGGGHRGGGGRREGGGGYGGGEGGGYGGSGGGGGW

SEQ ID NO: 417 - DNA, 635 bp, Arabidopsis thaliana
  misc_feature (1)..(635): Ceres CLONE ID no.3948
  misc_feature (1)..(635): Encodes the peptide sequence at SEQ ID NO 418
ctacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagaggtggtggtggcggaagctacggtggtggaagacgtgagggaggaggaggatacggtggtggtgaaggaggaggttacggaggaagcggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagat

SEQ ID NO: 418 - protein, 124 aa, Arabidopsis thaliana
  misc_feature (1)..(124): Ceres CLONE ID no.3948
  misc_feature (1)..(124): Bit score of 243.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(124): Functional Homolog Of Ceres SEEDLINE ID no. ME04753 at SEQ ID NO: 368
MASGDVEYRCFVGGLAWATDDRALETAFAQYGDVIDSKIINDRETGRSRGFGFVTFKDEKAMKDAIEGMNGQDLDGRSITVNEAQSRGRGGGGGSYGGGRREGGGGYGGGEGGGYGGSGGGGGW

SEQ ID NO: 419 - protein, 126 aa, Arabidopsis thaliana
  misc_feature (1)..(126): Public GI ID no.30692254
  misc_feature (1)..(126): Bit score of 229.9 for HMM based on sequences of FIGURE 14.
  misc_feature (8)..(79): Pfam Name: RRM_1 Pfam Description: RNA recognition motif (RRM, RBD, or RNP domain)
  misc_feature (1)..(126): Functional Homolog Of Ceres SEEDLINE ID no. ME04753 at SEQ ID NO: 368
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGGW

SEQ ID NO: 420 - protein, 208 aa, Brassica rapa
  misc_feature (1)..(208): Public GI ID no.83032218
  misc_feature (1)..(208): Bit score of 223.1 for HMM based on sequences of FIGURE 14.
  misc_feature (36)..(106): Pfam Name: RRM_1 Pfam Description: RNA recognition motif (RRM, RBD, or RNP domain)
  misc_feature (1)..(208): Functional Homolog Of Ceres SEEDLINE ID no. ME04753 at SEQ ID NO: 368
  misc_feature (161)..(161): Xaa is any aa, unknown or other
MAFLSKVGKIFRQTSAHVTASNSMLQSIRCMSSSKIFVGGISYSTDEFGLREAFSKYGEVVDAKIIVDRETGRSRGFAFVTFTSTEEASNAMQLDGQDLHGRRIRVNYATERGSGFGGRGFGGPGGGNAGGYGAPSGGYGGGGGYGGGAGGYGAPGGGYGXWWWLRRRCWWLRCSSWWLWRRWLQCSRWWLRRWLILWWKCCWWRLWR

SEQ ID NO: 421 - protein, 444 aa, Solanum lycopersicum
  misc_feature (1)..(444): Public GI ID no.1838976
  misc_feature (1)..(444): Bit score of 1017.9 for HMM based on sequences of FIGURE 56.
  misc_feature (295)..(349): Pfam Name: bZIP_2 Pfam Description: Basic region leucine zipper
  misc_feature (1)..(444): Functional Homolog Of Ceres SEEDLINE ID no. ME20628 at SEQ ID NO: 1681
MAQSNSKPPMSSQNFGVGAVSHVRSLSQSSIFSNSCLPPLSPFPPSEPGMVSGRSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 422 - protein, 166 aa, Sinapis alba
  misc_feature (1)..(166): Public GI ID no.1346180
  misc_feature (1)..(166): Bit score of 309.6 for HMM based on sequences of FIGURE 14.
  misc_feature (10)..(81): Pfam Name: RRM_1 Pfam Description: RNA recognition motif (RRM, RBD, or RNP domain)
  misc_feature (1)..(166): Functional Homolog Of Ceres SEEDLINE ID no. ME04753 at SEQ ID NO: 368
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 423 - protein, 169 aa, Sinapis alba
  misc_feature (1)..(169): Public GI ID no.1346181
  misc_feature (1)..(169): Bit score of 304.1 for HMM based on sequences of FIGURE 14.
  misc_feature (10)..(81): Pfam Name: RRM_1 Pfam Description: RNA recognition motif (RRM, RBD, or RNP domain)
  misc_feature (1)..(169): Functional Homolog Of Ceres SEEDLINE ID no. ME04753 at SEQ ID NO: 368
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 424 - DNA, 125 bp, Glycine max
  misc_feature (1)..(125): Ceres CLONE ID no.621487
  misc_feature (1)..(125): Encodes the peptide sequence at SEQ ID NO 425
  misc_feature (25)..(25): y is t/u or c
attcttcgtgctattttcctttgtytctatggcttctgcagaagtagagttccgatgctttgttggtgggcttgcttgggccaccgaccacgatgctctcgagaaagccttctctcaatttggcg

SEQ ID NO: 425 - protein, 182 aa, Glycine max
  misc_feature (1)..(182): Ceres CLONE ID no.621487
  misc_feature (1)..(182): Bit score of 314.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(182): Functional Homolog Of Ceres SEEDLINE ID no. ME04753 at SEQ ID NO: 368
MASAEVEFRCFVGGLAWATDHDALEKAFSQFGEIVESKVINDRETGRSRGFGFVTFATEQAMRDAIEGMNGQNLDGRNITVNEAQSRGKGGGGGGGGYGGGGGGYGGGGGYSRGGGGYGGGGGRREGGYNRNGGGGGYGGGGGGYGGGGGYGGGGRDRGYGGDGGSRYSRGGGGSDGGSWRN

SEQ ID NO: 426 - DNA, 731 bp, Glycine max
  misc_feature (1)..(731): Ceres CLONE ID no.583672
  misc_feature (1)..(731): Encodes the peptide sequence at SEQ ID NO 427
gtgccagtcttacccctcttaataccaattttctagggtttatacaattttcgatggcttcttcagatgttgagtaccgttgctttgtcggtgggctcgcttgggccactgacgaccaagctctcgagagagccttctctcagtacggcgaaatcgttgaaacgaagattatcaacgatcgtgagactggaagatccaggggttttggatttgtgaccttcgcctcggagcagtccatgaaagacgccatcgaagggatgaacggccaaaaccttgacggccgtaacatcactgttaacgaagctcagtcccgtggtggcggtggcggcggaggcggtggaggtggtggatatggtggtggtcgcggtggtggatatggtggtggtggtcgcggtggtggagggggatacaaccgtagcggtggcggtggaggctatggcggcggcggtggatatggcggtggcggtggcggtggctatggcggtggcagagaccgtggttatggtggtggtggtgaccgtggttactctcgtggtggtgacggtggtgatggaggctggagaaactagggcttgatgtcgttgattagggtttatgattatgctcagtaattttagttgtgtttgagtttgagtatctttatggttttgtgtcaccgtggttcttgtttttgaccaatatatctggttgtttatagtcgatttaatgaaatgataatcagaaattggagt

SEQ ID NO: 427 - protein, 171 aa, Glycine max
  misc_feature (1)..(171): Ceres CLONE ID no.583672
  misc_feature (1)..(171): Bit score of 312.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(171): Functional Homolog Of Ceres SEEDLINE ID no. ME04753 at SEQ ID NO: 368
MASSDVEYRCFVGGLAWATDDQALERAFSQYGEIVETKIINDRETGRSRGFGFVTFASEQSMKDAIEGMNGQNLDGRNITVNEAQSRGGGGGGGGGGGGYGGGRGGGYGGGGRGGGGGYNRSGGGGGYGGGGGYGGGGGGGYGGGRDRGYGGGGDRGYSRGGDGGDGGWRN

SEQ ID NO: 428 - protein, 160 aa, Glycine max
  misc_feature (1)..(160): Public GI ID no.5726567
  misc_feature (1)..(160): Bit score of 287.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(160): Functional Homolog Of Ceres SEEDLINE ID no. ME04753 at SEQ ID NO: 368
MASADVEYRCFVGGLAWATDDHALERAFSQYGEIVETKIINDRETGRSRGFGFVTFASEQSMKDAIGAMNGQNLDGRNITVNEAQSRGGGGGGGGGGGGYNRGGGGYGGRSGGGGGGGGYRSRDGGYGGGYGGGGGGGYGGGRDRGYSRGGDGGDGGWRN

SEQ ID NO: 429 - DNA, 843 bp, Glycine max
  misc_feature (1)..(843): Ceres CLONE ID no.580316
  misc_feature (1)..(843): Encodes the peptide sequence at SEQ ID NO 430
tcgtgctaatcatctatccttgtgtttttcctttcgggattggtttctatggcttctgaagtaatagagtaccgatgctttgtcggtgggcttgcttgggccaccgacagcgatgctctcgagaaagccttctctcattatggtgagatcgtcgaatcgaaggttatcatcgatcgtgaaactagaagatcgagagggtttggatttgtgaccttcgcctcggagcaggcgatgaaagacgcaatcgaaggaatgaacggtcagaacctcgacggtcgtagtatcacagtgaacgaagcacaatcccgtggaagaggcggtggtggcggtggatacggaggtggtggtggttatggcggcggcggttacagccgcggtggaggaggatatggaggaggaggccgccgtgaaggtggtggaggtggctataaccgcaacggtggaggtggtggatatggtggtggtggaggttatggtggtggtggaggtcatggtggcggtggaggttatggtggcggtgggagagaccgtggatatggtggtgacggcgggtcccgctactcgagaggaggcggtgcttcggatggaggaagctggaggaattaggattaggttttttagtgggtgaaaaaatggggggaggttctgttggagtaatatcatccccttgatattaattgtggtaattttaggtttggaatatgcgttgtggtttgagcatatgttactgttatggttggttggtttccgtgttactcctgtcctgtggttctcgtttttgacctctgataatgaatctgtgttcttgaaggaatgaaatgaatggcaagaaattatgatccc

SEQ ID NO: 430 - protein, 185 aa, Glycine max
  misc_feature (1)..(185): Ceres CLONE ID no.580316
  misc_feature (1)..(185): Bit score of 296.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(185): Functional Homolog Of Ceres SEEDLINE ID no. ME04753 at SEQ ID NO: 368
MASEVIEYRCFVGGLAWATDSDALEKAFSHYGEIVESKVIIDRETRRSRGFGFVTFASEQAMKDAIEGMNGQNLDGRSITVNEAQSRGRGGGGGGYGGGGGYGGGGYSRGGGGYGGGGRREGGGGGYNRNGGGGGYGGGGGYGGGGGHGGGGGYGGGGRDRGYGGDGGSRYSRGGGASDGGSWRN

SEQ ID NO: 431 - DNA, 554 bp, Glycine max
  misc_feature (1)..(554): Ceres CLONE ID no.1169834
  misc_feature (1)..(554): Encodes the peptide sequence at SEQ ID NO 432
aatattcctatcctcttttccaaatttccatggcttctgcggatgttgaataccgatgctttgttggtgggctcgcttgggccactgacaactacgatctggagaaagccttctctcagtacggtgacgtcgttgaatcgaagattatcaacgatcgtgagactggaagatccaggggatttggatttgttaccttcgcctccgaggattcaatgagggatgcgatcgaagggatgaacggtcagaaccttgatggacgcaacatcactgtgaacgaagctcagtcccgcggaagccgcggtggaggcggtggcggttacggaagtggcggtggatacaaccgcagtggtggtgctggaggatacggtggccgtcgggaaggtgcatataaccgtaacggtggtggttatggcggtgacagagaccatcgttacggaccttacggggacggtggatcacgctactctcgtggtggtggtgatggaagctggagaaattagggcttaatgttgtagattagtgtttattgctatgtttgtgttccgtaattttag

SEQ ID NO: 432 - protein, 156 aa, Glycine max
  misc_feature (1)..(156): Ceres CLONE ID no.1169834
  misc_feature (1)..(156): Bit score of 289.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(156): Functional Homolog Of Ceres SEEDLINE ID no. ME04753 at SEQ ID NO: 368
MASADVEYRCFVGGLAWATDNYDLEKAFSQYGDVVESKIINDRETGRSRGFGFVTFASEDSMRDAIEGMNGQNLDGRNITVNEAQSRGSRGGGGGGYGSGGGYNRSGGAGGYGGRREGAYNRNGGGYGGDRDHRYGPYGDGGSRYSRGGGDGSWRN

SEQ ID NO: 433 - protein, 105 aa, Medicago sativa
  misc_feature (1)..(105): Public GI ID no.6273331
  misc_feature (1)..(105): Bit score of 200.5 for HMM based on sequences of FIGURE 14.
  misc_feature (8)..(79): Pfam Name: RRM_1 Pfam Description: RNA recognition motif (RRM, RBD, or RNP domain)
  misc_feature (1)..(105): Functional Homolog Of Ceres SEEDLINE ID no. ME04753 at SEQ ID NO: 368
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 434 - protein, 190 aa, Medicago truncatula
  misc_feature (1)..(190): Public GI ID no.92874469
  misc_feature (1)..(190): Bit score of 308.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(190): Functional Homolog Of Ceres SEEDLINE ID no. ME04753 at SEQ ID NO: 368
MGSSDVEYRCFVGGLAWATDSQALEQAFSKFGEITDSKVINDRETGRSRGFGFVTFAEEKSMRDAIEEMNGQDIDGRNITVNEAQSRGSGGGGRGGGGGGYGGGGGYGGGGGGYGGGGGRRDGGYSRSGGGGGYGGGGDRGYGGGGGGGYGGGRDRGYGGGGGDRGYGGGGGGDRYSRGGGADSGGNWRD

SEQ ID NO: 435 - protein, 164 aa, Medicago truncatula
  misc_feature (1)..(164): Public GI ID no.92874472
  misc_feature (1)..(164): Bit score of 319.6 for HMM based on sequences of FIGURE 14.
  misc_feature (10)..(81): Pfam Name: RRM_1 Pfam Description: RNA recognition motif (RRM, RBD, or RNP domain)
  misc_feature (1)..(164): Functional Homolog Of Ceres SEEDLINE ID no. ME04753 at SEQ ID NO: 368
MASADVEYRCFVGGLAWATDSEALEKAFSQYGEIIDSKIINDRETGRSRGFGFVTFADEKSMRDAIEGMNGQDMDGRNITVNEAQSRGSGGGGGRGGGGYGGGGGGYGGGGRREGGYNRSSGGGGGYGGGGGGGYGGGRDRGYGDDGGSRYSRGGGGDGGSWRS

SEQ ID NO: 436 - protein, 146 aa, Pisum sativum
  misc_feature (1)..(146): Public GI ID no.1778374
  misc_feature (1)..(146): Bit score of 157.8 for HMM based on sequences of FIGURE 14.
  misc_feature (38)..(109): Pfam Name: RRM_1 Pfam Description: RNA recognition motif (RRM, RBD, or RNP domain)
  misc_feature (1)..(146): Functional Homolog Of Ceres SEEDLINE ID no. ME04753 at SEQ ID NO: 368
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 437 - protein, 165 aa, Ricinus communis
  misc_feature (1)..(165): Public GI ID no.18076086
  misc_feature (1)..(165): Bit score of 334.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(165): Functional Homolog Of Ceres SEEDLINE ID no. ME04753 at SEQ ID NO: 368
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 438 - protein, 164 aa, Euphorbia esula
  misc_feature (1)..(164): Public GI ID no.2674201
  misc_feature (1)..(164): Bit score of 329.5 for HMM based on sequences of FIGURE 14.
  misc_feature (9)..(80): Pfam Name: RRM_1 Pfam Description: RNA recognition motif (RRM, RBD, or RNP domain)
  misc_feature (1)..(164): Functional Homolog Of Ceres SEEDLINE ID no. ME04753 at SEQ ID NO: 368
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 439 - protein, 165 aa, Euphorbia esula
  misc_feature (1)..(165): Public GI ID no.2645699
  misc_feature (1)..(165): Bit score of 306.7 for HMM based on sequences of FIGURE 14.
  misc_feature (9)..(80): Pfam Name: RRM_1 Pfam Description: RNA recognition motif (RRM, RBD, or RNP domain)
  misc_feature (1)..(165): Functional Homolog Of Ceres SEEDLINE ID no. ME04753 at SEQ ID NO: 368
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 440 - protein, 166 aa, Pelargonium x hortorum
  misc_feature (1)..(166): Public GI ID no.2267567
  misc_feature (1)..(166): Bit score of 337.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(166): Functional Homolog Of Ceres SEEDLINE ID no. ME04753 at SEQ ID NO: 368
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 441 - protein, 157 aa, Daucus carota
  misc_feature (1)..(157): Public GI ID no.544426
  misc_feature (1)..(157): Bit score of 311.7 for HMM based on sequences of FIGURE 14.
  misc_feature (8)..(79): Pfam Name: RRM_1 Pfam Description: RNA recognition motif (RRM, RBD, or RNP domain)
  misc_feature (1)..(157): Functional Homolog Of Ceres SEEDLINE ID no. ME04753 at SEQ ID NO: 368
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 442 - DNA, 1825 bp, Zea mays
  misc_feature (1)..(1825): Ceres CLONE ID no.1547185
  misc_feature (1)..(1825): Encodes the peptide sequence at SEQ ID NO 443
ccccccagcggcagagcggcgcctcggttctgcctccgctcgcgctcgccgccggcattccggcagttcctgctcccggccggcctcccagagtgtatcgatcgccgcgatggacgacccgggcgcttccgccgaccccgccgcgcgccaccacctatcgccgcagcagctcgggggccagccgccggtgccgcgctccccgaccccgctcgacctggcctccgccgccgcggcgtccgggtatcgccgcctctcgccgtcgctgcggccgccagcgcacccgcaggcgcgcctcccgtcgccctacggccagatcccctcgcccggcgccggcgcgcaccacgcgcgctcgctctcccagccgctcttcttctcgctcgactcgctcccgccgccgccctacgccgatctgggcgccgcgcccgccgtgcctccctccccgccgccgtcgacctccgacccgccgcctctcggcctgccgcccaggagggccggccaccgccgctcgcagagcgacatcccgttcggcttcgcgcagctcagcccgccgctgcccccgccggcgccggtcaagcgcgaggtcaccgctgcggccgacggctgcagatcggacggcggcggcggtgatgacgccgccctctacgacctcgtcaacgcgtacatggacctggacgggctggacccgctcaactcgtctgaggaccgccacgacgaccgcgacagtcgtgccagcggcacgcgcgcggggagcgcggccgagagcagcgagaacgaggcggagagccagtccacgtccgcggacaggaaggacgggggcaagtcccgccattgtcgcagcctgtccatagacagcttcatgggcaagctcagcttcgccgcaggggaggagtctccgaagctgccgctgccgtctcctggtggcagcctcaccaggagcgggagtggctcactggaaggtggtgctgtcgcgctgttcaatatggagtttaccaacggagagtttaccgactccgagaagaagaaaattatggcgaatgagcgacttgctgagatagctctgacggatcctaagagggtcaagaggattctggcgaatcggcagtcagcagccaggtcaaaggagcgcaagatgaggtacattcaggagcttgagcataaggtgcaagtgctgcagacagaggctacgacactctcagcacagttgacaatgctgcagagggactcagctggattggctactcagaacaacgagttgaaaataaggcttcaagcaatggagcaacaagcacagctgagagatgcactgaacgaagcgttaactgccgaggtccagcgtctgaaactcgcgactggggaggtaaccgatggccggatgccgaagggcctacagcagcagatgaactcccagatgctccagatccagcagctgcaggttcagcagcaggcgccccaggcacagcagcagggccagcgacagcagcagcagcagcctcagaaatcggcatagatcaggtcaggtcgagagaaggacgctgaagctaattgagcttgagcatggccaattgaaggatgctgggtggggagaaaaaacccgagtcttttgcgtatatcagacatgttgtaggatagctgcaatagtagggcgacaggcgccgttggtttcgccgagtcaagtaccttagctggagtatgtcgtcttggtgtcgtagtaccatacatgattgcctgcctgcctgcctattgttgaggcgtcttggtagcgtccctgaacgttctctcggaggtgcttcttctgttcttttgtctaagagggctagggtgtcac

SEQ ID NO: 443 - protein, 465 aa, Zea mays
  misc_feature (1)..(465): Ceres CLONE ID no.1547185
  misc_feature (1)..(465): Bit score of 1099.5 for HMM based on sequences of FIGURE 56.
  misc_feature (317)..(371): Pfam Name: bZIP_2 Pfam Description: Basic region leucine zipper
  misc_feature (1)..(465): Functional Homolog Of Ceres SEEDLINE ID no. ME20628 at SEQ ID NO: 1681
MDDPGASADPAARHHLSPQQLGGQPPVPRSPTPLDLASAAAASGYRRLSPSLRPPAHPQARLPSPYGQIPSPGAGAHHARSLSQPLFFSLDSLPPPPYADLGAAPAVPPSPPPSTSDPPPLGLPPRRAGHRRSQSDIPFGFAQLSPPLPPPAPVKREVTAAADGCRSDGGGGDDAALYDLVNAYMDLDGLDPLNSSEDRHDDRDSRASGTRAGSAAESSENEAESQSTSADRKDGGKSRHCRSLSIDSFMGKLSFAAGEESPKLPLPSPGGSLTRSGSGSLEGGAVALFNMEFTNGEFTDSEKKKIMANERLAEIALTDPKRVKRILANRQSAARSKERKMRYIQELEHKVQVLQTEATTLSAQLTMLQRDSAGLATQNNELKIRLQAMEQQAQLRDALNEALTAEVQRLKLATGEVTDGRMPKGLQQQMNSQMLQIQQLQVQQQAPQAQQQGQRQQQQQPQKSA

SEQ ID NO: 444 - protein, 164 aa, Catharanthus roseus
  misc_feature (1)..(164): Public GI ID no.6911144
  misc_feature (1)..(164): Bit score of 340.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(164): Functional Homolog Of Ceres SEEDLINE ID no. ME04753 at SEQ ID NO: 368
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 445 - protein, 160 aa, Catharanthus roseus
  misc_feature (1)..(160): Public GI ID no.6911146
  misc_feature (1)..(160): Bit score of 316.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(160): Functional Homolog Of Ceres SEEDLINE ID no. ME04753 at SEQ ID NO: 368
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 446 - protein, 137 aa, Catharanthus roseus
  misc_feature (1)..(137): Public GI ID no.6911142
  misc_feature (1)..(137): Bit score of 270.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(137): Functional Homolog Of Ceres SEEDLINE ID no. ME04753 at SEQ ID NO: 368
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 447 - protein, 148 aa, Nicotiana sylvestris
  misc_feature (1)..(148): Public GI ID no.469071
  misc_feature (1)..(148): Bit score of 270.8 for HMM based on sequences of FIGURE 14.
  misc_feature (8)..(79): Pfam Name: RRM_1 Pfam Description: RNA recognition motif (RRM, RBD, or RNP domain)
  misc_feature (1)..(148): Functional Homolog Of Ceres SEEDLINE ID no. ME04753 at SEQ ID NO: 368
MAEVEYSCFVGGLAWATTDRTLADAFGTYGEVLDSKIINDRETGRSRGFGFVTFKDEKCMRDAIEGMNGQELDGRSITVNEAQARGSGGGGGGYGGGRREGGGGGYGGGGGGYGGGRREGGGGGYGGGRREGGGGGYGGGGYGGGGRY

SEQ ID NO: 448 - protein, 156 aa, Nicotiana sylvestris
  misc_feature (1)..(156): Public GI ID no.469070
  misc_feature (1)..(156): Bit score of 322.1 for HMM based on sequences of FIGURE 14.
  misc_feature (8)..(79): Pfam Name: RRM_1 Pfam Description: RNA recognition motif (RRM, RBD, or RNP domain)
  misc_feature (1)..(156): Functional Homolog Of Ceres SEEDLINE ID no. ME04753 at SEQ ID NO: 368
MAEVEYRCFVGGLAWATTDQTLGEAFSQFGEILDSKIINDRETGRSRGFGFVTFKDEKAMRDAIEGMNGQDLDGRNITVNEAQSRGSGGGGGGGGYRGGSGGGYGGGGRREGGYGGGGGYGGGRREGGYGGGGGGGYGGGRREGGYGGGSEGNWRS

SEQ ID NO: 449 - protein, 165 aa, Nicotiana sylvestris
  misc_feature (1)..(165): Public GI ID no.469072
  misc_feature (1)..(165): Bit score of 315.3 for HMM based on sequences of FIGURE 14.
  misc_feature (8)..(79): Pfam Name: RRM_1 Pfam Description: RNA recognition motif (RRM, RBD, or RNP domain)
  misc_feature (1)..(165): Functional Homolog Of Ceres SEEDLINE ID no. ME04753 at SEQ ID NO: 368
MAEVEYRCFVGGLAWATTDRTLGEAFSQYGEVLESKIINDRETGRSRGFGFVTFGDEKSMRDAIEGMNGQDLDGRNITVNEAQSRGSGGGGGGGGFRGGRREGGGGYGGGGYGGGRREGGGGGYGGGGYGGGRDRGYGGGDRGYGGDGGSRYSRGGGDSDGNWRN

SEQ ID NO: 450 - protein, 162 aa, Solanum commersonii
  misc_feature (1)..(162): Public GI ID no.1934994
  misc_feature (1)..(162): Bit score of 293.5 for HMM based on sequences of FIGURE 14.
  misc_feature (9)..(80): Pfam Name: RRM_1 Pfam Description: RNA recognition motif (RRM, RBD, or RNP domain)
  misc_feature (1)..(162): Functional Homolog Of Ceres SEEDLINE ID no. ME04753 at SEQ ID NO: 368
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 451 - protein, 178 aa, Solanum tuberosum
  misc_feature (1)..(178): Public GI ID no.82623423
  misc_feature (1)..(178): Bit score of 326.0 for HMM based on sequences of FIGURE 14.
  misc_feature (8)..(79): Pfam Name: RRM_1 Pfam Description: RNA recognition motif (RRM, RBD, or RNP domain)
  misc_feature (1)..(178): Functional Homolog Of Ceres SEEDLINE ID no. ME04753 at SEQ ID NO: 368
MGDVEYRCFVGGLAWATTDNTLSEAFSQYGEVVESKIINDRETGRSRGFGFVTFKDEQAMRDAIEGMNGQDLDGRNITVNEAQSRGGGGGGGGRGGGGYGGGRREGGGGGYGGGGGYGGGRREGGGGGGYSGGGGGYGGGRREGGYGGGGGGYGGGDRYSDRSSRGGGGGSSDGNWRN

SEQ ID NO: 452 - protein, 175 aa, Solanum tuberosum
  misc_feature (1)..(175): Public GI ID no.799015
  misc_feature (1)..(175): Bit score of 310.3 for HMM based on sequences of FIGURE 14.
  misc_feature (8)..(79): Pfam Name: RRM_1 Pfam Description: RNA recognition motif (RRM, RBD, or RNP domain)
  misc_feature (1)..(175): Functional Homolog Of Ceres SEEDLINE ID no. ME04753 at SEQ ID NO: 368
MADVEYRCFVGGLAWATTDQTLSDAFSQYAEVVESKIINDRETGRSRGFGFVTFKDEQAMRDAIEGMNRQDLDGRNITVNEAQSRGGVEAGGGRGGGGYGGGRREGGGGGYGGYGGGRREGGGGGGYSGGGGGYGGGRREGGYGGGGGGYGGGDRYSDRSSRGGGGGSSDGNWRN

SEQ ID NO: 453 - protein, 176 aa, Solanum tuberosum
  misc_feature (1)..(176): Public GI ID no.77416975
  misc_feature (1)..(176): Bit score of 168.1 for HMM based on sequences of FIGURE 14.
  misc_feature (28)..(75): Pfam Name: RRM_1 Pfam Description: RNA recognition motif (RRM, RBD, or RNP domain)
  misc_feature (1)..(176): Functional Homolog Of Ceres SEEDLINE ID no. ME04753 at SEQ ID NO: 368
MFFCSDLLCFGCYFVDLFGSDVIVMVFISIFQIINDRETGRSRGFGFVTFKDEQAMRDAIEGMNGQDLDGRKITVNEAQSRGGGGGGGGGGRGGGGYVRWRREGGGGGYGGGGGYGGGRREGGGGGGYSGGGGGYGGGRREGGYGGGGGGYGGGDRYSDRSSRGGGGGSSDGNWRS

SEQ ID NO: 454 - protein, 107 aa, Lolium perenne
  misc_feature (1)..(107): Public GI ID no.90265701
  misc_feature (1)..(107): Bit score of 202.3 for HMM based on sequences of FIGURE 14.
  misc_feature (7)..(78): Pfam Name: RRM_1 Pfam Description: RNA recognition motif (RRM, RBD, or RNP domain)
  misc_feature (1)..(107): Functional Homolog Of Ceres SEEDLINE ID no. ME04753 at SEQ ID NO: 368
MAEEYRCFVGGLAWATNDQSLEQAFSQFGEITDCKIINDRETGRSRGFGFVTFSSSESMKNAIEGMNGQDLDGRNITVNEAQSRSGGGGGGYSRGGGGGDSGGNWRN

SEQ ID NO: 455 - protein, 168 aa, Sorghum bicolor
  misc_feature (1)..(168): Public GI ID no.544423
  misc_feature (1)..(168): Bit score of 311.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(168): Functional Homolog Of Ceres SEEDLINE ID no. ME04753 at SEQ ID NO: 368
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 456 - protein, 170 aa, Sorghum bicolor
  misc_feature (1)..(170): Public GI ID no.10799202
  misc_feature (1)..(170): Bit score of 317.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(170): Functional Homolog Of Ceres SEEDLINE ID no. ME04753 at SEQ ID NO: 368
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 457 - DNA, 854 bp, Triticum aestivum
  misc_feature (1)..(854): Ceres CLONE ID no.1320097
  misc_feature (1)..(854): Encodes the peptide sequence at SEQ ID NO 458
tcgtgctttctcaggggttggcttctcctccccactcagtcctcgtttcccggcccttttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccactcccgccgctccggcggaggcggcggcggcttcagcggcggaggcggtggcggctacggcggccagcgccgcgagggcggcggcggcggcggtggctacggaggtggccgtagcggcggcggcggtggctacggcagccgtgagggcggcggcggctacggcggcggcggcggcggctacggcggcagccgcggcggctccggcggcggcggcggcggctacggcggcagccgcggcggctccggcggcggcaactggagggagtgaatggtggggcccctcgctggccagttatcctagttacccgatccgtttttacctgtctaccaaaatgttatcgctcgctcgctcccgagtatcctagatctcgctccgtcgcgtaggttccgagatgttcaggctaccgttagatgtgacgctgctaccgttccgtgttactgttccgtccccgctctgttcgctatgcttctaagattgaaatgaaaacctgagcaaagtttgttcac

SEQ ID NO: 458 - protein, 171 aa, Triticum aestivum
  misc_feature (1)..(171): Ceres CLONE ID no.1320097
  misc_feature (1)..(171): Bit score of 311.9 for HMM based on sequences of FIGURE 14.
  misc_feature (8)..(79): Pfam Name: RRM_1 Pfam Description: RNA recognition motif (RRM, RBD, or RNP domain)
  misc_feature (1)..(171): Functional Homolog Of Ceres SEEDLINE ID no. ME04753 at SEQ ID NO: 368
MADVEYRCFVGGLAWATDDQSLQNAFSKYGDVIDSKIITDRETGRSRGFGFVTFASDEAMRQAIEAMNGQDLDGRNITVNEAHSRRSGGGGGGFSGGGGGGYGGQRREGGGGGGGYGGGRSGGGGGYGSREGGGGYGGGGGGYGGSRGGSGGGGGGYGGSRGGSGGGNWRE

SEQ ID NO: 459 - protein, 163 aa, Triticum aestivum
  misc_feature (1)..(163): Public GI ID no.114145394
  misc_feature (1)..(163): Bit score of 310.0 for HMM based on sequences of FIGURE 14.
  misc_feature (8)..(79): Pfam Name: RRM_1 Pfam Description: RNA recognition motif (RRM, RBD, or RNP domain)
  misc_feature (1)..(163): Functional Homolog Of Ceres SEEDLINE ID no. ME04753 at SEQ ID NO: 368
MADVEYRCFVGGLAWATDDQSLQNAFSKYGDVIDSKIITDRETGRSRGFGFVTFASDEAMRQAIEAMNGQDLDGRNITVNEAQSRRSGGGGGGGFGGGGGGYGGQRREGGGGGGYGGGGGGYRGGRSGGGGGYGSRDGGGYGGGGGGGYGGSRGGSGGGNWRE

SEQ ID NO: 460 - DNA, 849 bp, Glycine max
  misc_feature (1)..(849): Ceres CLONE ID no.565035
  misc_feature (1)..(849): Encodes the peptide sequence at SEQ ID NO 461
ataaaaggatcccgcgggtgttccctttttcttcgtgctaatcttatcttatccctctaatcactctagctgttgcaaatttctactatttttcaatggcttctgcagatgttgagttccgttgctttgttggtgggcttgcttgggtcaccggcaacgatgccctcgagaaagccttttcaatctacggcgacatcgttgaatcgaaggttatcaacgaccgtgagactggaaggtccagaggattcggatttgtgaccttcgcctcagagcagtcaatgaaagatgcgatcgcaggaatgaacggccaggaccttgacggtcgtaacatcactgtcaacgaagctcagacccgcgccagccgtggtggtggtggaggcggtggtttcggaagtggtggtggatacaaccgcggtagcggtggatatggtggtggtggtggcggcggcggatacggtggtcgtcgtgaaggtggatacaaccgtaatggtgggggtggaggtggaggatacggcggtggtagagaccgtggttacggtggtgatggtggttctcgctactctcgcggtggggaaggcggtggatccgatggaaactggagaaattaggcatatgaccctgtaaattagggtttatgattaagttcaattattttaaggtgttgtctgtgtgtggtttaagtttcggtatctgtgttggtttcgtttcgtgttcctgtggttttcgtttttgacctacaattctagttgtgtttatagtcgatcgaatgaaatgatagtaagaaattatcgcatcaaatttctatggattttgctatctgtttgctggacgtggaaatcgaattggatt

SEQ ID NO: 461 - protein, 170 aa, Glycine max
  misc_feature (1)..(170): Ceres CLONE ID no.565035
  misc_feature (1)..(170): Bit score of 287.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(170): Functional Homolog Of Ceres SEEDLINE ID no. ME04753 at SEQ ID NO: 368
MASADVEFRCFVGGLAWVTGNDALEKAFSIYGDIVESKVINDRETGRSRGFGFVTFASEQSMKDAIAGMNGQDLDGRNITVNEAQTRASRGGGGGGGFGSGGGYNRGSGGYGGGGGGGGYGGRREGGYNRNGGGGGGGYGGGRDRGYGGDGGSRYSRGGEGGGSDGNWRN

SEQ ID NO: 462 - DNA, 913 bp, Triticum aestivum
  misc_feature (1)..(913): Ceres CLONE ID no.1317119
  misc_feature (1)..(913): Encodes the peptide sequence at SEQ ID NO 463
  misc_feature (601)..(601): n is a, c, t, g, unknown, or other
aaaaaaaaaaaaaaaaaatcgctctcggggttggcttctcctccccttccggttcgggttctggttcggttctggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggactccaccccccaggccatcgaggagatgaacggcaaggagctcgacgggcgcaacatcaccgtcaacgaggcccagtcccgccgctcgggcggagggggcggcggcggcggcggctacggcggccagcgcggcggtggcggaggctacggcggcggcggcggctacggaggcggcggcggctacggcggtggtggcggctacggcggccagcgcggcggtggcggcggcgactccggcggccagtggaggaactgagcttcgaatctcccagttatcgatctatctaccgngtcgtcgtcgtcgtcgtcgtcttcgtcagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgttactatctttcagtcggtcggtcggtcggtcagtcggtgatgcagcaatccccttctgtcatggattgggatgtgatgttggaatatcctatgtttgaacaagtttaaatggatgaagaaaatgcaagtcatagctgcgaaataacc

SEQ ID NO: 463 - protein, 142 aa, Triticum aestivum
  misc_feature (1)..(142): Ceres CLONE ID no.1317119
  misc_feature (1)..(142): Bit score of 266.8 for HMM based on sequences of FIGURE 14.
  misc_feature (8)..(79): Pfam Name: RRM_1 Pfam Description: RNA recognition motif (RRM, RBD, or RNP domain)
  misc_feature (1)..(142): Functional Homolog Of Ceres SEEDLINE ID no. ME04753 at SEQ ID NO: 368
MAETEYRCFVGGLAWATDDNNLQQAFSQYGEILDAKIINDRETGRSRGFGFVTFGSEDSTPQAIEEMNGKELDGRNITVNEAQSRRSGGGGGGGGGYGGQRGGGGGYGGGGGYGGGGGYGGGGGYGGQRGGGGGDSGGQWRN

SEQ ID NO: 464 - DNA, 845 bp, Zea mays
  misc_feature (1)..(845): Ceres CLONE ID no.1469740
  misc_feature (1)..(845): Encodes the peptide sequence at SEQ ID NO 465
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagggtttatcttcgttcgtctcatgtttgttgttgcccatctgtgtttttgattgcaaggtcgctttgtgtcagttgttagtgctgtgttcatcctcggctccagcagacccatgcatcaaccagcatggactgcggatcgatggatgctgttacccccgtcaggctttatcctaagttaatcttcaaggaaaaaatggtgcttcttggtgctg

SEQ ID NO: 465 - protein, 156 aa, Zea mays
  misc_feature (1)..(156): Ceres CLONE ID no.1469740
  misc_feature (1)..(156): Bit score of 310.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(156): Functional Homolog Of Ceres SEEDLINE ID no. ME04753 at SEQ ID NO: 368
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRN

SEQ ID NO: 466 - DNA, 1447 bp, Zea mays
  misc_feature (1)..(1447): Ceres CLONE ID no.359846
  misc_feature (1)..(1447): Encodes the peptide sequence at SEQ ID NO 467
gacctcgcatccggcccgattcgactagggttttagcactcccagtcccggctcccgccgtcgcctcgacgcttcccccctcttcctccgccgccaacccagcgagagagctcccagtccgcgaagacatggcggggaagaagcgcaagtccggctccgagaagccgacgaagcaccgcctcccgctgggagccgatgccgacgctgtcgccgaagcctcgaagcgccgccgatcgggcgccaccaagcagcaccaggcggacgaggaagcgtccatcccgccctctctcagcgccaagatcctccgcgaggcgcgcaagcagcaggaagaggagatgcgcgccgactccagcgacgaacagcgaccctcagccgtcgaggcgaccgcggggccgtccacgtcgtcctcgtttcccgtccccgccgccgacggcgagaatgagggggacgacgtcgatgagttcgacgggtttgacgcgctgagcgagtacgatggcggtgaggtggagatcaacgaggaggacgagaaggccctcgctgctttcatgtcaaaggacaaagctgccgagcgcacccttggcgatatcattctccagaagatcagggagaaggacgccgaggtcgcaactggtgaaggacgacctcgtgtaaaattggacaacagcattattgaactttataaagaggttgggaagttcttaagccggtacacgagtggggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggccgcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgc

SEQ ID NO: 467 - protein, 156 aa, Zea mays
  misc_feature (1)..(156): Ceres CLONE ID no.359846
  misc_feature (1)..(156): Bit score of 297.6 for HMM based on sequences of FIGURE 14.
  misc_feature (10)..(81): Pfam Name: RRM_1 Pfam Description: RNA recognition motif (RRM, RBD, or RNP domain)
  misc_feature (1)..(156): Functional Homolog Of Ceres SEEDLINE ID no. ME04753 at SEQ ID NO: 368
MAAADVEYRCFVGGLAWATSNESLENAFASYGEILDSKVITDRETGRSRGFGFVTFSSENSMLDAIENMNGKELDGRNITVNQAQSRGGGGGGGGRGGRGGGGYGGGRRDGGYGGGGGYGGRREGGGGGYGGGGGYGGRREGGGGGYGGGGGGWRD

SEQ ID NO: 468 - DNA, 842 bp, Zea mays
  misc_feature (1)..(842): Ceres CLONE ID no.1554524
  misc_feature (1)..(842): Encodes the peptide sequence at SEQ ID NO 469
gtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggtgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 469 - protein, 155 aa, Zea mays
  misc_feature (1)..(155): Ceres CLONE ID no.1554524
  misc_feature (1)..(155): Bit score of 307.9 for HMM based on sequences of FIGURE 14.
  misc_feature (10)..(81): Pfam Name: RRM_1 Pfam Description: RNA recognition motif (RRM, RBD, or RNP domain)
  misc_feature (1)..(155): Functional Homolog Of Ceres SEEDLINE ID no. ME04753 at SEQ ID NO: 368
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRN

SEQ ID NO: 470 - DNA, 746 bp, Zea mays
  misc_feature (1)..(746): Ceres CLONE ID no.290778
  misc_feature (1)..(746): Encodes the peptide sequence at SEQ ID NO 471
  misc_feature (659)..(659): s is g or c
  misc_feature (661)..(661): k is g or t/u
agtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacstktggattaggtgttggtacccctgttgttccctttggttctgcgtgtgatgaacatgataatttatattcttgcgctttataagtt

SEQ ID NO: 471 - protein, 157 aa, Zea mays
  misc_feature (1)..(157): Ceres CLONE ID no.290778
  misc_feature (1)..(157): Bit score of 297.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(157): Functional Homolog Of Ceres SEEDLINE ID no. ME04753 at SEQ ID NO: 368
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGYGGRREGGGGGYGGGGGGWRD

SEQ ID NO: 472 - DNA, 627 bp, Musa acuminata
  misc_feature (1)..(627): Ceres CLONE ID no.1740834
  misc_feature (1)..(627): Encodes the peptide sequence at SEQ ID NO 473
ttcctacagaggtgggttggtgttacctccccctcttccgccgtcctttcctgttcagggttccgttccgatcctttccatggcggcttccgacgtcgagttccgctgcttcgtaggcggcctcgcctgggctaccgacgacgcctcccttgagcgggctttcagcacctacggcgacatcgtcgagtctaagatcatcaacgaccgagagacggggaggtcgaggggcttcgggttcgtcaccttccgcgacgagcaatcgatgagggacgccatcaaggggatgaacggccagacccttgacggccggaacatcacagtaaacgaggcggaggttttcgcagcggcggtggcggcgggtacggcggcggcggcggaggtcgccgtgacggaggtggtgggtacggccgcgaccgcgggtacggcggtggatcgtcggatgggtactggaggagctaaggcggtcgttcgcttgccgcgatcggagggctgggcttcgtagttatctgctgctttggttatctttaagtttggaacttgtctgttgtctggcgtcattttgggtcttgcagtataagtagactgtgatgttgtggtttggcagtcctatgagtgggtgttattatc

SEQ ID NO: 473 - protein, 140 aa, Musa acuminata
  misc_feature (1)..(140): Ceres CLONE ID no.1740834
  misc_feature (1)..(140): Bit score of 220.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(140): Functional Homolog Of Ceres SEEDLINE ID no. ME04753 at SEQ ID NO: 368
MAASDVEFRCFVGGLAWATDDASLERAFSTYGDIVESKIINDRETGRSRGFGFVTFRDEQSMRDAIKGMNGQTLDGRNITVNEAEVFAAAVAAGTAAAAEVAVTEVVGTAATAGTAVDRRMGTGGAKAVVRLPRSEGWAS

SEQ ID NO: 474 - protein, 156 aa, Nicotiana glutinosa
  misc_feature (1)..(156): Public GI ID no.2226370
  misc_feature (1)..(156): Bit score of 327.2 for HMM based on sequences of FIGURE 14.
  misc_feature (8)..(79): Pfam Name: RRM_1 Pfam Description: RNA recognition motif (RRM, RBD, or RNP domain)
  misc_feature (1)..(156): Functional Homolog Of Ceres SEEDLINE ID no. ME04753 at SEQ ID NO: 368
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 475 - protein, 177 aa, Polytomella sp. 'Pringsheim 198.80'
  misc_feature (1)..(177): Public GI ID no.27527723
  misc_feature (1)..(177): Bit score of 202.0 for HMM based on sequences of FIGURE 14.
  misc_feature (5)..(75): Pfam Name: RRM_1 Pfam Description: RNA recognition motif (RRM, RBD, or RNP domain)
  misc_feature (1)..(177): Functional Homolog Of Ceres SEEDLINE ID no. ME04753 at SEQ ID NO: 368
MSSRLYVGNLSWNAKEEDLRTYFGKFGEVEEASIALDRESGRSRGFGFVTLPADVAKDAIEKTNGAEFMGRNIKVNEASPPGERPPRTNNYGGGYGDFNGNGGGRDYGRGGYGRGNGGYGGRNAGYGGRGNFGGQGGYGDNRFGNDNFGGSYGGRGGYRGPRGPSAEENNSNNYGGY

SEQ ID NO: 476 - DNA, 738 bp, Panicum virgatum
  misc_feature (1)..(738): Ceres CLONE ID no.1762613
  misc_feature (1)..(738): Encodes the peptide sequence at SEQ ID NO 477
cgtgctctctcagaggtgggttgacttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgg

SEQ ID NO: 477 - protein, 158 aa, Panicum virgatum
  misc_feature (1)..(158): Ceres CLONE ID no.1762613
  misc_feature (1)..(158): Bit score of 300.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(158): Functional Homolog Of Ceres SEEDLINE ID no. ME04753 at SEQ ID NO: 368
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGGYGGGGGGGRREGGYGGGGYGSRGDSGGNWRN

SEQ ID NO: 478 - DNA, 738 bp, Panicum virgatum
  misc_feature (1)..(738): Ceres CLONE ID no.1789498
  misc_feature (1)..(738): Encodes the peptide sequence at SEQ ID NO 479
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcagctacggcggaggcgatggcggcggtcgccgcgagggcggctacggtggtggtggctacggcagccgcggtgactccggtggtaactggaggaactgatgacttggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgc

SEQ ID NO: 479 - protein, 158 aa, Panicum virgatum
  misc_feature (1)..(158): Ceres CLONE ID no.1789498
  misc_feature (1)..(158): Bit score of 295.7 for HMM based on sequences of FIGURE 14.
  misc_feature (10)..(81): Pfam Name: RRM_1 Pfam Description: RNA recognition motif (RRM, RBD, or RNP domain)
  misc_feature (1)..(158): Functional Homolog Of Ceres SEEDLINE ID no. ME04753 at SEQ ID NO: 368
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGSYGGGDGGGRREGGYGGGGYGSRGDSGGNWRN

SEQ ID NO: 480 - DNA, 1351 bp, Panicum virgatum
  misc_feature (1)..(1351): Ceres CLONE ID no.2027327
  misc_feature (1)..(1351): Encodes the peptide sequence at SEQ ID NO 481
gctagggtttctgcatttttttttttttttttttgcatgccccaaactggagacaatcatcagagctcgatacacaggtattacaaatcatagcaaagaacaagttggtgcttcatacagcaaagaaacttttgggcaaccaattcattcatctgatatataggatagtgaaaactctggttcagcagtaaaccccaaccagcatagtaacctacatctgaattactacatatcaagattcaagacagcaacagttgttccggtgattagcaaaataaaacatggttgaaatccaaacatcatgactcttgattttttctgaccaaaagacaactctgataactgcaccagcctagtcaaagaggctgaagcccatgtcatcatcgctttcttccttctcctccaccttctcttcctgctcctgcggctgaggcgaagaaggaagagaaggcggaggagaaattcgagtgagcttagcggagctagtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggcggcggcggctacggtcgccgcgagggcggtggcggctacggcggcggcggcggcggctacggtggccgtggaggctacggtggcggcggcggcggcggctacggtggcaaccgcggcggcggctacggcaactccgatgggaactggaggagctgagcggtggggcccgcgtggccaaagttatcctgtgctttctactgtgacccgagttatcctgtgtcatgatctacctgtgtttggtgtctgtttcgtgttcgttgttgcccatctgtgtttttgatcgcaagctccgtcgtgctgttgtctgtcagagctatcttgatctccatcccatgaacttgggtgttgggattggaagctgttatcttgctgtaacttgttaccgtttcagttaatcaaaggggaaaaaaaggtgctacttggagcagc

SEQ ID NO: 481 - protein, 163 aa, Panicum virgatum
  misc_feature (1)..(163): Ceres CLONE ID no.2027327
  misc_feature (1)..(163): Bit score of 291.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(163): Functional Homolog Of Ceres SEEDLINE ID no. ME04753 at SEQ ID NO: 368
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGGGGGYGRREGGGGYGGGGGGYGGRGGYGGGGGGGYGGNRGGGYGNSDGNWRS

SEQ ID NO: 482 - DNA, 704 bp, Panicum virgatum
  misc_feature (1)..(704): Ceres CLONE ID no.2027024
  misc_feature (1)..(704): Encodes the peptide sequence at SEQ ID NO 483
gtgctctctcagaggtgggttggcttctcctccccctcttaccaagtcctcggctctagggttttaatgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggcggcggctacggcggcggtcgtcagggtggctacggcggcggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgtgcgtgtcactgtttgatccgagttacccctgagttttgttcgtgtgttaccgttcgattaggtgttggttcccctgtttaccgttccgagttgtttccg

SEQ ID NO: 483 - protein, 157 aa, Panicum virgatum
  misc_feature (1)..(157): Ceres CLONE ID no.2027024
  misc_feature (1)..(157): Bit score of 308.6 for HMM based on sequences of FIGURE 14.
  misc_feature (10)..(81): Pfam Name: RRM_1 Pfam Description: RNA recognition motif (RRM, RBD, or RNP domain)
  misc_feature (1)..(157): Functional Homolog Of Ceres SEEDLINE ID no. ME04753 at SEQ ID NO: 368
MAAADVEYRCFVGGLAWATDNASLQQAFASYGDVLDSKVITDRETGRSRGFGFVTFSSEQSMLDAIEAMNGKDLDGRNITVNQAQSRGGGGGGGGYGGGRQGGYGGGGGGGYGGGGGYGGGRREGGYGGGGGGGRREGGYGDGGYGSRGDSGGNWRN

SEQ ID NO: 484 - DNA, 725 bp, Panicum virgatum
  misc_feature (1)..(725): Ceres CLONE ID no.1773631
  misc_feature (1)..(725): Encodes the peptide sequence at SEQ ID NO 485
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacagcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgc

SEQ ID NO: 485 - protein, 154 aa, Panicum virgatum
  misc_feature (1)..(154): Ceres CLONE ID no.1773631
  misc_feature (1)..(154): Bit score of 295.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(154): Functional Homolog Of Ceres SEEDLINE ID no. ME04753 at SEQ ID NO: 368
MAAADVEYRCFVGGLAWATDNASLQQAFASYGDVLDSKVITDRETGRSRGFGFVTFSSEQSMLDAIEAMNGKDLDGRNITVNQAQSRGGGGGGYSGGRQGGYGGGGGGYGGGGGYGGGRREGGYGGGGGGGRREGGYGGGGYGSRGDSGGNWRN

SEQ ID NO: 486 - DNA, 839 bp, Panicum virgatum
  misc_feature (1)..(839): Ceres CLONE ID no.1777622
  misc_feature (1)..(839): Encodes the peptide sequence at SEQ ID NO 487
acaccgagccaccgcttcgcacaaaccgcacctagagctaggttttagccgccgcctcccccttctcgcttcggcggccgcacgcgccgacctcctcccggaagaagcccccagcgcccgccgcttccactccgtgccagatcgttgtttatgagctcgaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatgaaatgagatttgatctgcgcgc

SEQ ID NO: 487 - protein, 154 aa, Panicum virgatum
  misc_feature (1)..(154): Ceres CLONE ID no.1777622
  misc_feature (1)..(154): Bit score of 295.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(154): Functional Homolog Of Ceres SEEDLINE ID no. ME04753 at SEQ ID NO: 368
MAAADVEYRCFVGGLAWATDNASLQQAFASYGDVLDSKVITDRETGRSRGFGFVTFSSEQSMLDAIEAMNGKDLDGRNITVNQAQSRGGGGGGYGGGRQGGYGGGGGGYGGGGGYGGGRREGGYGGGGGGGRREGGYGGGGYGSRGDSGGNWRN

SEQ ID NO: 488 - protein, 163 aa, Oryza sativa subsp. indica
  misc_feature (1)..(163): Public GI ID no.125545195
  misc_feature (1)..(163): Bit score of 314.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(163): Functional Homolog Of Ceres SEEDLINE ID no. ME04753 at SEQ ID NO: 368
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGGGYGGGGGGYGGGRGGGGYGGGGGGGYGRREGGYGGGGGYGGGRGGGGGYGGSRGGGYGGDSGGNWRN

SEQ ID NO: 489 - protein, 161 aa, Oryza sativa subsp. indica
  misc_feature (1)..(161): Public GI ID no.125537516
  misc_feature (1)..(161): Bit score of 316.1 for HMM based on sequences of FIGURE 14.
  misc_feature (10)..(81): Pfam Name: RRM_1 Pfam Description: RNA recognition motif (RRM, RBD, or RNP domain)
  misc_feature (1)..(161): Functional Homolog Of Ceres SEEDLINE ID no. ME04753 at SEQ ID NO: 368
MAAPDVEYRCFVGGLAWATDDRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGSYGGGYGSRGGGNSDGNWRN

SEQ ID NO: 490 - protein, 165 aa, Oryza sativa subsp. indica
  misc_feature (1)..(165): Public GI ID no.2267593
  misc_feature (1)..(165): Bit score of 306.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(165): Functional Homolog Of Ceres SEEDLINE ID no. ME04753 at SEQ ID NO: 368
MAAPDVDYRCFVGGLAWATDNRSLEAAFSTYGEILESKIINDRETGRSRGFGFVTFSSEQAMRDAIEGMSGKELDGRNITVNEAQSRRSGGGGGGGYGQRGGGGGYGGRGYGGGGGGGGYGQRREGGYGGGGGYGGGGGGGGYGGGYGGGYGSRGGGNSDGNWRN

SEQ ID NO: 491 - protein, 161 aa, Oryza sativa subsp. indica
  misc_feature (1)..(161): Public GI ID no.2293480
  misc_feature (1)..(161): Bit score of 286.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(161): Functional Homolog Of Ceres SEEDLINE ID no. ME04753 at SEQ ID NO: 368
  misc_feature (156)..(156): Xaa is any aa, unknown or other
  misc_feature (160)..(160): Xaa is any aa, unknown or other
MAAPDVEYRCFVGGLAWATDDRSLEAAFSTYGEILESKIINDRETGRSRGFGFVTFSSEQAMRDAIEGMNGKELDGRNITVNEAQSRRSGSGSGGGYGQRGGSGSYGGGGYGGGGGGGGYCQRRESGYRGGGGYRGGRGGGNYRGGYGSRGGGNSXGNWXN

SEQ ID NO: 492 - protein, 194 aa, Oryza sativa subsp. indica
  misc_feature (1)..(194): Public GI ID no.18103931
  misc_feature (1)..(194): Bit score of 261.8 for HMM based on sequences of FIGURE 14.
  misc_feature (10)..(81): Pfam Name: RRM_1 Pfam Description: RNA recognition motif (RRM, RBD, or RNP domain)
  misc_feature (1)..(194): Functional Homolog Of Ceres SEEDLINE ID no. ME04753 at SEQ ID NO: 368
MAAPDVEYRCFVGGLAWATDDRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREAATAVAVATVAAVVAAATVVATAAAAAATPTGTGGTERWGPHGQVIYLSNRATIIIIRSLSSLVLCGTI

SEQ ID NO: 493 - protein, 104 aa, Oryza sativa subsp. indica
  misc_feature (1)..(104): Public GI ID no.125551311
  misc_feature (1)..(104): Bit score of 38.0 for HMM based on sequences of FIGURE 14.
  misc_feature (25)..(95): Pfam Name: RRM_1 Pfam Description: RNA recognition motif (RRM, RBD, or RNP domain)
  misc_feature (1)..(104): Functional Homolog Of Ceres SEEDLINE ID no. ME04753 at SEQ ID NO: 368
MSAPWWDNDYNGRTGSDSKGQESRVYVGNLPYRADERSLKDSFANYGAVSSEIAVDRETGRSRGFGFVSFQDSKSASDAIKGMNGQDIGGRNVIVQEAQPRSRR

SEQ ID NO: 494 - protein, 153 aa, Oryza sativa subsp. japonica
  misc_feature (1)..(153): Public GI ID no.108710322
  misc_feature (1)..(153): Bit score of 313.0 for HMM based on sequences of FIGURE 14.
  misc_feature (10)..(81): Pfam Name: RRM_1 Pfam Description: RNA recognition motif (RRM, RBD, or RNP domain)
  misc_feature (1)..(153): Functional Homolog Of Ceres SEEDLINE ID no. ME04753 at SEQ ID NO: 368
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGGGGGYGRREGGYGGGGGYGGGRGGGGGGYGGSRGGGYGGDSGGNWRN

SEQ ID NO: 495 - protein, 162 aa, Oryza sativa subsp. japonica
  misc_feature (1)..(162): Public GI ID no.50881454
  misc_feature (1)..(162): Bit score of 317.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(162): Functional Homolog Of Ceres SEEDLINE ID no. ME04753 at SEQ ID NO: 368
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGRGGGGYGGGGGGGYGRREGGYGGGGGYGGGRGGGGGGYGGSRGGGYGGDSGGNWRN

SEQ ID NO: 496 - protein, 162 aa, Oryza sativa subsp. japonica
  misc_feature (1)..(162): Public GI ID no.2331131
  misc_feature (1)..(162): Bit score of 303.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(162): Functional Homolog Of Ceres SEEDLINE ID no. ME04753 at SEQ ID NO: 368
MAAPDVKYRCFVGGLAWATDDRSLEAAFSTYGEILDSKIINDRETGRSLGFGFITFSSEQSMRDAIEGMNGKELDGRNITVNEAQSRRSGGGGGGYGGGGGGYGGGRGGGGYGGGGGGGYGRREGGYGGGGGYGGGRGGGGGGYGGSRGGGYGGDSGGNWRN

SEQ ID NO: 497 - protein, 162 aa, Oryza sativa subsp. japonica
  misc_feature (1)..(162): Public GI ID no.115489714
  misc_feature (1)..(162): Bit score of 318.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(162): Functional Homolog Of Ceres SEEDLINE ID no. ME04753 at SEQ ID NO: 368
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYGQRREGGYGGGGGYGGGRGGGGGYGGGYGSRGGGNSDGNWRN

SEQ ID NO: 498 - protein, 161 aa, Oryza sativa subsp. japonica
  misc_feature (1)..(161): Public GI ID no.2331133
  misc_feature (1)..(161): Bit score of 311.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(161): Functional Homolog Of Ceres SEEDLINE ID no. ME04753 at SEQ ID NO: 368
MAAPDVDYRCFVGGLAWATDNRSLEAAFSTYGEILESKIINDRETGRSRGFGFVTFSSEQAMRDAIEGMNGKELDGRNITVNEAQSRRSGGGGGGGYGQRGGGGGYGGGGYGGGGGGGGYGQRREGGYGGGGGYGGGRGGGGYGGGYGSRGGGNSDGNWRN

SEQ ID NO: 499 - protein, 160 aa, Oryza sativa subsp. japonica
  misc_feature (1)..(160): Public GI ID no.2624326
  misc_feature (1)..(160): Bit score of 314.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(160): Functional Homolog Of Ceres SEEDLINE ID no. ME04753 at SEQ ID NO: 368
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYASREGGYGGGGGYGGGRGGGGGYGGGYGRGGGNSDGNWRN

SEQ ID NO: 500 - protein, 196 aa, Oryza sativa subsp. japonica
  misc_feature (1)..(196): Public GI ID no.115454539
  misc_feature (1)..(196): Bit score of 280.2 for HMM based on sequences of FIGURE 14.
  misc_feature (10)..(81): Pfam Name: RRM_1 Pfam Description: RNA recognition motif (RRM, RBD, or RNP domain)
  misc_feature (1)..(196): Functional Homolog Of Ceres SEEDLINE ID no. ME04753 at SEQ ID NO: 368
MAAPDVEYRCFVGGLAWATDDRSLEAAFSTYGEILDSKIINDRETGRSRGFGFVTFSSEQSMRDAIEGMNGKELDGRNITVNEAQSRRSGGGGGGYGGGGGGYGGGRGGGGYGGGGGGGYGRREGGYAVAAATAATPAGTGGTDWWGPSWPVILSYPCQNHLIIESSRYRVQWLSRVEKPSIHPSSVRCSSSVMLP

SEQ ID NO: 501 - protein, 117 aa, Oryza sativa subsp. japonica
  misc_feature (1)..(117): Public GI ID no.108863012
  misc_feature (1)..(117): Bit score of 234.3 for HMM based on sequences of FIGURE 14.
  misc_feature (10)..(81): Pfam Name: RRM_1 Pfam Description: RNA recognition motif (RRM, RBD, or RNP domain)
  misc_feature (1)..(117): Functional Homolog Of Ceres SEEDLINE ID no. ME04753 at SEQ ID NO: 368
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGAP

SEQ ID NO: 502 - protein, 197 aa, Oryza sativa subsp. japonica
  misc_feature (1)..(197): Public GI ID no.2196542
  misc_feature (1)..(197): Bit score of 254.4 for HMM based on sequences of FIGURE 14.
  misc_feature (73)..(117): Pfam Name: RRM_1 Pfam Description: RNA recognition motif (RRM, RBD, or RNP domain)
  misc_feature (1)..(197): Functional Homolog Of Ceres SEEDLINE ID no. ME04753 at SEQ ID NO: 368
MAAPDVEYRCFVGGLAWATDDRSLEAAFSTYGEILESKVRWIPSSLCFFLMRFGGGVRQIWLRKSDYGGGYAVQIINDRETGRSRGFGFVTFSNEQAMRDAIQGMNGKELDGRNITVNEAQSRRSRSGSGGGYCHPGGSGSYRGGGYGGGGGGGGYGQRRESGYRGGGGYGGGRGGGGYGGGYGSRGGGNSDGNWRN

SEQ ID NO: 503 - protein, 159 aa, Oryza sativa subsp. japonica
  misc_feature (1)..(159): Public GI ID no.108863011
  misc_feature (1)..(159): Bit score of 91.3 for HMM based on sequences of FIGURE 14.
  misc_feature (10)..(59): Pfam Name: RRM_1 Pfam Description: RNA recognition motif (RRM, RBD, or RNP domain)
  misc_feature (1)..(159): Functional Homolog Of Ceres SEEDLINE ID no. ME04753 at SEQ ID NO: 368
MAAPDVEYRCFVGGLAWATDDRSLEAAFSTFGEILESKIINDRETGRSRGFGFVTFSSEQAIAAEAEATVAAAATVVAAAVATASAVKAATAVAAATVAAVAAAAATAVATAAAAAATPTGTGGTERWGPHGQVIYLSNRATIIIIRSLSSLVLCGTTI

SEQ ID NO: 504 - protein, 178 aa, Prunus avium
  misc_feature (1)..(178): Public GI ID no.34851124
  misc_feature (1)..(178): Bit score of 324.9 for HMM based on sequences of FIGURE 14.
  misc_feature (10)..(81): Pfam Name: RRM_1 Pfam Description: RNA recognition motif (RRM, RBD, or RNP domain)
  misc_feature (1)..(178): Functional Homolog Of Ceres SEEDLINE ID no. ME04753 at SEQ ID NO: 368
MASAEIEFRCFVGGLAWATDNDALERAFSPFGEIIESKIINDRETGRSRGFGFVTFSNEKAMRDAIEGMNGQNLDGRNITVNEAQSRGSGGGGGGNGGGYSRGGGGGGYGGGGGYGGGGRREGGGGGYSRGGGGGGYGSGGGGYGGGGRREGGYGGGEGGGARYSRGSGGSEGGSWRS

SEQ ID NO: 505 - protein, 152 aa, Nicotiana attenuata
  misc_feature (1)..(152): Public GI ID no.111162637
  misc_feature (1)..(152): Bit score of 298.1 for HMM based on sequences of FIGURE 14.
  misc_feature (8)..(79): Pfam Name: RRM_1 Pfam Description: RNA recognition motif (RRM, RBD, or RNP domain)
  misc_feature (1)..(152): Functional Homolog Of Ceres SEEDLINE ID no. ME04753 at SEQ ID NO: 368
MAEVEYRCFVGGLAWATTDQTLGDAFSQFGEILDSKIINDRETGRSRGFGFVTFKDEKAMRDAIEGMKGQDLDGRNITVNEAQSRGSGGGGGGGGYRGGGGGGYGGGGRREGGYGGGGGYGGGRREGGYGGGGGGGYGGGRREGGYGGGSEG

SEQ ID NO: 506 - protein, 167 aa, Citrus unshiu
  misc_feature (1)..(167): Public GI ID no.7024451
  misc_feature (1)..(167): Bit score of 331.5 for HMM based on sequences of FIGURE 14.
  misc_feature (10)..(81): Pfam Name: RRM_1 Pfam Description: RNA recognition motif (RRM, RBD, or RNP domain)
  misc_feature (1)..(167): Functional Homolog Of Ceres SEEDLINE ID no. ME04753 at SEQ ID NO: 368
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 507 - protein, 161 aa, Hordeum vulgare subsp. vulgare
  misc_feature (1)..(161): Public GI ID no.1229138
  misc_feature (1)..(161): Bit score of 302.3 for HMM based on sequences of FIGURE 14.
  misc_feature (8)..(79): Pfam Name: RRM_1 Pfam Description: RNA recognition motif (RRM, RBD, or RNP domain)
  misc_feature (1)..(161): Functional Homolog Of Ceres SEEDLINE ID no. ME04753 at SEQ ID NO: 368
MADVEYRCFVGGLRWATDDQSLQNAFSKYGDVIDSKIITDRETGRSRGFGFVTFASDEAMRQAIEAMNGQDLDGRNITVNEAQSRRSDGGGGFGGGGGGYGGQRREGGGGGYGGGGGGYGGGRSGGGGGYGSRDGGGGGYGGGGGGYGGSRGGSGGGNWRE

SEQ ID NO: 508 - protein, 173 aa, Hordeum vulgare subsp. vulgare
  misc_feature (1)..(173): Public GI ID no.728594
  misc_feature (1)..(173): Bit score of 286.7 for HMM based on sequences of FIGURE 14.
  misc_feature (8)..(79): Pfam Name: RRM_1 Pfam Description: RNA recognition motif (RRM, RBD, or RNP domain)
  misc_feature (1)..(173): Functional Homolog Of Ceres SEEDLINE ID no. ME04753 at SEQ ID NO: 368
MAETEYRCFVGGLAWATDDHNLQAAFSQYGEILDAKIINDRETGRSRGFGFVTFGSEESMRQAIEEMNGKELDGRQVTVNEAQSRRSAGGGGGGYGGQRGGGGGYGGGGGYGGQGGGYGGQGGGGYGGQGGGGYGGQRGGGGGYGGGGGGYGGGGGGYGGQRGGGDSGGQWRS

SEQ ID NO: 509 - DNA, 763 bp, Arabidopsis thaliana
  misc_feature (1)..(763): Ceres SEEDLINE ID no.ME04772
  misc_feature (1)..(763): Ceres CLONE ID no.5232
  misc_feature (1)..(763): Inplanta Sequence
  misc_feature (1)..(763): Encodes the peptide sequence at SEQ ID NO. 510
acttctgtcgtctctgcaaaaactctctatttctctttcgccggagataatgggagaagggaaggcctccactctggttttcatcctcgtcgtcgctcttagtttagtagccttcggcttctccatcgccgccgagcgccgccgcagcatcgggaaatctattcaagacccaataacaaacacaacgttctgcgtttatgactctgatgtagccactggttatggagttggagctttccttttcctcctctctagtgaatcattgcttatgagtgttaccaaatgcatgtgttttggaagacccttagcccctggaagtgaccgtgcttggtctattatctatttcatctcttcgtggatgacatttctggtagcagaagcttgtgtaatagcaggagcgaccaagaacgcataccacacaaagtacttaagttcgcaaaccttttcgtgtgcatcattgcgtaaaggaattttcattgcaggtgcagtctttatagttgctactatggttcttaatgtctactactacatgtattttaccaagtccgtctcttcgccgcctgctcacaaagccaaccgctctagttccaatattggtatggcgggttatgcataaatgtcaaaaagaggaaatggttagtcatttgcattgtagatgtaagaaaggaaagagattgttgcattgttacaacacttggttactcttatatcttttgcttatatatctcttacttatttatgaaaattttcgctatttgctctc

SEQ ID NO: 510 - protein, 188 aa, Arabidopsis thaliana
  misc_feature (1)..(188): Ceres SEEDLINE ID no.ME04772
  misc_feature (1)..(188): Ceres CLONE ID no.5232
  misc_feature (1)..(188): Bit score of 498.8 for HMM based on sequences of FIGURE 15.
  misc_feature (48)..(160): Pfam Name: DUF1218 Pfam Description: Protein of unknown function (DUF1218)
MGEGKASTLVFILVVALSLVAFGFSIAAERRRSIGKSIQDPITNTTFCVYDSDVATGYGVGAFLFLLSSESLLMSVTKCMCFGRPLAPGSDRAWSIIYFISSWMTFLVAEACVIAGATKNAYHTKYLSSQTFSCASLRKGIFIAGAVFIVATMVLNVYYYMYFTKSVSSPPAHKANRSSSNIGMAGYA

SEQ ID NO: 511 - protein, 185 aa, Gossypium barbadense
  misc_feature (1)..(185): Public GI ID no.38016521
  misc_feature (1)..(185): Bit score of 469.0 for HMM based on sequences of FIGURE 15.
  misc_feature (44)..(159): Pfam Name: DUF1218 Pfam Description: Protein of unknown function (DUF1218)
  misc_feature (1)..(185): Functional Homolog Of Ceres SEEDLINE ID no. ME04772 at SEQ ID NO: 510
MASKLLLIAVFVLDLIAFGLAVAAEQRRSTAKIVQDSEVNYNYCVYDSYISTGYGVGAFLFLMVSQALIMAASKCFCCGKGLNPSGSRAWAVILFIVCWLFFLIAEICLLAGSVRNAYHTKYRTIFSEQPPSCETVRKGVFGAGAAFIFLNAIVNKFYYICYSSARDKSFQAYGGETGVGMGTYK

SEQ ID NO: 512 - DNA, 982 bp, Gossypium hirsutum
  misc_feature (1)..(982): Ceres CLONE ID no.1895044
  misc_feature (1)..(982): Encodes the peptide sequence at SEQ ID NO 513
actgaaagcagcagctaaacaagggccgctctctttgcctcacttatcaataccctgtcagtgcctgcgtcagctcaaagcagagatgggagaaggaaagggctcaaccctagtgcaccttctggtggtagtccttagcctggtcgcatttgggtttgccattgcagccgagagaagaagaagcgttggcactgttgttaaagatgacataacaaattctacatattgtgtctacaactcggatgttgccactggctatggagtaggtgctttcttgtttcttctttctggcgaatcgctgttgatgggagttacaaagtgcatgtgttttgggaggccattagcaccgggtagtgatcgagcttggtctatcatatattttgtctcatcatggttgactttcttggttgcagaagcatgtctaatagcgggtgcaactaggaatgcttatcacaccaagtatcgtggaatgatttatgcccagaatttctcctgtgaaactttgaggaaaggtgtctttattgcaggagcagtgtttgtggttgccacaatgattctcaacgtatactactacatgtatttcgccaaagcaaccaccacaatgccggctcacaaggcaaatcgaacgaattcaactgttgggatgactggttatgcttaaggttaaattactcaattaatgaagccaggcagataagtttcacatcttgttctagtgtgacttcgattgacattgtaataaacaactgtacttgttatgtttgcgcttttccatgatgctacagctcaggtaatgaatgtatggtgtcaatggaaggagcgatagatttgttgggaacaatgtacgtaaagatcaaagaaatgtcttggggcttgacctcagatgtcagccatcgcttggcctagtgatattctacagaaactctgggaactatactatattagcaacttgttttataaggaaatttgagcttggtatatc

SEQ ID NO: 513 - protein, 191 aa, Gossypium hirsutum
  misc_feature (1)..(191): Ceres CLONE ID no.1895044
  misc_feature (1)..(191): Bit score of 530.9 for HMM based on sequences of FIGURE 15.
  misc_feature (48)..(163): Pfam Name: DUF1218 Pfam Description: Protein of unknown function (DUF1218)
  misc_feature (1)..(191): Functional Homolog Of Ceres SEEDLINE ID no. ME04772 at SEQ ID NO: 510
MGEGKGSTLVHLLVVVLSLVAFGFAIAAERRRSVGTVVKDDITNSTYCVYNSDVATGYGVGAFLFLLSGESLLMGVTKCMCFGRPLAPGSDRAWSIIYFVSSWLTFLVAEACLIAGATRNAYHTKYRGMIYAQNFSCETLRKGVFIAGAVFVVATMILNVYYYMYFAKATTTMPAHKANRTNSTVGMTGYA

SEQ ID NO: 514 - DNA, 843 bp, Populus balsamifera subsp. trichocarpa
  misc_feature (1)..(843): Ceres ANNOT ID no.1463984
  misc_feature (1)..(843): Encodes the peptide sequence at SEQ ID NO 515
atgggagagggaaaagggtcgactctggttcaccttctagtggtggttctgtgtctggttgcctttgggttcgccattgctgctgaaagacgcagaagcactgtagagaatttggctacaacctttttgacgagggtagagaagagtctcgaagttgtgacctggcagctgggctgcttcctagctaattggctttctgcatcagaactagatgatggcgtgaactggaagatggaagtagcttgcagttcactgtacttgctttcaagaagttctagaaaacagcatttaggctcaacaattagtgctttttcaggaacagcaaatccgcataagaaaacagtgatcttgtttgatatggcagtgtgcaggcagggccatattgaaaaagatgcaacaaacgctacatactgtgtctacaactctgatgttgcaactggttatggagtgggcgctttcttatttcttctttcaagtgaatcactattgatgggtgtcacaagatgcatgtgttttgggagatcactagcccctggtggagatcgagcttggtccatcatatattttgtttcatcatgggcgacttttctggtggcagaagcatgtttaattgcaggtgcacagaaaaatgcctatcataccaagtatgttgggatgatctatgctcaaaactttgcctgtgaaacattgcggaaaggtgtttttattgctggagcagtgtttgtggtggcaacaatgattctgaatgtatactactacatgtatttctccaaggctactgccaccaaggcagctctcaaaacaaatcgtacaagttctgttgggatgactggctatgcttag

SEQ ID NO: 515 - protein, 280 aa, Populus balsamifera subsp. trichocarpa
  misc_feature (1)..(280): Ceres ANNOT ID no.1463984
  misc_feature (1)..(280): Bit score of 478.0 for HMM based on sequences of FIGURE 15.
  misc_feature (138)..(253): Pfam Name: DUF1218 Pfam Description: Protein of unknown function (DUF1218)
  misc_feature (1)..(280): Functional Homolog Of Ceres SEEDLINE ID no. ME04772 at SEQ ID NO: 510
MGEGKGSTLVHLLVVVLCLVAFGFAIAAERRRSTVENLATTFLTRVEKSLEVVTWQLGCFLANWLSASELDDGVNWKMEVACSSLYLLSRSSRKQHLGSTISAFSGTANPHKKTVILFDMAVCRQGHIEKDATNATYCVYNSDVATGYGVGAFLFLLSSESLLMGVTRCMCFGRSLAPGGDRAWSIIYFVSSWATFLVAEACLIAGAQKNAYHTKYVGMIYAQNFACETLRKGVFIAGAVFVVATMILNVYYYMYFSKATATKAALKTNRTSSVGMTGYA

SEQ ID NO: 516 - DNA, 501 bp, Populus balsamifera subsp. trichocarpa
  misc_feature (1)..(501): Ceres ANNOT ID no.1512198
  misc_feature (1)..(501): Encodes the peptide sequence at SEQ ID NO 517
atggaagaaggaaaaggttcgactcttgttcaccttctggtggtggttctgagtctggtagcatttgggtttgccattgctgctgaaagacgtagaagttatggagtgggtgctttcttatttcttctttcaagtgaatcactattgatgggtatcacaaaatgcatgtgttttgggagatcattagcccctggtggagaccgagcctgggccatcatttattttgtctcttcttgggcaacttttcttgttgcagaaggatgtttaattgcaggtgcaaagaaaaatgcttatcataccaagtatcgagggatgatctatgctcaaaacttcacctgtgaaacattgcggaaaggtgtttttattgctggagcagtgtttgtggtggcaacaatgattctcaatgtatactactacatgtatttctctaaggctactgccagtaaggccgctcacaaaacaaatcgtacaagttctgtcgggatgactggcaatccttag

SEQ ID NO: 517 - protein, 166 aa, Populus balsamifera subsp. trichocarpa
  misc_feature (1)..(166): Ceres ANNOT ID no.1512198
  misc_feature (1)..(166): Bit score of 417.9 for HMM based on sequences of FIGURE 15.
  misc_feature (34)..(139): Pfam Name: DUF1218 Pfam Description: Protein of unknown function (DUF1218)
  misc_feature (1)..(166): Functional Homolog Of Ceres SEEDLINE ID no. ME04772 at SEQ ID NO: 510
MEEGKGSTLVHLLVVVLSLVAFGFAIAAERRRSYGVGAFLFLLSSESLLMGITKCMCFGRSLAPGGDRAWAIIYFVSSWATFLVAEGCLIAGAKKNAYHTKYRGMIYAQNFTCETLRKGVFIAGAVFVVATMILNVYYYMYFSKATASKAAHKTNRTSSVGMTGNP

SEQ ID NO: 518 - DNA, 423 bp, Populus balsamifera subsp. trichocarpa
  misc_feature (1)..(423): Ceres ANNOT ID no.1458932
  misc_feature (1)..(423): Encodes the peptide sequence at SEQ ID NO 519
atgggttgcactgatcccttccagtggacaatgcatagcactggtcacattgaaaaagatgcaacaaacgctacatactgtgtctacaactctgatgttgccacaggtgcaaagaaaaatgcttatcataccaagtatcgagggatgatctatgctcaaaacttcacctgtgaaacattgcggaaaggtgtttttattgctggagcagtgtttgtggtggcaacaatgattctcaatgtatactactacatgtatttctctaaggctactgccagggtcgacatagggacttggtcgttaattaaagataagtcaagagtcgaggtccagcccaggctactcagaaactgggttcatctaggatatggacctgaggcgattgtggttagggttgaatatggttgcatttacgacgttggatag

SEQ ID NO: 519 - protein, 130 aa, Populus balsamifera subsp. trichocarpa
  misc_feature (1)..(130): Ceres ANNOT ID no.1458932
  misc_feature (1)..(130): Bit score of 50.1 for HMM based on sequences of FIGURE 15.
  misc_feature (29)..(73): Pfam Name: DUF1218 Pfam Description: Protein of unknown function (DUF1218)
  misc_feature (1)..(130): Functional Homolog Of Ceres SEEDLINE ID no. ME04772 at SEQ ID NO: 510
MHSTGHIEKDATNATYCVYNSDVATGAKKNAYHTKYRGMIYAQNFTCETLRKGVFIAGAVFVVATMILNVYYYMYFSKATARVDIGTWSLIKDKSRVEVQPRLLRNWVHLGYGPEAIVVRVEYGCIYDVG

SEQ ID NO: 520 - DNA, 949 bp, Glycine max
  misc_feature (1)..(949): Ceres CLONE ID no.682503
  misc_feature (1)..(949): Encodes the peptide sequence at SEQ ID NO 521
  misc_feature (402)..(402): k is g or t/u
  misc_feature (412)..(412): s is g or c
  misc_feature (475)..(475): k is g or t/u
  misc_feature (485)..(485): w is a or t/u
  misc_feature (514)..(514): y is t/u or c
  misc_feature (627)..(627): y is t/u or c
  misc_feature (711)..(711): m is a or c
  misc_feature (719)..(719): y is t/u or c
  misc_feature (805)..(805): y is t/u or c
  misc_feature (869)..(869): y is t/u or c
acccttcaaaccgaaagtatgatacactccctccattaacgcgtgggtccaacattctctctctctccactcactttgttcacagttcacaagttttctacttccctctccccccccccctctctcatctagtcaaacaatcaaacaaactcatttagcatagacagtgaagcaggctttctctagcagctagagatggcagagggaagagggtccactctcgtgcacctcttggtcgtggttctgtgcttggtcgctttcgggttcgccattgccgccgagagaagaagaagcgtcggaaccatgcacaaaattgaaggaacaaatgaaacattctgcagctatagttcagatgttgccactggttatggagtgggcgctttcctgtttcttctttctggkgaatcactgstaatgggagtgacaaagtgcatgtgctttgggaggcccttaacacctggggtaaatcgagcgkggtccattawatattttctttcttcttgggtcacttttytggtagcagaagcttgcttgatagcaggtgcaaccaagaatgcctaccacaccaaataccgtggaatgatttatgctcataacttctcatgtgaagccttgcggaaaggtgtyttcattgccggagcggttttcgttgttgcaaccatgattcttaacgtatactattacatgtacttcacgaaggcaatgacaacmccagtttytcataaggcaaatcgggtgagctccactgttggaatggctggatatgcatgatggactatggctgaaaagggtaacaaattgagtyttaatttcagtggatatctctatgattgtcactagcaaaacggtgattttcagtttggtttttyttaggtgtttataatgtttttgtggatgttactggtcagaagcaatttatagctatatctataaatatcgtagtttaggt

SEQ ID NO: 521 - protein, 191 aa, Glycine max
  misc_feature (1)..(191): Ceres CLONE ID no.682503
  misc_feature (1)..(191): Bit score of 488.7 for HMM based on sequences of FIGURE 15.
  misc_feature (48)..(163): Pfam Name: DUF1218 Pfam Description: Protein of unknown function (DUF1218)
  misc_feature (1)..(191): Functional Homolog Of Ceres SEEDLINE ID no. ME04772 at SEQ ID NO: 510
  misc_feature (69)..(69): Xaa is any aa, unknown or other
  misc_feature (73)..(73): Xaa is any aa, unknown or other
  misc_feature (94)..(94): Xaa is any aa, unknown or other
  misc_feature (97)..(97): Xaa is any aa, unknown or other
  misc_feature (107)..(107): Xaa is any aa, unknown or other
  misc_feature (144)..(144): Xaa is any aa, unknown or other
  misc_feature (172)..(172): Xaa is any aa, unknown or other
  misc_feature (175)..(175): Xaa is any aa, unknown or other
MAEGRGSTLVHLLVVVLCLVAFGFAIAAERRRSVGTMHKIEGTNETFCSYSSDVATGYGVGAFLFLLSXESLXMGVTKCMCFGRPLTPGVNRAXSIXYFLSSWVTFXVAEACLIAGATKNAYHTKYRGMIYAHNFSCEALRKGXFIAGAVFVVATMILNVYYYMYFTKAMTXPVXHKANRVSSTVGMAGYA

SEQ ID NO: 522 - DNA, 882 bp, Triticum aestivum
  misc_feature (1)..(882): Ceres CLONE ID no.685324
  misc_feature (1)..(882): Encodes the peptide sequence at SEQ ID NO 523
ctcactttccccagcagagcaagcaaccacctcggagaggcagagcgcaatggcaatggcgtccatcctcgtgcaggtgtccgccctgctcctcaacctcatcgccttcggcctcgccgtcgccgccgagcagcgccgcagcaaggccacggtgacgccggatctggccaaggagtacgactactgcgtctacgactcggacgtcgccaccggctacggcgtcggcgcgctgctcctcctcgtcgccgcgcaggccgtcgtcatgctcgccagccgctgcttctgctgcggccgcgggctcaagccggggggctcgcgcgcctgcgccctcatgctcttcctcttctcatggttgaccttcctcgtcgcagcggcgtgtttgctggcaggatcagtccgtaatgcataccacacccggtacagggggatcttcaacggcgacccgctctcttgcgagacgctgcgcaagggcgtcttcgctgctggtgcagccttcaccttcttcaccgccatcctcagcgagttctactacatcagctactccaaatcccgggatgccgccggcggcgctccatacggcggctccagcatcggcatgggcccttacacttaaggagcttgtgtgctggaggtttatggaaaggttcagtccgtttcactttcagggcggatcatgcatatgtagttcgtggagtgcggtgttcttgtttttttttataaaggtgttcttgttaacattagagtggtagatacggtggaaatgagttcgctgtcttcactggttatgtatgagattgcctggtgtgcatccggacatttcgttgttgcagatgttgggtgtaattggtatctccaaatgatattaatatatttcatttgttc

SEQ ID NO: 523 - protein, 185 aa, Triticum aestivum
  misc_feature (1)..(185): Ceres CLONE ID no.685324
  misc_feature (1)..(185): Bit score of 453.6 for HMM based on sequences of FIGURE 15.
  misc_feature (44)..(159): Pfam Name: DUF1218 Pfam Description: Protein of unknown function (DUF1218)
  misc_feature (1)..(185): Functional Homolog Of Ceres SEEDLINE ID no. ME04772 at SEQ ID NO: 510
MASILVQVSALLLNLIAFGLAVAAEQRRSKATVTPDLAKEYDYCVYDSDVATGYGVGALLLLVAAQAVVMLASRCFCCGRGLKPGGSRACALMLFLFSWLTFLVAAACLLAGSVRNAYHTRYRGIFNGDPLSCETLRKGVFAAGAAFTFFTAILSEFYYISYSKSRDAAGGAPYGGSSIGMGPYT

SEQ ID NO: 524 - DNA, 507 bp, Zea mays
  misc_feature (1)..(507): Ceres CLONE ID no.1384414
  misc_feature (1)..(507): Encodes the peptide sequence at SEQ ID NO 525
actcacctcgtcggctctgccaagaaaaaaaagtctctatctctctcattcgcgggagttatgggagaagggaaaggctctactcttgttttcatcctcgtcatcgccctctgtttagtcgccttcggcttctccatcgccgccgaacgccgccggagcattggaaaaagtatacaagacccaataacaaatgcaacgtactgcgtttatagctctgatgtagccactggttatggagttggagctttccttttcctcctctctagtgaatcattgcttatgggtgtcaccaaatgtatgtgctttggtagacctttatcccccggaagtgaccgtgcttggtctattatctatttcatctcttcttggatgacgtttctggtagctgaagcttgtttaatagcgggagcgactaagaacgcataccacacaaagtacttgagcgcacaagccttctcgtgtgaatcgttacgcaaaggaattttcattgcaggagcagtttttacg

SEQ ID NO: 525 - protein, 188 aa, Zea mays
  misc_feature (1)..(188): Ceres CLONE ID no.1384414
  misc_feature (1)..(188): Bit score of 499.0 for HMM based on sequences of FIGURE 15.
  misc_feature (48)..(160): Pfam Name: DUF1218 Pfam Description: Protein of unknown function (DUF1218)
  misc_feature (1)..(188): Functional Homolog Of Ceres SEEDLINE ID no. ME04772 at SEQ ID NO: 510
MGEGKGSTLVFILVIALCLVAFGFSIAAERRRSIGKSIQDPITNATYCVYSSDVATGYGVGAFLFLLSSESLLMGVTKCMCFGRPLSPGSDRAWSIIYFISSWMTFLVAEACLIAGATKNAYHTKYLSAQAFSCESLRKGIFIAGAVFTVATMILNVYYYFHFTKFVFFPPTHKANRSGSNIGMAGYA

SEQ ID NO: 526 - DNA, 764 bp, Musa acuminata
  misc_feature (1)..(764): Ceres CLONE ID no.1739919
  misc_feature (1)..(764): Encodes the peptide sequence at SEQ ID NO 527
aaaggaaaggccctcttttttctggcgatctgtctaactgtggtggtggcagcggcggaaatggcggggatatcggtcatagtggttgtcgtcgtcgctttcctccacatcctcgcctttgtcctcgccatcggcgccgagatgcgccggagtaccggcaaggtggtgccggacgagtacgacgagcggactttctgcgcgtacgactcggacgcgtccacggcttacggcttgtccgcgttcggcctcctgttgctgagccaggcggtgatgagcgccgctacccgatgcctctgcttcggtcggggcctctccgccggtggcccaaggacctgtgccatcgcctcgttcgtcgtctcctggataagttttctggtggcggaagtttgcctgttggcaggatctgcaaggaatgcataccatactaagtatgtgggttactatgccaagaaggacttgtcatcctgcacagcgctccgtaagggggttttcgcagcaggagctaccttcgtgctgctttcgatgatatcctcacttctttactattggagctactccaaggctgacatgggcggatgggtgaagcaccaaaacgaaggtggtgtggggatggcagaatttggtcctgagaagagagggcttggaaacacaaatggttgaaggtttcgtctctcattgtgtaattctgtcttcgtatatccttgtcttctaaggaaccatagtttgttggatttgggataagagtaagagaaggggtttaacag

SEQ ID NO: 527 - protein, 199 aa, Musa acuminata
  misc_feature (1)..(199): Ceres CLONE ID no.1739919
  misc_feature (1)..(199): Bit score of 480.7 for HMM based on sequences of FIGURE 15.
  misc_feature (46)..(162): Pfam Name: DUF1218 Pfam Description: Protein of unknown function (DUF1218)
  misc_feature (1)..(199): Functional Homolog Of Ceres SEEDLINE ID no. ME04772 at SEQ ID NO: 510
MAGISVIVVVVVAFLHILAFVLAIGAEMRRSTGKVVPDEYDERTFCAYDSDASTAYGLSAFGLLLLSQAVMSAATRCLCFGRGLSAGGPRTCAIASFVVSWISFLVAEVCLLAGSARNAYHTKYVGYYAKKDLSSCTALRKGVFAAGATFVLLSMISSLLYYWSYSKADMGGWVKHQNEGGVGMAEFGPEKRGLGNTNG

SEQ ID NO: 528 - DNA, 845 bp, Panicum virgatum
  misc_feature (1)..(845): Ceres CLONE ID no.2002832
  misc_feature (1)..(845): Encodes the peptide sequence at SEQ ID NO 529
gggagctatccctttctttccccgtcccagacggccgagacgagagcaagcgccaccaccctagcccaggagaagagagggggccgaggaagagtgttagctatgggggatgtggggaggagctccatactggtgcacatcctggtgatcgccctctgcctggccgccttcggcttcgccatcgccgccgagcgccgccgcagcacgggttcaatagtcacggacagctccaatactacattttgtgtttatgactccgatattgctactggctatggtgttggtgctttcctgtttcttctctcaggccactcactgcttatgggtcttacgaagtgcatgtgcttcggcgcaccacttgcgccaggtggaagcagagcctggtccattatatacttcgcatcatcatgggtcacatttgcaattgcagaggcgtgcctaattgctggagcaacaaagaatgcataccacaccaagtatagggatatggtatatgctggtaactggacctgtcaatctctgcgcaaaggagtgttcattgccggagcagtctttgtggtcttcaccatgattctggacgtgtacttctacatgtactatgcaaaggccaccagccaagctgccaaaaagatcagtaagacaaccccgagcgttggcatgactggctatgcatgagcaacctaatagaattctcgcctgatagaaaaagagactatttctatttgtggtattttctgtaacactgcagtgagtgattttaggatatgacttagttttgcgtaaatgttggttactatatatgtgtattgtttgatccttgcaaaaccaaagtactcttgcgatgc

SEQ ID NO: 529 - protein, 190 aa, Panicum virgatum
  misc_feature (1)..(190): Ceres CLONE ID no.2002832
  misc_feature (1)..(190): Bit score of 493.8 for HMM based on sequences of FIGURE 15.
  misc_feature (48)..(163): Pfam Name: DUF1218 Pfam Description: Protein of unknown function (DUF1218)
  misc_feature (1)..(190): Functional Homolog Of Ceres SEEDLINE ID no. ME04772 at SEQ ID NO: 510
MGDVGRSSILVHILVIALCLAAFGFAIAAERRRSTGSIVTDSSNTTFCVYDSDIATGYGVGAFLFLLSGHSLLMGLTKCMCFGAPLAPGGSRAWSIIYFASSWVTFAIAEACLIAGATKNAYHTKYRDMVYAGNWTCQSLRKGVFIAGAVFVVFTMILDVYFYMYYAKATSQAAKKISKTTPSVGMTGYA

SEQ ID NO: 530 - protein, 218 aa, Oryza sativa subsp. indica
  misc_feature (1)..(218): Public GI ID no.125531563
  misc_feature (1)..(218): Bit score of 484.0 for HMM based on sequences of FIGURE 15.
  misc_feature (76)..(191): Pfam Name: DUF1218 Pfam Description: Protein of unknown function (DUF1218)
  misc_feature (1)..(218): Functional Homolog Of Ceres SEEDLINE ID no. ME04772 at SEQ ID NO: 510
MGDTERSSILVHILVIALCLTAFGFAIAAERRRSTVKSTYLRYILNFVFEFMDGVFFTIYIVQGSIVTDSFNSTFCVYDSDIATGYGVGAFLFLLSGQSLLMVVTKCMCFGKPLAPGGSRAWSIIYFASSWVTFMIAESCLIAGATKNAYHTRYRHMVYVGSWTCESLRKGVFIAGAVFVVFTMILNVYFYMYYTKSTSQAAKKINKTTPNVGMTGYA

SEQ ID NO: 531 - protein, 190 aa, Oryza sativa subsp. japonica
  misc_feature (1)..(190): Public GI ID no.115478344
  misc_feature (1)..(190): Bit score of 503.7 for HMM based on sequences of FIGURE 15.
  misc_feature (48)..(163): Pfam Name: DUF1218 Pfam Description: Protein of unknown function (DUF1218)
  misc_feature (1)..(190): Functional Homolog Of Ceres SEEDLINE ID no. ME04772 at SEQ ID NO: 510
MGDTERSSILVHILVIALCLTAFGFAIAAERRRSTGSIVTDSFNSTFCVYDSDIATGYGVGAFLFLLSGQSLLMVVTKCMCFGKPLAPGGSRAWSIIYFASSWVTFMIAESCLIAGATKNAYHTRYRHMVYVGSWTCESLRKGVFIAGAVFVVFTMILNVYFYMYYTKSTSQAAKKINKTTPNVGMTGYA

SEQ ID NO: 532 - DNA, 1161 bp, Arabidopsis thaliana
  misc_feature (1)..(1161): Ceres SEEDLINE ID no.ME04909
  misc_feature (1)..(1161): Ceres CLONE ID no.29302
  misc_feature (1)..(1161): Inplanta Sequence
  misc_feature (1)..(1161): Encodes the peptide sequence at SEQ ID NO. 533
accacacgattaaaccaaagagaagagagagagagagagaaacagagaagaaaagattgaagcaatcgaatggagagtgtggtggcaacatggagcagagaagaagagaaagcattcgagaacgcaattgcgttgcattgtgtagaggaagagataacagaggatcaatggaacaaaatgtcgtcaatggtaccaagcaaagccttagaagaagtaaagaaacattaccaaatccttttagaagatgtcaaagcaatcgagaatggtcaagttcctttacctcgttatcatcaccgcaaaggtctcatcgtagatgaagcagcagcagcagctacttctcctgccaacagagactctcattcctctggatcatctgagaagaaaccaaatcctggcacctccgggataagtagctccaatggaggaagaagtggtggctcgagagctgagcaagagagaagaaaagggattccatggactgaagaagagcatcggttgtttcttttgggtttggacaagtttgggaaaggagattggagaagcatttcaaggaactttgtgatctcaagaactccaacacaagttgcaagtcatgctcaaaaatacttcatcaggcttaactcgatgaaccgagatagaaggcggtctagcattcacgacatcaccactgtgaacaatcaagctcctgcggttacaggaggaggacaacaaccgcaagtggttaaacatagaccagctcagccacaaccacagccacaaccgcaaccacaacaacatcatcccccaacaatggctggattagggatgtatggtggtgcgccagtgggacaaccgatcatcgcaccacctgatcatatgggttcagctgttggaacacctgtgatgcttccacctccaatgggaactcatcatcatcaccatcaccatcatcttggagttgctccttatgctgtaccggcttatccggtaccgccattaccgcagcaacatccagctccgtcgacaatgcactgactgaaaacaatacagttggtattaaaactgacatatattgtactgaaaacttgtgtacattctcaaatcgaatagcgaaactgcggcaaataataatgtacagcagaggaatctgtttttccatttcaaatctatgattttcttccc

SEQ ID NO: 533 - protein, 314 aa, Arabidopsis thaliana
  misc_feature (1)..(314): Ceres SEEDLINE ID no.ME04909
  misc_feature (1)..(314): Ceres CLONE ID no.29302
  misc_feature (1)..(314): Bit score of 579.2 for HMM based on sequences of FIGURE 16.
  misc_feature (133)..(180): Pfam Name: Myb_DNA-binding Pfam Description: Myb-like DNA-binding domain
MESVVATWSREEEKAFENAIALHCVEEEITEDQWNKMSSMVPSKALEEVKKHYQILLEDVKAIENGQVPLPRYHHRKGLIVDEAAAAATSPANRDSHSSGSSEKKPNPGTSGISSSNGGRSGGSRAEQERRKGIPWTEEEHRLFLLGLDKFGKGDWRSISRNFVISRTPTQVASHAQKYFIRLNSMNRDRRRSSIHDITTVNNQAPAVTGGGQQPQVVKHRPAQPQPQPQPQPQQHHPPTMAGLGMYGGAPVGQPIIAPPDHMGSAVGTPVMLPPPMGTHHHHHHHHLGVAPYAVPAYPVPPLPQQHPAPSTMH

SEQ ID NO: 534 - DNA, 1058 bp, Gossypium hirsutum
  misc_feature (1)..(1058): Ceres CLONE ID no.1839156
  misc_feature (1)..(1058): Encodes the peptide sequence at SEQ ID NO 535
attggtagtatggcaggaagtgttagttggagcagggaagaagagaaggcatttgaaaacgcaatagcaatgcattggatagacaaagaggaatgtgaagagcaatgggaaaagattgcttcaacggttcctactaaaagtcttgaggaattgaagcttcactacgaattattagtggaggatgttactgcaatagaggctggtcatgttccacttccttgttataaaggagaagaaccttcctcttctgctaaggattattttcatggaccttccatggctcctaattctgataggagatccaattccggttacggaaatgggttttcggggttaacccttgattctactggacatggagggaaacagagttcgaggtccgaccaagaaagaaggaaaggaatcccatggactgaagaagagcataggttatttctacttggtttagacaagtttgggaaaggagattggagaagcatttcaaggaactttgtgatatcgagaactccgacgcaggtggctagccatgcacaaaagtattttatacgcttaaattcgatgaatagagaccggcggcggtccagcatccacgacatcacgagtgttaacaatggggatacgtctcatcaagcgcctatcaccggccaacaggctaacacaaactcacccggtgcagcggtcatggggcaatcagtgaagcacagggctcagccgcatttgccgggtttaggcatgtacggagcgcctgttgggcggccgattgctgctgctccagggcatattggatctgctgtaggaactcctgttatgcttcctcctgctcaccatcctcattcccctcctccttacattgtccctgttgcttaccccatggcaccacctcctatgcaccaataagttcaaaattcaattaatgatttaaaggtaacctaacaagttgtgtttttgtgaacatgaaaaatatgcagaaggaataaagcagatgagagaactcttcgtttttttgctgtagttatccatttttctgactgcaaaaaaggtacatgttatttgactac

SEQ ID NO: 535 - protein, 295 aa, Gossypium hirsutum
  misc_feature (1)..(295): Ceres CLONE ID no.1839156
  misc_feature (1)..(295): Bit score of 655.4 for HMM based on sequences of FIGURE 16.
  misc_feature (131)..(178): Pfam Name: Myb_DNA-binding Pfam Description: Myb-like DNA-binding domain
  misc_feature (1)..(295): Functional Homolog Of Ceres SEEDLINE ID no. ME04909 at SEQ ID NO: 533
MAGSVSWSREEEKAFENAIAMHWIDKEECEEQWEKIASTVPTKSLEELKLHYELLVEDVTAIEAGHVPLPCYKGEEPSSSAKDYFHGPSMAPNSDRRSNSGYGNGFSGLTLDSTGHGGKQSSRSDQERRKGIPWTEEEHRLFLLGLDKFGKGDWRSISRNFVISRTPTQVASHAQKYFIRLNSMNRDRRRSSIHDITSVNNGDTSHQAPITGQQANTNSPGAAVMGQSVKHRAQPHLPGLGMYGAPVGRPIAAAPGHIGSAVGTPVMLPPAHHPHSPPPYIVPVAYPMAPPPMHQ

SEQ ID NO: 536 - protein, 295 aa, Cucumis sativus
  misc_feature (1)..(295): Public GI ID no.56605378
  misc_feature (1)..(295): Bit score of 559.8 for HMM based on sequences of FIGURE 16.
  misc_feature (123)..(170): Pfam Name: Myb_DNA-binding Pfam Description: Myb-like DNA-binding domain
  misc_feature (1)..(295): Functional Homolog Of Ceres SEEDLINE ID no. ME04909 at SEQ ID NO: 533
METLYPSSHLSSSAWFVLDNPSTKWTKEENKMFESALAIYDKETPDRWFKVAALIPGKTVSDVIKQYKELEEDVCEIEAGRFPVPGYDLASSFSFEFVDDRNFDVYRRKSSVGRGSEHERKKGVPWTEEEHKQFLRGLLKYGKGDWRNISRNFVNSKTPTQVASHAQKYFMRQLSGGKDKRRPSIHDITTVNLTEPTASENEKLSSMDQFSKLPSLQKSPCYQKLLFDWNRSSNGGLLGLGSNYGDRLMSFPSGIAANGIKNEQDQELNSAYYGTYSKPHKSIFQFEPSRYQIYG

SEQ ID NO: 537 - DNA, 882 bp, Populus balsamifera subsp. trichocarpa
  misc_feature (1)..(882): Ceres ANNOT ID no.1467946
  misc_feature (1)..(882): Encodes the peptide sequence at SEQ ID NO 538
atggcaagcgtaggtacttggacgagagatgaagagaaaacttttgagaatgcaatagcgatgcattggattgatgaggattcaaatgagcaatgggaaaagattgcttcaatggtgcctagcaaaagtcttgaagagttgaaactacactacaaaatactagtagaagatgtttgtgctatagaggcaggaaacgtaccaataccaaattatgaaggagaggaagccgcttcttcaactaaggatcttcatggactttctgggacgatgactaccgttaagaaattgaattgtggttatggaagtgggtttgtggggttaggtcatgagtcatccggacatggaggcaaaggagcatcaagatcagaacaagaaagaaagaaaggtattccatggacagaagaagagcataggttatttctacttggtcttgacaagttcggcaaaggagattggagaagcatatcaagaaactttgtcatatcaagaacaccaacgcaagtggcaagccatgctcaaaaatacttcatccgattgaactcaatgaatagagataggaggaggtctagcatccatgatattacaagtttgaacaatggagatgtgtcttctcatcaagcaccaattactggtcaacaagcgaacacaagccctgctggtcccgctcctgctatgggaccgccagtgaagcataggacacaagcccatatgcctggtttagccatgtatggcccgccgcttggacacccagttgcccctcctccaggtcacatggcatcggctgttggaactccggtcatgcttcccccacctggacaccatccccaccctccatacgtggttcctgttgcttacccaacggcaccaccaaaaactgcttaa

SEQ ID NO: 538 - protein, 293 aa, Populus balsamifera subsp. trichocarpa
  misc_feature (1)..(293): Ceres ANNOT ID no.1467946
  misc_feature (1)..(293): Bit score of 657.9 for HMM based on sequences of FIGURE 16.
  misc_feature (129)..(176): Pfam Name: Myb_DNA-binding Pfam Description: Myb-like DNA-binding domain
  misc_feature (1)..(293): Functional Homolog Of Ceres SEEDLINE ID no. ME04909 at SEQ ID NO: 533
MASVGTWTRDEEKTFENAIAMHWIDEDSNEQWEKIASMVPSKSLEELKLHYKILVEDVCAIEAGNVPIPNYEGEEAASSTKDLHGLSGTMTTVKKLNCGYGSGFVGLGHESSGHGGKGASRSEQERKKGIPWTEEEHRLFLLGLDKFGKGDWRSISRNFVISRTPTQVASHAQKYFIRLNSMNRDRRRSSIHDITSLNNGDVSSHQAPITGQQANTSPAGPAPAMGPPVKHRTQAHMPGLAMYGPPLGHPVAPPPGHMASAVGTPVMLPPPGHHPHPPYVVPVAYPTAPPKTA

SEQ ID NO: 539 - protein, 307 aa, Glycine max
  misc_feature (1)..(307): Public GI ID no.110931704
  misc_feature (1)..(307): Bit score of 669.1 for HMM based on sequences of FIGURE 16.
  misc_feature (133)..(180): Pfam Name: Myb_DNA-binding Pfam Description: Myb-like DNA-binding domain
  misc_feature (1)..(307): Functional Homolog Of Ceres SEEDLINE ID no. ME04909 at SEQ ID NO: 533
MSSSGTIWSYDEEKAFENAIAMHWIEESSKEQWEKIASAVPSKSMEEVKQHYQVLVEDVSAIEAGHISFPNYASDETTSSNKDFHGSSKATSSDKRSNCNYGSGFSGLGLDSTTHSSGKGGLSRSSEQERRKGIPWTEEEHRLFLLGLDKFGKGDWRSISRNFVISRTPTQVASHAQKYFIRLNSMNRDRRRSSIHDITSVNNGDVASSQAPITGLHSSTISSNTMGVGQSLKHRVQGHIPPGLGMYGTPVGHPVAAPPGHMASAVGTPVMLPPGPHPHPHPHHHAHPHPPYVLPLAYPMAPPTMHQ

SEQ ID NO: 540 - DNA, 1430 bp, Glycine max
  misc_feature (1)..(1430): Ceres CLONE ID no.475643
  misc_feature (1)..(1430): Encodes the peptide sequence at SEQ ID NO 541
gagtgtggtcctcttgaaattgattgtttgataccactttacttcttatcctacacacattatgattcttctccttatcctgcgcatcccttcagctactttgttcaatagagacaaaagtccacacaccaaaaaatgacttacgctcccatctgctaccaatttcaccattctcatcctccaaagttgaaccataatttcaaatccaaccaagagacaccatgtcatcaagtggaaccatttggagctatgaggaagaaaaagcatttgagaatgccatagctatgcattggattgaggaatcctcaaaagagcaatgggagaaattgcttcagcagttcccagcaaaagcatggaagatgtgaagcaacattaccaggttctagtagaggatgtaagtgcaatagaggcaggtcacatatcattcccaaactatgctgcttctgaggaaatcacatcttcaaataaggactttcatggctcttccaaggccacaagctcagataaaagatcaaattgtaattatggacgtggtttttctgggttaggacatgactccaccactcatagtagtggtaaaggaggcttgtcaaggtcatcagaacaagaaagaagaaaaggaatcccatggactgaagaggaacacaggttatttttacttggtctagagaagtttggaaaaggagattggagaagcatttcaaggaactttgtgatatctaggactcccactcaagtggcaagccatgcacaaaagtacttcataaggttgaattcaatgaatagagacaggaggaggtctagtatccatgatatcactagtgtgaacaatggagatgtggctaataaccaagcacctattacagggcagcatagtagcacaattccttcaaacacaatgggtgtaggacaatcccttaagcatagagttcagggtcacataccacctggtttaggcatgtatggaacaccagttggacatcctgtggctgctcctccagggcacatggcatctgcagttggcactcctgtcatgcttcctcctggaccccacccccatgctcatcctcatccaccttatgttcttcctcttgcttacccaatggcacctccaacaatgcatcaataacaactctttttttctctttcttatttgtagttaggtttttttcttctttcttattagtatggaattaaaatcctttctgtggaaattcataaatatgttgttttaaattaaattctactcttagtttaagcaaggaaattgttgaatggatccaatggtacttagtttatgtcagtatagagttagtttaaatgccaaccccttttttccaatgtagatgtaatcctaagaattgccttgtggtgtatatggagatagatatggatttaaataccaaggaaatgaatttctctttatcatc

SEQ ID NO: 541 - protein, 270 aa, Glycine max
  misc_feature (1)..(270): Ceres CLONE ID no.475643
  misc_feature (1)..(270): Bit score of 540.3 for HMM based on sequences of FIGURE 16.
  misc_feature (102)..(149): Pfam Name: Myb_DNA-binding Pfam Description: Myb-like DNA-binding domain
  misc_feature (1)..(270): Functional Homolog Of Ceres SEEDLINE ID no. ME04909 at SEQ ID NO: 533
MGEIASAVPSKSMEDVKQHYQVLVEDVSAIEAGHISFPNYAASEEITSSNKDFHGSSKATSSDKRSNCNYGRGFSGLGHDSTTHSSGKGGLSRSSEQERRKGIPWTEEEHRLFLLGLEKFGKGDWRSISRNFVISRTPTQVASHAQKYFIRLNSMNRDRRRSSIHDITSVNNGDVANNQAPITGQHSSTIPSNTMGVGQSLKHRVQGHIPPGLGMYGTPVGHPVAAPPGHMASAVGTPVMLPPGPHPHAHPHPPYVLPLAYPMAPPTMHQ

SEQ ID NO: 542 - protein, 289 aa, Medicago truncatula
  misc_feature (1)..(289): Public GI ID no.92869601
  misc_feature (1)..(289): Bit score of 523.9 for HMM based on sequences of FIGURE 16.
  misc_feature (96)..(143): Pfam Name: Myb_DNA-binding Pfam Description: Myb-like DNA-binding domain
  misc_feature (1)..(289): Functional Homolog Of Ceres SEEDLINE ID no. ME04909 at SEQ ID NO: 533
MGRKCSHCGNIGHNSRTCNSLRGSGSFVGVRLFGVQLDLSSSCVSMKKSFSMDSFPTSSSSPTSSFSSSRLTIDDRASIGYLSDGLIVRTQERKKGVPWTEEEHRKFLVGLEKLGKGDWRGISRNYVTTRTPTQVASHAQKYFIRLATLNKKKRRSSLFDMVGSGKTNKTVDPNNSSKSKSGDSVCRHDHEVEKDATLSLLINSLQQQTKSDDYDMQKIEDDSEEAEHKDVPDWLHPLTKSLNMTLVIPNSSNVAPPDLELTLAGSKSNNMEQDKTSSSSFLIGPISVT

SEQ ID NO: 543 - protein, 310 aa, Hevea brasiliensis
  misc_feature (1)..(310): Public GI ID no.12005328
  misc_feature (1)..(310): Bit score of 631.4 for HMM based on sequences of FIGURE 16.
  misc_feature (135)..(182): Pfam Name: Myb_DNA-binding Pfam Description: Myb-like DNA-binding domain
  misc_feature (1)..(310): Functional Homolog Of Ceres SEEDLINE ID no. ME04909 at SEQ ID NO: 533
MDRGIEILSPASYLQNSNWLFPETRATKWTPEENKQFENALALYDKDEPDRWQKVAAVIPGKTVGDVIKQYRELEEDVSDIEAGLIPIPGYSSSDAFTLEWFNNNQGYDGFRHYYTPGGKRTTAARSSEQERKKGVPWTEEEHRQFLMGLQKYGKGDWRNISRNFVTTRTPTQVASHAQKYFIRQSTGGKDERRSSIHDITTVNLPDTKSPSPDEKKSSPDHSTTSLQSQPQQKMVGMAKGLIDWKPQNEGGGAAGVFSQANGNLLMAPLCGISSYGQRLQEQNLLRGTLPGYQFAPYNLIFQMQPMQRQ

SEQ ID NO: 544 - protein, 310 aa, Hevea brasiliensis
  misc_feature (1)..(310): Public GI ID no.51557078
  misc_feature (1)..(310): Bit score of 633.0 for HMM based on sequences of FIGURE 16.
  misc_feature (135)..(182): Pfam Name: Myb_DNA-binding Pfam Description: Myb-like DNA-binding domain
  misc_feature (1)..(310): Functional Homolog Of Ceres SEEDLINE ID no. ME04909 at SEQ ID NO: 533
MDRGIEILSPASYLQNSNWLFPETRATKWTPEENKQFENALALYDKDEPDRWQRVAAVIPGKTVGDVIKQYRELEEDVSDIEAGLIPIPGYSSSDAFTLEWFNNNQGYDGFRHYYTPGGKRTTAARSSEQERKKGVPWTEEEHRQFLMGLQKYGKGDWRNISRNFVTTRTPTQVASHAQKYFIRQSTGGKDKRRSSIHDITTVNLPDTKSPSPDEKKSSPDHSTTSLQSQPQQKMVGMAKGLIDWKPQNEGGGAAGVFSQANGNLLMAPLCGISSYGQKLQEQNLLRGTLPGYQFAPYNLIFQMQPMQRQ

SEQ ID NO: 545 - protein, 310 aa, Hevea brasiliensis
  misc_feature (1)..(310): Public GI ID no.84314023
  misc_feature (1)..(310): Bit score of 619.9 for HMM based on sequences of FIGURE 16.
  misc_feature (135)..(182): Pfam Name: Myb_DNA-binding Pfam Description: Myb-like DNA-binding domain
  misc_feature (1)..(310): Functional Homolog Of Ceres SEEDLINE ID no. ME04909 at SEQ ID NO: 533
MDRGIEILSPASYLQNSNWLFPETRATKWTPEENKQFENALALYDKDEPDRWQKVAAVIPGKTVGDVIKQYRELEEDVSDIEAGLIPIPGYSSSDAFTLEWFNNNQGYDGFRHYYTPGGKRTTAARSSEQERKKGVPWTEEEHRQFLMGLQKYGKGNWRNISRNFVTTRTPTQVASHAQKYFIRQSTGGKDKRRSSIHDITTVNLPDTKSPSPDEKKSSPDHSTTSLQSQPQQKMVGMAKGLIDWKPQNEGGRAAGVFSQANGNLLMAPLCGISSYGQKLQEQNLLRGTLPGYQFAPYNLIFQMRPMQRQ

SEQ ID NO: 546 - protein, 350 aa, Catharanthus roseus
  misc_feature (1)..(350): Public GI ID no.119331596
  misc_feature (1)..(350): Bit score of 629.1 for HMM based on sequences of FIGURE 16.
  misc_feature (127)..(174): Pfam Name: Myb_DNA-binding Pfam Description: Myb-like DNA-binding domain
  misc_feature (1)..(350): Functional Homolog Of Ceres SEEDLINE ID no. ME04909 at SEQ ID NO: 533
MSSSLERKKGKTVIMLRSCSQCGSNGHNSRTCGESSSAAGNGAGDGEFMLFGVRVKVDPMRKSVSMNDLSQYELPSNVNQNGVDNSKNSNDSDKVVADDVVTAGAGYVSADDAVQHQSTGGRERKRGIPWTEEEHKLFLLGLQKVGKGDWRGISRNFVKTRTPTQVASHAQKYYLRKNNLNRRRRRSSLFDITTDSVPGGLPMDDVKNHQDKSVPKVLQHSQVPHAEKPNMNGYTIAPFPLAVGPILLPVQVHNPMENKAFHWGDHQLQNGPGMLLRTVPFIPVANSSSAIRDLNLNQRVEGEPSSPLSLKLSLSSSDNSQSSSTRHSTGFQAMAATSFSKGGDSIISVA

SEQ ID NO: 547 - protein, 342 aa, Solanum tuberosum
  misc_feature (1)..(342): Public GI ID no.7705206
  misc_feature (1)..(342): Bit score of 658.3 for HMM based on sequences of FIGURE 16.
  misc_feature (101)..(148): Pfam Name: Myb_DNA-binding Pfam Description: Myb-like DNA-binding domain
  misc_feature (1)..(342): Functional Homolog Of Ceres SEEDLINE ID no. ME04909 at SEQ ID NO: 533
MTRRCSHCSTNGHNSRTCPNRGVKLFGVRLTDGLIRKSASMGNLTHFASGSGGGSTPLNGVVHDSPGDTPDHPAVGGGSADGYASEDFVAGSSSSRERKKGVPWTEEEHRMFLLGLQKLGKGDWRGIARNYVISRTPTQVASHAQKYFIRQSNMSRRKRRSSLFDIVADESGDTPMVSRDFLADDPAQAEMQSNNLLPPTPAVDEECESMGSAASANSIDGEHALPIPESSQYQHPLVYPAYVAPFYPMPYPCWPGYTAEPAIAETHEVLKPIAVHSKSPINVDELVGMSKLSLGESIGDAAKPPSLSLKLVEGSSRQSAFHANPSSGSSGMNSSHNPIHAV

SEQ ID NO: 548 - protein, 307 aa, Antirrhinum majus
  misc_feature (1)..(307): Public GI ID no.18874263
  misc_feature (1)..(307): Bit score of 612.0 for HMM based on sequences of FIGURE 16.
  misc_feature (131)..(178): Pfam Name: Myb_DNA-binding Pfam Description: Myb-like DNA-binding domain
  misc_feature (1)..(307): Functional Homolog Of Ceres SEEDLINE ID no. ME04909 at SEQ ID NO: 533
MEILAPSSYFSSSSWFLEESRSTTRWTAAENKAFENALAVFDENTPNRWERVAERVPGKTVGDVMRQYKELEDDVSSIEAGFVPVPGYSTSSPFTLEWGSGHGFDGFKQSYGTGGRKSSSGRPSEQERKKGVPWTEEEHKLFLMGLKKYGKGDWRNISRNFVITRTPTQVASHAQKYFIRQLSGGKDKRRASIHDITTVNLSDNQTPSPDNKKPPSSPDHSMAQQQTSSTSIHKLPFQWDQTSNETIMGFASSGHHGNMFQSNPFGMNSYGFKMQGQQMQRGGFCDTYLGSQNMAFQMQSGLHFPNA

SEQ ID NO: 549 - DNA, 1341 bp, Triticum aestivum
  misc_feature (1)..(1341): Ceres CLONE ID no.753605
  misc_feature (1)..(1341): Encodes the peptide sequence at SEQ ID NO 550
ctcccttttcgcgaaacccccgatttattccccacgagcccgcagcgacaccaaatccgcctcttcctcccgaccttcctccccccgtcccccactccttatcccgccgccgcaatccgtccggccgactgccgccccgcgagccccgcggagcgctgtcaaggttgcttttttcctcttctttcgctcggggaacaggtccgcggccggccatggcggcggaagaggcgagcagcagcggcgggggtgaggaggggtccggcgccggggccggcgggtggacgcgggagcaggagaaggcgttcgagaacgcgctggccacggtggacgaggaggaaggggaggccatgtgggacaagatagccgacgccgtcgagggcaagacgcccgaggaggtccggcggcactacgagctgctcgtggaggacgtggacggcatcgaggccggccgcgtgccgctgctcgtctacgccggcgacggcgacgaggggggctccggcgggggggctgggggcagcggcggcggcgggggcgggggcgggaagaagagcggcggaggagggggagggcacggggagaagggctcgtccaagtccgccgagcaggagcgccgcaaggggatcgcctggaccgaggacgagcacaggttgttccttcttggacttgaaaagtatggcaaaggtgactggaggagcatctcaaggaacttcgtgatctcaaggacgcccactcaggtcgccagtcacgcccagaagtacttcatccgcctcaactcgatgaacagggagaggcggcgatcaagcattcacgacatcaccagcgtgaacggagaggcatcagctgctcagggcccaatcacaggcacaaatgggcaggccgcagtccctggcaagtcccccaagcaatctccgcaccagccagggaacctgcctccaggcgtggacgccttcggcaccaccatcgggcagccggtgggcggccccctcgtgtccgccgtcggcaccccggtcacgctccctgtcgccgccccgcctcacatgggatacgccatgcacgccccggtcccagggaccgtggtgccccgggctccgatgtacccgatgccgcccccaccgtcccggtgatgggcccgtgctacaaaatagacgttgttaagcgatgctgctgggcttcctgacagaccaactcagaaccttctccatgttgtccggccttgcagtgaaatgctctgttatgtctgaataaaggaataacgataaacccttgtacattaccgatggtgttgtggacgttgtggattatatgtaatcgtgacgcgtttcgtcgtcgtcgttcgatgtt

SEQ ID NO: 550 - protein, 303 aa, Triticum aestivum
  misc_feature (1)..(303): Ceres CLONE ID no.753605
  misc_feature (1)..(303): Bit score of 567.5 for HMM based on sequences of FIGURE 16.
  misc_feature (136)..(183): Pfam Name: Myb_DNA-binding Pfam Description: Myb-like DNA-binding domain
  misc_feature (1)..(303): Functional Homolog Of Ceres SEEDLINE ID no. ME04909 at SEQ ID NO: 533
MAAEEASSSGGGEEGSGAGAGGWTREQEKAFENALATVDEEEGEAMWDKIADAVEGKTPEEVRRHYELLVEDVDGIEAGRVPLLVYAGDGDEGGSGGGAGGSGGGGGGGGKKSGGGGGGHGEKGSSKSAEQERRKGIAWTEDEHRLFLLGLEKYGKGDWRSISRNFVISRTPTQVASHAQKYFIRLNSMNRERRRSSIHDITSVNGEASAAQGPITGTNGQAAVPGKSPKQSPHQPGNLPPGVDAFGTTIGQPVGGPLVSAVGTPVTLPVAAPPHMGYAMHAPVPGTVVPRAPMYPMPPPPSR

SEQ ID NO: 551 - DNA, 1254 bp, Zea mays
  misc_feature (1)..(1254): Ceres CLONE ID no.291733
  misc_feature (1)..(1254): Encodes the peptide sequence at SEQ ID NO 552
cagaagccaaattggtgctcctcttatctcgccgcgccgccaccgctccatttccgctcccccagcccccccaaaagaacctcgtaaccctactcgcgggattccgcaggccgccgcttgcttagggttcatcactcctgttcacacccgatggccgtgaacgaggcgagcagcagtggcggtggggaggaggggtgcgggtcgtggacccgcgagcaggagaaggcgttcgagaacgcggtggcgacgatgggcggggaggaggacggggacgcgaggtgggagaagctagcggaggccgtcgaggggaagacgccggaggaggtcaggcggcactacgagctgctggtggaggacgtcgacggcatcgagtcgggccgcgtcccgcttccggcgtacgcggctgacggcgctgccgaggaagggggcggtggcgggaagaagggaagtggcggaggagggacccatggggacaagcggtcggcgaagtccgccgagcaggagcgtaggaagggcatcgcctggacagaggacgagcacagattgttcctccttggacttgaaaagtatggcaaaggtgactggcggagcatctcgcggaactttgtgatctcaaggacgccgactcaagtagctagtcatgcacagaagtactttatccgtctgaactcaatgaacagagaaaggcggcgatcaagtatacatgacatcaccagtgtgaacaatggagatccatctactgcacagggtccaatcacaggccaaacaaatggtcaggctgcaaatcctggaaaaccatctaagcaatccccgcagccagcgaatacacctccaggcgtcgatgcttatggcacaacaattggacagccagttggtggcccccttgtctcagctgttggaactcccgttacactacctgtttccgctccacctcatctggcctatggcatgcgtgccccggttccaggagccgtagtacctggtgctccagtaaacattgctccgatgccctatccaatgccacccccaccatctcatgggtgacagggtgagggacacatttcaaatgctgtgtagcgtctaaacaaacccataatctccccctatgccagcattttgcgggtgtgctgctatgtctcaataaagcaatgccaataaacccttgtacattacaaactgttgtcacatgttgcattgaggacattgcagattgtgtactttgtgttgcatgcaaactttttcatgtacatctcc

SEQ ID NO: 552 - protein, 297 aa, Zea mays
  misc_feature (1)..(297): Ceres CLONE ID no.291733
  misc_feature (1)..(297): Bit score of 596.4 for HMM based on sequences of FIGURE 16.
  misc_feature (16)..(67): Pfam Name: Myb_DNA-binding Pfam Description: Myb-like DNA-binding domain
  misc_feature (1)..(297): Functional Homolog Of Ceres SEEDLINE ID no. ME04909 at SEQ ID NO: 533
MAVNEASSSGGGEEGCGSWTREQEKAFENAVATMGGEEDGDARWEKLAEAVEGKTPEEVRRHYELLVEDVDGIESGRVPLPAYAADGAAEEGGGGGKKGSGGGGTHGDKRSAKSAEQERRKGIAWTEDEHRLFLLGLEKYGKGDWRSISRNFVISRTPTQVASHAQKYFIRLNSMNRERRRSSIHDITSVNNGDPSTAQGPITGQTNGQAANPGKPSKQSPQPANTPPGVDAYGTTIGQPVGGPLVSAVGTPVTLPVSAPPHLAYGMRAPVPGAVVPGAPVNIAPMPYPMPPPPSHG

SEQ ID NO: 553 - protein, 306 aa, Oryza sativa subsp. japonica
  misc_feature (1)..(306): Public GI ID no.21902114
  misc_feature (1)..(306): Bit score of 575.7 for HMM based on sequences of FIGURE 16.
  misc_feature (141)..(188): Pfam Name: Myb_DNA-binding Pfam Description: Myb-like DNA-binding domain
  misc_feature (1)..(306): Functional Homolog Of Ceres SEEDLINE ID no. ME04909 at SEQ ID NO: 533
MTSQAATTTTTAAAAAAWTREDDKAFENALAACAAPPPADGGAPDDDWFAALAASVPGARSAEEVRRHYEALVEDVAAIDAGRVPLPRYAGEESAAPPDGAGAAAAASKDGGHRRDERKGGGGGYDGGKSCSKAEQERRKGIPWTEEEHRLFLLGLDKFGKGDWRSISRNFVISRTPTQVASHAQKYFIRLNSMNRDRRRSSIHDITSVTAGDQVAAQQGAPITGHQATGNPAAAALGPPGMKHHHHHHPGGAPPPMPMYSAAPMGHPVAGHMVPAAVGTPVVFPPGHAPYVVPVGYPAPPAKMHQ

SEQ ID NO: 554 - protein, 284 aa, Oryza sativa subsp. japonica
  misc_feature (1)..(284): Public GI ID no.115437140
  misc_feature (1)..(284): Bit score of 524.8 for HMM based on sequences of FIGURE 16.
  misc_feature (119)..(166): Pfam Name: Myb_DNA-binding Pfam Description: Myb-like DNA-binding domain
  misc_feature (1)..(284): Functional Homolog Of Ceres SEEDLINE ID no. ME04909 at SEQ ID NO: 533
MTSQAATTTTTAAAAAAWTREDDKAFENALAASVPGARSAEEVRRHYEALVEDVAAIDAGRVPLPRYAGEESAAPPDGAGAAAAASKDGGHRRDERKGGGGGYDGGKSCSKAEQERRKGIPWTEEEHRLFLLGLDKFGKGDWRSISRNFVISRTPTQVASHAQKYFIRLNSMNRDRRRSSIHDITSVTAGDQVAAQQGAPITGHQATGNPAAAALGPPGMKHHHHHHPGGAPPPMPMYSAAPMGHPVAGHMVPAAVGTPVVFPPGHAPYVVPVGYPAPPAKMHQ

SEQ ID NO: 555 - DNA, 441 bp, Arabidopsis thaliana
  misc_feature (1)..(441): Ceres SEEDLINE ID no.ME05033
  misc_feature (1)..(441): Ceres CLONE ID no.93971
  misc_feature (1)..(441): Inplanta Sequence
  misc_feature (1)..(441): Encodes the peptide sequence at SEQ ID NO. 556
gaagatgattaccttggaagaagatctacgatgagcagagagcttgaaggaacatggtacagaagccattctttctttcgttctatgttctgtttcgactttcgagtgggagaaaatggataagacgaagaagattaacgagcggctctccggtcaccaccttcctcgtcgggagattcaaaggaggattctccgatcggaagagcgaggaaaatgacggaaagatttaacgagttttggcaaagtttgatcaatcgttctgggttatatcagcgcaactacgaattaggtatgtaacacgaatctaatttgccttttttgatctgagaatttcctctttcgtttggtagtgagtttctgttggatcatgatagtgttacactgtgacaatacctaagatgctagtgataacccgtatgagtttgcttcattgtcaggatt

SEQ ID NO: 556 - protein, 58 aa, Arabidopsis thaliana
  misc_feature (1)..(58): Ceres SEEDLINE ID no.ME05033
  misc_feature (1)..(58): Ceres CLONE ID no.93971
MVQKPFFLSFYVLFRLSSGRKWIRRRRLTSGSPVTTFLVGRFKGGFSDRKSEENDGKI

SEQ ID NO: 557 - DNA, 1596 bp, Arabidopsis thaliana
  misc_feature (1)..(1596): Ceres SEEDLINE ID no.ME05194
  misc_feature (1)..(1596): Ceres CLONE ID no.DNA12669619_CDNA
  misc_feature (1)..(1596): Inplanta Sequence
  misc_feature (1)..(1596): Encodes the peptide sequence at SEQ ID NO. 558
atgacatctctaacaactcaaaccctaatcatcaccatttttcttcttacaatcccaacatccttcgcatcaccaccatcactcgaagacgttttcgcacaatgcgtcaccgattttaaaccttcaaatccaaaatccccaatccaaaactacatatacactcaacgaagccctaatttcctcacaatccttaacaactacgtccgtaaccttcgttacttcaacaacatgacacgtaaacccgtagcgattgtagctgccgcggatgtcactcacatccaggctacaatcacttgcgccaagaaactcggtctccagctccggatccgcagtggaggacatgactacgacggtatgtcgtatttatcaaccattgatttcgttgtcctagacatgttcaatctccggtctatcaatatagatcctaaactcgacaccgcgtgggtccaatccggtgctacgcttggagagatctactacggagtcgccaacaaaagcaatgacctccgtggatttcctgccggaatctgtcctggtttaggcgctggtggacattttagcggtggaggttacggaaacatgatgaggaaatacggtttatcgatcgataacattatagacgctaagatcgttgacgctaaaggaaaagttttggaccggagctcaatgggagaagatcttttctgggccttacgtggtggtggagctgctagtttctgtgttgtcttagcttggaagattaagcttgttccggttccagctaaagtcacagtctttaacattgaaacgtttggaaacacaggaagcgtgaacaccacggaacttgtagccaaatggcaagagatcgcagacaagattgacaatgatctgttcataagattaactttaggctcaagcaacaaaaccgtgaaggcttctttcatgggaatgtacctcggaaactcatcgaatcttctagaaatcatgaacgcgaaattccctgagcttggtctgatcaaaagagagtgtattgaaatgaaatggatcgaatcggttctgttctggctcggtatcccacccggtacagcaccaacaacgagtatgcgaaaccggatcccacaaaagcaaatctacctcaagagaaaatccgattacgtccaaaaaccgatttcacgaaccggtttagagtcaatattcaagatcatgacagagaacgagaacgtcacaatggcttttaacccttacggagggaggatgagtgagattccatcgaccgagaccgctttccctcacagagcaggaaacatgttcaagattcagtacgcagcaaactggttcgtgccaggtgaagcagtggctaaagattgcttgagccagacagaaagattgttcgaggcaatgagcccttacgtgtcaaagaatccaagagaggcgtttttgaactatagagacgttgacattggaaagagcttaaactcaacgtacgaggaaggtaaagtgtacggatttaagtattttaaggataacttcgagaaattggttaagatcaagagcagagttgatcccgacaactttttccggtacgagcagagcattccagtgctctccagccactag

SEQ ID NO: 558 - protein, 531 aa, Arabidopsis thaliana
  misc_feature (1)..(531): Ceres SEEDLINE ID no.ME05194
  misc_feature (1)..(531): Ceres CLONE ID no.DNA12669619_CDNA
  misc_feature (1)..(531): Bit score of 1252.3 for HMM based on sequences of FIGURE 17.
  misc_feature (471)..(526): Pfam Name: BBE Pfam Description: Berberine and berberine like
  misc_feature (81)..(221): Pfam Name: FAD_binding_4 Pfam Description: FAD binding domain
MTSLTTQTLIITIFLLTIPTSFASPPSLEDVFAQCVTDFKPSNPKSPIQNYIYTQRSPNFLTILNNYVRNLRYFNNMTRKPVAIVAAADVTHIQATITCAKKLGLQLRIRSGGHDYDGMSYLSTIDFVVLDMFNLRSINIDPKLDTAWVQSGATLGEIYYGVANKSNDLRGFPAGICPGLGAGGHFSGGGYGNMMRKYGLSIDNIIDAKIVDAKGKVLDRSSMGEDLFWALRGGGAASFCVVLAWKIKLVPVPAKVTVFNIETFGNTGSVNTTELVAKWQEIADKIDNDLFIRLTLGSSNKTVKASFMGMYLGNSSNLLEIMNAKFPELGLIKRECIEMKWIESVLFWLGIPPGTAPTTSMRNRIPQKQIYLKRKSDYVQKPISRTGLESIFKIMTENENVTMAFNPYGGRMSEIPSTETAFPHRAGNMFKIQYAANWFVPGEAVAKDCLSQTERLFEAMSPYVSKNPREAFLNYRDVDIGKSLNSTYEEGKVYGFKYFKDNFEKLVKIKSRVDPDNFFRYEQSIPVLSSH

SEQ ID NO: 559 - protein, 538 aa, Eschscholzia californica
  misc_feature (1)..(538): Public GI ID no.400972
  misc_feature (1)..(538): Bit score of 1157.1 for HMM based on sequences of FIGURE 17.
  misc_feature (455)..(517): Pfam Name: BBE Pfam Description: Berberine and berberine like
  misc_feature (71)..(210): Pfam Name: FAD_binding_4 Pfam Description: FAD binding domain
  misc_feature (1)..(538): Functional Homolog Of Ceres SEEDLINE ID no. ME05194 at SEQ ID NO: 558
MENKTPIFFSLSIFLSLLNCALGGNDLLSCLTFNGVRNHTVFSADSDSDFNRFLHLSIQNPLFQNSLISKPSAIILPGSKEELSNTIRCIRKGSWTIRLRSGGHSYEGLSYTSDTPFILIDLMNLNRVSIDLESETAWVESGSTLGELYYAITESSSKLGFTAGWCPTVGTGGHISGGGFGMMSRKYGLAADNVVDAILIDANGAILDRQAMGEDVFWAIRGGGGGVWGAIYAWKIKLLPVPEKVTVFRVTKNVAIDEATSLLHKWQFVAEELEEDFTLSVLGGADEKQVWLTMLGFHFGLKTVAKSTFDLLFPELGLVEEDYLEMSWGESFAYLAGLETVSQLNNRFLKFDERAFKTKVDLTKEPLPSKAFYGLLERLSKEPNGFIALNGFGGQMSKISSDFTPFPHRSGTRLMVEYIVAWNQSEQKKKTEFLDWLEKVYEFMKPFVSKNPRLGYVNHIDLDLGGIDWGNKTVVNNAIEISRSWGESYFLSNYERLIRAKTLIDPNNVFNHPQSIPPMANFDYLEKTLGSDGGEVVI

SEQ ID NO: 560 - protein, 545 aa, Cannabis sativa
  misc_feature (1)..(545): Public GI ID no.81158002
  misc_feature (1)..(545): Bit score of 1274.4 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIIFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 561 - protein, 545 aa, Cannabis sativa
  misc_feature (1)..(545): Public GI ID no.81158004
  misc_feature (1)..(545): Bit score of 1268.0 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFNIQISIANPQENFLKCFSEYIPNNPANPKFIYTQHDQLYMSVLNSTIQNLRFTSDATPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 562 - protein, 545 aa, Cannabis sativa
  misc_feature (1)..(545): Public GI ID no.81157984
  misc_feature (1)..(545): Bit score of 1271.1 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 563 - protein, 545 aa, Cannabis sativa
  misc_feature (1)..(545): Public GI ID no.81158006
  misc_feature (1)..(545): Bit score of 1269.1 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFNIQISLANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 564 - protein, 545 aa, Cannabis sativa
  misc_feature (1)..(545): Public GI ID no.81157996
  misc_feature (1)..(545): Bit score of 1265.7 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFNIQISLANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAAWKIKLVVVPSKATIFSVKKNMEIRGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 565 - protein, 545 aa, Cannabis sativa
  misc_feature (1)..(545): Public GI ID no.26005814
  misc_feature (1)..(545): Bit score of 1233.3 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 566 - protein, 545 aa, Cannabis sativa
  misc_feature (1)..(545): Public GI ID no.81157990
  misc_feature (1)..(545): Bit score of 1265.2 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDSHLVNVDGKVLDRKSMGEDLFWAIRGGGGENFGIIAAWKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 567 - protein, 545 aa, Cannabis sativa
  misc_feature (1)..(545): Public GI ID no.81157982
  misc_feature (1)..(545): Bit score of 1233.1 for HMM based on sequences of FIGURE 17.
  misc_feature (480)..(538): Pfam Name: BBE Pfam Description: Berberine and berberine like
  misc_feature (81)..(220): Pfam Name: FAD_binding_4 Pfam Description: FAD binding domain
  misc_feature (1)..(545): Functional Homolog Of Ceres SEEDLINE ID no. ME05194 at SEQ ID NO: 558
MNCSAFSFWFVCKIIFFFLSFHIQISIANPRENFLKCFSKHIPNNVANPKLVYTQHDQLYMSLLNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 568 - DNA, 1764 bp, Gossypium hirsutum
  misc_feature (1)..(1764): Ceres CLONE ID no.1834135
  misc_feature (1)..(1764): Encodes the peptide sequence at SEQ ID NO 569
atgtgaagatcaagcttatactcgaacaaatgccccaagaaaatatcaaacactacaatgccgaatccaatgcgtccgtaccttattctatccgtagttttcttcttcaacctgtatcattcaatggcggttccagatcctactcatcaagcccttcttcaatgtttaacccaatccattcccactgacacagcttcctccattatagtctctaaatccaacccttcatatacttctgttctacgtgcttacattcgaaacgcccgtttcaacacttcttcaacccctaaaccactcatcatcatcactcctttagatgaatcccatgtttccgccgccgttatttgttcccaaaaacttgggtttcaactcaaaatccgtagcggcggtcatgattatgaagggttgtcttatgtttttgataaccccttttttgttctcgatatgtttaatctccggtcaataacggttaatatggctgatgaaacagcttgggtcggtgctggtgctacactcggtgaactttattataacatttggaaaaatagtaaagttcatggttttccggcgggggtttgtcctactgttggcgttggtggtcatttaagcggtgctgggtatggtactttgataagaaagtacggtttgtcggtggaccatgtcgtggatgctaaattagtcgacgtgaacggaaaaatccttgaccggaaaaccatgggggaggaccttttttgggctataagaggcggcggagcagccagtttcggcgttgttttatcttataaaataaaactcgtccctgtaccggaaaccgtcaccgttttcagaatcgaaagattattaactgaaaacgccaccgatataacattcaaatggcaaaccattgctccgacgaccgacgagaatctgttcatgagaatgcttttacaaccggtgacgagaaacaagaaaaaaacggcgagaatctctgtaatcgctttgtatttgggagattccgatagtctcgtatctcttctacaaaaagatttcccggaattatccatcggaaaatcaaactgtaatgaaacaacatggatcgattcagttctatggtgggctaatttcaatttaggtacaccaccgacggctttactcgatcgggatcttaacgacgccggttttctaaaacgaaaatcagattatgttcagaccccaatccctaaatctgggttagaatcactttggcaaaaaatgatcgaactcggcaaagtcgggatggttttcaatgcttacggcggcagaatggaccaaatcaaacccgatgaaacgccgttcccccaccgtgccggaaacctgtataaaattcaatactcagtgaactgggatcaacctggaagtgaagcagataagaatttcacaactcaagctaaattacttcatgattttatgacaccgtttgtgtctaaaaatccaaggagtgcttatttcaattatagagatattgatgttggatctactaaaaaatggagttatgaagaagggaaagtttatggagaaagttattttaatgggaattatgaaagattggttgatgtgaagactgccgttgatgctaataatttctttaggaatgaacagagtataccacctcgatcaagtaagatttagacacccaatttagcaattgtttcccaacatttatgtataacatagtttttctttctttttctaataatacaatgttctcgaggggttttattggtaataatttattttatatttttc

SEQ ID NO: 569 - protein, 529 aa, Gossypium hirsutum
  misc_feature (1)..(529): Ceres CLONE ID no.1834135
  misc_feature (1)..(529): Bit score of 1303.8 for HMM based on sequences of FIGURE 17.
  misc_feature (468)..(523): Pfam Name: BBE Pfam Description: Berberine and berberine like
  misc_feature (79)..(218): Pfam Name: FAD_binding_4 Pfam Description: FAD binding domain
  misc_feature (1)..(529): Functional Homolog Of Ceres SEEDLINE ID no. ME05194 at SEQ ID NO: 558
MPNPMRPYLILSVVFFFNLYHSMAVPDPTHQALLQCLTQSIPTDTASSIIVSKSNPSYTSVLRAYIRNARFNTSSTPKPLIIITPLDESHVSAAVICSQKLGFQLKIRSGGHDYEGLSYVFDNPFFVLDMFNLRSITVNMADETAWVGAGATLGELYYNIWKNSKVHGFPAGVCPTVGVGGHLSGAGYGTLIRKYGLSVDHVVDAKLVDVNGKILDRKTMGEDLFWAIRGGGAASFGVVLSYKIKLVPVPETVTVFRIERLLTENATDITFKWQTIAPTTDENLFMRMLLQPVTRNKKKTARISVIALYLGDSDSLVSLLQKDFPELSIGKSNCNETTWIDSVLWWANFNLGTPPTALLDRDLNDAGFLKRKSDYVQTPIPKSGLESLWQKMIELGKVGMVFNAYGGRMDQIKPDETPFPHRAGNLYKIQYSVNWDQPGSEADKNFTTQAKLLHDFMTPFVSKNPRSAYFNYRDIDVGSTKKWSYEEGKVYGESYFNGNYERLVDVKTAVDANNFFRNEQSIPPRSSKI

SEQ ID NO: 570 - DNA, 2112 bp, Populus balsamifera subsp. trichocarpa
  misc_feature (1)..(2112): Ceres ANNOT ID no.1467218
  misc_feature (1)..(2112): Encodes the peptide sequence at SEQ ID NO 571
atgaagagtccttttgtgttcttttcagttcttctgatttcagtttcattgccaaactcgattgcacttccagacaactttctgcaatgtcttacagaaaattctcagcctacaaatcccatttctgatgctatccatactcctgacaatccttcattcacaacagttttgcagtcttatgccagaaacctaaggttcctgacgctttcaacaccaaaaccccttgctatcatagccgcgaagcacgaatcccatgtccaagcaaccattatttgttctaaaaaacttggcttgcagatcagaattcggagtggcggtcacgattatgatggactttcgtatgtttctgatgtcgcttttattattcttgatatgttcaatcttcgatcgatcaatattgatattgaagatgaaagtgcttgggttcaggctggagcgactcttggcgaagtttattatagaattgcagagaaaagcaatgtccatggatttcctgcaggtgtctgtcctacactaggcgttgggggacacttttcaggtggtggatatggcaatatgatgagaaaatatggcctgtcagttgacaatatagttgatgcacaaataattgatgtcaggggaaggattcttgatagaaaatctatgggagaagatctcttttgggccattagaggaggaggtgcagcaagctttggagtcatcctttcctggaaaataaaattggttccagtcccggaaattgtcacagtttttagtgttgacagaactctggaggagggtgttagtgacctcgcttggaagtggcaacagattgcagctgataaactagataatgatctcttcataagattgatgctacagcctgtaaatggaactcaagaagggaagaaaactatacaggcatccttcgttgccatgtttcttggccgagcagaaagactcctttcggtgatgaatgaaagcttccctgaattaggcttacaggcgaaggactgcgctgaaatgagatggatcgaatctgtcctgtcttgggtcggcatgcctaaaggaactcccattgaagttttacttgacaggattccaaagggtgtgagctatctgaaacggaaatcagactatgttaaagaacctatttcaaaggaaggtttggaatccatttggaaggttatgactgaggttggagaagtggcaatgctctggaatccttatggtggaaaaatgagtgagatttcggagacggaaactgcattcccgcatagagctggaaacatattcaagatccaatattctgtgaattggaagcaagaaggaattgacaccaccaaccattatgtcaatttgacaagaactctctttgaagccatgactccttatgtctcaaagaacccgagggaagcattcctcaactaccgtgatatcgacattggtagcattggcagccatggaaatgggacattccaggaagcaagtgtttatgggcataagtacttcaaggataactttgacagattagtgcaaattaagacaagggttgatcctgataactttttcgggtatgaacaaagtattccaactcaatcatcatcttacaggccagatctgtgtgcctggcagcagccccgaaaacggacacttggcgccaggaccagtgagcgagcatggcagcagcaccaggctgcagacacgtggcgcagggctgtcatgccctatgggctaggtaaactcgcacgtcttgctaaacacccgaagagaaggtttacaggcccgcccgcatgggtttgcagacacgtgctttgggtgcagaccccgacgagcgggtctgcagccacgcgagcttggggtatgtgcccagcgttgttgactctgcagacttgggcgctgggtgcagactcgcacgctagagtcaattgtgatccgcaccttagccggacccaagaagaatatattaaattgggtcctgcccagcaagacccgttcaagttaggttctgccctagaaggacccaaaatagcgcggctagacccattagctttggctcttgttgctctgatgggtcctgtcctaagcaagacccatcagcgttctttaaaaaaaaaaatttctctcatgtaa

SEQ ID NO: 571 - protein, 703 aa, Populus balsamifera subsp. trichocarpa
  misc_feature (1)..(703): Ceres ANNOT ID no.1467218
  misc_feature (1)..(703): Bit score of 1345.1 for HMM based on sequences of FIGURE 17.
  misc_feature (466)..(524): Pfam Name: BBE Pfam Description: Berberine and berberine like
  misc_feature (74)..(213): Pfam Name: FAD_binding_4 Pfam Description: FAD binding domain
  misc_feature (1)..(703): Functional Homolog Of Ceres SEEDLINE ID no. ME05194 at SEQ ID NO: 558
MKSPFVFFSVLLISVSLPNSIALPDNFLQCLTENSQPTNPISDAIHTPDNPSFTTVLQSYARNLRFLTLSTPKPLAIIAAKHESHVQATIICSKKLGLQIRIRSGGHDYDGLSYVSDVAFIILDMFNLRSINIDIEDESAWVQAGATLGEVYYRIAEKSNVHGFPAGVCPTLGVGGHFSGGGYGNMMRKYGLSVDNIVDAQIIDVRGRILDRKSMGEDLFWAIRGGGAASFGVILSWKIKLVPVPEIVTVFSVDRTLEEGVSDLAWKWQQIAADKLDNDLFIRLMLQPVNGTQEGKKTIQASFVAMFLGRAERLLSVMNESFPELGLQAKDCAEMRWIESVLSWVGMPKGTPIEVLLDRIPKGVSYLKRKSDYVKEPISKEGLESIWKVMTEVGEVAMLWNPYGGKMSEISETETAFPHRAGNIFKIQYSVNWKQEGIDTTNHYVNLTRTLFEAMTPYVSKNPREAFLNYRDIDIGSIGSHGNGTFQEASVYGHKYFKDNFDRLVQIKTRVDPDNFFGYEQSIPTQSSSYRPDLCAWQQPRKRTLGARTSERAWQQHQAADTWRRAVMPYGLGKLARLAKHPKRRFTGPPAWVCRHVLWVQTPTSGSAATRAWGMCPALLTLQTWALGADSHARVNCDPHLSRTQEEYIKLGPAQQDPFKLGSALEGPKIARLDPLALALVALMGPVLSKTHQRSLKKKISLM

SEQ ID NO: 572 - protein, 531 aa, Arabidopsis thaliana
  misc_feature (1)..(531): Public GI ID no.15221474
  misc_feature (1)..(531): Bit score of 1254.1 for HMM based on sequences of FIGURE 17.
  misc_feature (471)..(526): Pfam Name: BBE Pfam Description: Berberine and berberine like
  misc_feature (81)..(221): Pfam Name: FAD_binding_4 Pfam Description: FAD binding domain
  misc_feature (1)..(531): Functional Homolog Of Ceres SEEDLINE ID no. ME05194 at SEQ ID NO: 558
MTSLTTQTLIITIFLLTIPTSFASPPSLEDVFAQCVTDFKPSNPKSPIQNYIYTQRSPNFLTILNNYVRNLRYFNNMTRKPVAIVAAADVTHIQATITCAKKLGLQLRIRSGGHDYDGMSYLSTIDFVVLDMFNLRSINIDPKLDTAWVQSGATLGEIYYGVANKSNDLRGFPAGICPGLGAGGHFSGGGYGNMMRKYGLSIDNIIDAKIVDAKGRVLDRSSMGEDLFWALRGGGAASFCVVLAWKIKLVPVPAKVTVFNIETFGNTGSVNTTELVAKWQEIADKIDNDLFIRLTLGSSNKTVKASFMGMYLGNSSNLLEIMNAKFPELGLIKRECIEMKWIESVLFWLGIPPGTAPTTSMLNRIPQKQIYLKRKSDYVQKPISRTGLESIFKIMTENENVTMAFNPYGGRMSEIPSTETAFPHRAGNMFKIQYAANWFVPGEAVAKDCLSQTERLFEAMSPYVSKNPREAFLNYRDVDIGKSLNSTYEEGKVYGFKYFKDNFEKLVKIKSRVDPDNFFRYEQSIPVLSSH

SEQ ID NO: 573 - protein, 527 aa, Arabidopsis thaliana
  misc_feature (1)..(527): Public GI ID no.18399342
  misc_feature (1)..(527): Bit score of 1187.1 for HMM based on sequences of FIGURE 17.
  misc_feature (467)..(522): Pfam Name: BBE Pfam Description: Berberine and berberine like
  misc_feature (78)..(218): Pfam Name: FAD_binding_4 Pfam Description: FAD binding domain
  misc_feature (1)..(527): Functional Homolog Of Ceres SEEDLINE ID no. ME05194 at SEQ ID NO: 558
MKSSTTQTLIFTVFLLLIPTSFAAPPKLKDSFTQCVTVFKPSVPIQNFTYTQQNPNFLTILNNYVRNLRYFNGTTRKPVAIVAAAHFTHIQATINCAKKLGLQLRIRSGGHDYDGMSYLSTVDFVVLDMFNLRAIEIDPKLDTAWVQSGATLGEIYYNVANKSNNLRGFPAGICPGLGAGGHFSGGGYGNMMRKYGLSIDNIIDAKIVDANARVLDRSSMGEDLFWALRGGGAASFCVVLAWKIKLVPVPEKVTVFNVETIGNRGVIPTDLAAKWQEIADKIDNDLFIRLTLSSSNKTVKASFMGMYLGNSEKLLEIMNAKFPELGLNKTECIEMKWIESVLFWLSIPPGTAPTSVMLNRIPQKQIYLKRKSDYVQKPISKPGLESIFKILSENENVSMAWNPYGGRMSEIPATETAFPHRAGNMFKIQYSSNWFVPGEEAASDCLSQTERVFEAMSPYVSKNPREAFLNYRDIDIGKNLNSTYEEGKVYGVKYFKNNFERLVQVKTRVDPDNIFRYEQSIPVHVSR

SEQ ID NO: 574 - DNA, 1861 bp, Glycine max
  misc_feature (1)..(1861): Ceres CLONE ID no.1104143
  misc_feature (1)..(1861): Encodes the peptide sequence at SEQ ID NO 575
attccagaatggaaaaatcaaattccctaccatttctttctgttattgttcttcttcttcatgtctctaactctctaactaccccaacaagagagtccattcacgacacttttcttcattgtcttcaaagccacacaacaaaccaaccagatcatgtttcaaacatagtctatgcgcaaaccaacacatcctacacctcagttcttcgagcctttgctagaaatgccaggttcagcgccccctccacgcaaaagccattactcattgtcacacctctcagtgaaaaccaagtacaagccactgtggtgtgcgccaaaagcattggccttcaactcaaaatcagaagtggtggccatgattttgaaggtgtttcatacatctcccaggtaccttttatcatccttgacatgttcaattttcaagatgtcacagtggacgtgcaaaatgagattgctgtgattcaagctggtgcaagtcttggacaagtttattacaggatttgggagaagagtaaagttcatggctttcctgcaggggcttgtcccactgtaggggttggtggccacttgagtggaggagggtatggtaacatgataagaaaatatgggttatctgttgatcatgttgttgatgctaaaattgttgatgtcaaaggtaggattcttgacaaggaatccatgggggaagatcttttctgggcaattagaggaggtggaggagcaagttttggtgtcatcttatcatacacagttaaacttgttccagtgccagaaaatgttacagtttttcaaattgacaagactttggaggaaaatgccaccgatctagttgttcaatggcaaaaggttgccccacacacagatgataggctttacttgaggcttgtcttacaacctgtaagttccaattttgtgaagggaaagaaaaccataagagcttcagttgaggctttgtttctaggagaagctgatgaacttgtcaaattgttggggcaggagtttcctttgctgggactgaaaaaagagctttgtcatgaaatgaggtggattgattctgtggtttggtgggctaattacaacgatggatcctcagttaatgcacttcttgaccgaaatcattactcggtgcattccaacaaaaggaaatctgattatgttcagaccccaatttccaaagatgggtttacatggatatggaaaaagatgattgaattgggaaaagttagcattgttttcaacccttatggagggaaaatgaatgaggtcccttctgatgctactccatttcctcaccgtgcagggaatctttacaagattcagtacactgtgagttggcaagaaccaggtgctgctgtggaaaaaagttttttgagtcagattagagtgctacacaattacatgaccccttttgtgtccaagaatccaaggagtgcatactttaactacagggaccttgatattggtatcaatagccatggtaaggataactttgaagatggaaaagtttatggtatcaagtacttcaataaaaattttgaaaggttggtgaaggttaagagtgccattgatccagaaaactttttctggaatgaacagagcattccaacatatccaagaagcaatgcgtaaggaacctaaccgacaaagggcaacaaaccgatttgttcatttagttgactttgttactttagcctctacgtgattggttgaattgttgtatcttgaatcttgctatttcgcagaaacttgtttttacagtacatatggaacttgtgtgtatttcgggaaattatatccttgtggacaaagatccttcgcttcttggattttcaccttcatctattctagcctttcgcttgtat

SEQ ID NO: 575 - protein, 539 aa, Glycine max
  misc_feature (1)..(539): Ceres CLONE ID no.1104143
  misc_feature (1)..(539): Bit score of 1284.4 for HMM based on sequences of FIGURE 17.
  misc_feature (475)..(532): Pfam Name: BBE Pfam Description: Berberine and berberine like
  misc_feature (83)..(222): Pfam Name: FAD_binding_4 Pfam Description: FAD binding domain
  misc_feature (1)..(539): Functional Homolog Of Ceres SEEDLINE ID no. ME05194 at SEQ ID NO: 558
MEKSNSLPFLSVIVLLLHVSNSLTTPTRESIHDTFLHCLQSHTTNQPDHVSNIVYAQTNTSYTSVLRAFARNARFSAPSTQKPLLIVTPLSENQVQATVVCAKSIGLQLKIRSGGHDFEGVSYISQVPFIILDMFNFQDVTVDVQNEIAVIQAGASLGQVYYRIWEKSKVHGFPAGACPTVGVGGHLSGGGYGNMIRKYGLSVDHVVDAKIVDVKGRILDKESMGEDLFWAIRGGGGASFGVILSYTVKLVPVPENVTVFQIDKTLEENATDLVVQWQKVAPHTDDRLYLRLVLQPVSSNFVKGKKTIRASVEALFLGEADELVKLLGQEFPLLGLKKELCHEMRWIDSVVWWANYNDGSSVNALLDRNHYSVHSNKRKSDYVQTPISKDGFTWIWKKMIELGKVSIVFNPYGGKMNEVPSDATPFPHRAGNLYKIQYTVSWQEPGAAVEKSFLSQIRVLHNYMTPFVSKNPRSAYFNYRDLDIGINSHGKDNFEDGKVYGIKYFNKNFERLVKVKSAIDPENFFWNEQSIPTYPRSNA

SEQ ID NO: 576 - protein, 528 aa, Medicago truncatula
  misc_feature (1)..(528): Public GI ID no.87240745
  misc_feature (1)..(528): Bit score of 1266.7 for HMM based on sequences of FIGURE 17.
  misc_feature (466)..(524): Pfam Name: BBE Pfam Description: Berberine and berberine like
  misc_feature (74)..(213): Pfam Name: FAD_binding_4 Pfam Description: FAD binding domain
  misc_feature (1)..(528): Functional Homolog Of Ceres SEEDLINE ID no. ME05194 at SEQ ID NO: 558
MDTMGKLFFLTATLTIVLFNSTTAATSPIQHFLNCLPHSLVSEVTYTPNNASFSTILNMKIQNKRFKTATTPKPLAIITAKDDSHIQETIKCAKSNNIQIRIRSGGHDYEGFSYVSDVPFIILDMFHLNSVDINLQESTAWVESGATLGKIYYNIANKSNKLAFPSGVCFTLGAGGHFSGGGYGNLMRKFGLSVDNIIDAKMVDVKGNILDRKSMGEDLFWAIRGGGGASFGVILSWKLQLVPVTPQVIVFDVKRNVSEGATDIVYKWQLIAPKLHKDLFIRAQPNVVQIGQEGKKVVQISFIGQFLGKIERLLTLMNKEFPELGLNKSDCFSMPWINSTLFWYGEPIGTPLEVLLDEPKDPQPLYQKNKSDYVKKPIPREALESIWKLMIEGENFLMQWNPYGGRMEEILPSETPFSHRAGNLFLIQYLNIWSNESSEVSERHVNFSRSFFEFMTPYVSTSPREAFLNYRDADIGANHPSNVTRFDIAKTYGSKFFKGNFERLVSVKTKVDPQNFFRYEQSIPTRSL

SEQ ID NO: 577 - protein, 535 aa, Vigna unguiculata
  misc_feature (1)..(535): Public GI ID no.13161397
  misc_feature (1)..(535): Bit score of 1316.6 for HMM based on sequences of FIGURE 17.
  misc_feature (473)..(530): Pfam Name: BBE Pfam Description: Berberine and berberine like
  misc_feature (76)..(215): Pfam Name: FAD_binding_4 Pfam Description: FAD binding domain
  misc_feature (1)..(535): Functional Homolog Of Ceres SEEDLINE ID no. ME05194 at SEQ ID NO: 558
MKTLSCYYTFATVIALLFSFTPSSADTHENFLQCLYSYPHNTNSISSVLYTQTNSSYFSVLDATMQNLRFSDSRKPLVIVTPQVVSHIQATIKCSQRHGLQIRTRSGGHDYEGLSYVARVPFVILDLLNFREIKVDVENRTAWVQVGATLGELYYTISQASKTLGFPAGVCYSVGAGGHISGGGYGFLMRKYGLAADNVIDAHIIDVNGNLLDRKAMGEDLFWAIRGGGGASFGVIVSWKIKLVPVPSTVTVFNVERILEENATEIIEKWQLVANKLDERIFLRMDLARANSSQHGKLALQANFVAMFQGGVEELIPLMQKNFPELGLKRKDCTETSWIGSAVFTNGALIGSSGHEAPEVLLNRTQIRSGKYKGKSDYVRKPIPVDGLRGLWRWLNDDKVQYSQLQFAPYGGKMDNISESEIPFAHRSGYIFHIHYVVVWQEEGDEATQRHVNWIRRLYKYMEPYVSNSPRAAYVNYRDLDIGVNNNGYTSYHQASIWGLKYFSNNFKRLATVKTKVDPHNFFRNEQSIPTLSKE

SEQ ID NO: 578 - protein, 538 aa, Helianthus annuus
  misc_feature (1)..(538): Public GI ID no.18652400
  misc_feature (1)..(538): Bit score of 1311.1 for HMM based on sequences of FIGURE 17.
  misc_feature (476)..(534): Pfam Name: BBE Pfam Description: Berberine and berberine like
  misc_feature (84)..(225): Pfam Name: FAD_binding_4 Pfam Description: FAD binding domain
  misc_feature (1)..(538): Functional Homolog Of Ceres SEEDLINE ID no. ME05194 at SEQ ID NO: 558
MANITSSFNMQTSILTLLLLLLSTQSSATSRSITDRFIQCLHDRADPSFPITGEVYTPGNSSFPTVLQNYIRNLRFNETTTPKPFLIITAEHVSHIQAAVVCGKQNRLLLKTRSGGHDYEGLSYLTNTNQPFFIVDMFNLRSINVDIEQETAWVQAGATLGEVYYRIAEKSNKHGFPAGVCPTVGVGGHFSGGGYGNLMRKYGLSVDNIVDAQIIDVNGKLLDRKSMGEDLFWAITGGGGVSFGVVLAYKIKLVRVPEVVTVFTIERREEQNLSTIAERWVQVADKLDRDLFLRMTFSVINDTNGGKTVRAIFPTLYLGNSRNLVTLLNKDFPELGLQESDCTEMSWVESVLYYTGFPSGTPTTALLSRTPQRLNPFKIKSDYVQNPISKRQFEFIFERMKELENQMLAFNPYGGRMSEISEFAKPFPHRSGNIAKIQYEVNWEDLSDEAENRYLNFTRLMYDYMTPFVSKNPREAFLNYRDLDIGINSHGRNAYTEGMVYGHKYFKETNYKRLVSVKTKVDPDNFFRNEQSIPTLSS

SEQ ID NO: 579 - protein, 540 aa, Lactuca sativa
  misc_feature (1)..(540): Public GI ID no.18652398
  misc_feature (1)..(540): Bit score of 1304.7 for HMM based on sequences of FIGURE 17.
  misc_feature (475)..(533): Pfam Name: BBE Pfam Description: Berberine and berberine like
  misc_feature (83)..(224): Pfam Name: FAD_binding_4 Pfam Description: FAD binding domain
  misc_feature (1)..(540): Functional Homolog Of Ceres SEEDLINE ID no. ME05194 at SEQ ID NO: 558
MAITYSFNFKSYIFPLLLVLLSTHSSATSTSIIDRFTQCLNNRADPSFPLSGQLYTPDNSSFPSVLQAYIRNLRFNESTTPKPILIITALHPSHIQAAVVCAKTHRLLMKTRSGGHDYEGLSYVTNSNQPFFVVDMFNLRSINVSIEDETAWVQAGATLGEVYYRIAEKSNSHAFPAGVCPTVGVGGHFSGGGYGNLMGKYGLSVDNIVDAQLIDVNGKLLNRKSMGEDLFWAITGGGGVSFGVVVAYKIKLVRVPTTVTVFNVQRTSEQNLSTIAHRWIQVADKLDNDLFLRMTFNVINNTNGEKTIRGLFPTLYLGNSTALVALLNKDFPELGVEISDCIEMSWIESVLFYTNFPIGTPTTALLSRTPQRLNPFKIKSDYVKNTISKQGFESIFERMKELENQMLAFNPYGGRMSEISEFAKPFPHRSGNIAKIQYEVNWDELGVEAANRYLNFTRVMYDYMTPFVSKNPREAFLNYRDLDIGVNSHGKNAYGEGMVYGHKYFKETNYKRLTMVKTRVDPSNFFRNEQSIPTLSSSWK

SEQ ID NO: 580 - DNA, 1791 bp, Triticum aestivum
  misc_feature (1)..(1791): Ceres CLONE ID no.778892
  misc_feature (1)..(1791): Encodes the peptide sequence at SEQ ID NO 581
acaggcagccatagttgccaccactcgtgcatccatcaatcatggcaaggacaccgaggacgacaattttacaccttgtcctaaccctctgctgcatcctctgggttcaaaacacgccctctttagcttccactgcaagtgcaatcgatgaattccttgggtgcctctcggcggacatcccgtctggcctcatccagaccccggcaaccccgtcgtcctactccgccctcctgctgtccaccacccggaacctccgctacgtcctgccagacacctccaagcctctagggatcatcgcggccaccgagcacgcccacgcgcagaccaccgtgcgctgcggccgccgccacggcgtccgcgtccgcgtgcgcagcggcggccacgactacgagggcctctcctacgcctccgtccacctccacaaccgcaacgagcccttcgcggtgctggacctcgccgctctccgggcgatccacgtcgacgcggcgcgtgctgaggcgtgggtcgagtccggcgccaccgtcggcgagctctactacgccgtcggcgccgccagccgctcgctggggttcccggcgggctcgtgccccaccatgggcgtcggtggccacctcagcggcggcgggttcggctcgctggcacgcaagtacggcctctccgccgacaacgtcctggacgccgtcgtcgtggacgccgacggaaggctggtgaacaggagcaccatgggggaggaccacttctgggctctctgtggcggaggcggcgagagcttcggtgtggtgctgtcgtggaaggtgcggctggtccccgtgccggagaccgtcacggtgttcagcatcgtccggtcaaggagccaatccgccgtcgaactgatcaccaaatggcaggagatggcgccggcttcaccgcaagagctgtacctccgcgtgctcgtgctgaaccagcaggctaatttccaagcgctgtttctcggccggtgcggcggcctccatcggctcatgcaagaccgcttccctgagctcgggatgacggagcaagactgcgaggaggtgagctgggtgcagtccacggccttcttcggcttctccacgacgtccgtgccaccggagcagctcctcaacaggagcagcaacccgagctactacctcaaggccaagtcggaccacgtgcaggagccgattccaagggacgtgtgggagagcatatggacgacatggctggagaagcccgaggcggcgctgctcatgctggacccttacggcggcgtgatgagcagcatcccgccgtcggagacgccgttcccgcaccggcaggggaacctctaccagctccagtactactccttctggtacgagaacgggacggcggcggcggagaagcggatgagctgggtcagggggctgtacaaggagatggagccctacgtgtccaagaacccgagggcggtgtacgtcaactacagggaccttgacctggggacgaatgagctggacggtgacgtgacgagctatgagaaggctagagtcagctggggagacaagtatttcaaaggaaattttaagaggttggcagccgtgaagaccatggtggatccccatgatttcttcaggaatgagcagagcatccctcctcttcccactgccaaaatgatgatagattccatttgagactcttaattttggtctctattgctaaatttgtgcgtcttggtgacgtgacgtgtttataatattcatggatgaaaaagtatgtgtatcgtatcaagtttatgaaaaataataaataaaatgg

SEQ ID NO: 581 - protein, 541 aa, Triticum aestivum
  misc_feature (1)..(541): Ceres CLONE ID no.778892
  misc_feature (1)..(541): Bit score of 1251.6 for HMM based on sequences of FIGURE 17.
  misc_feature (469)..(529): Pfam Name: BBE Pfam Description: Berberine and berberine like
  misc_feature (81)..(226): Pfam Name: FAD_binding_4 Pfam Description: FAD binding domain
  misc_feature (1)..(541): Functional Homolog Of Ceres SEEDLINE ID no. ME05194 at SEQ ID NO: 558
MARTPRTTILHLVLTLCCILWVQNTPSLASTASAIDEFLGCLSADIPSGLIQTPATPSSYSALLLSTTRNLRYVLPDTSKPLGIIAATEHAHAQTTVRCGRRHGVRVRVRSGGHDYEGLSYASVHLHNRNEPFAVLDLAALRAIHVDAARAEAWVESGATVGELYYAVGAASRSLGFPAGSCPTMGVGGHLSGGGFGSLARKYGLSADNVLDAVVVDADGRLVNRSTMGEDHFWALCGGGGESFGVVLSWKVRLVPVPETVTVFSIVRSRSQSAVELITKWQEMAPASPQELYLRVLVLNQQANFQALFLGRCGGLHRLMQDRFPELGMTEQDCEEVSWVQSTAFFGFSTTSVPPEQLLNRSSNPSYYLKAKSDHVQEPIPRDVWESIWTTWLEKPEAALLMLDPYGGVMSSIPPSETPFPHRQGNLYQLQYYSFWYENGTAAAEKRMSWVRGLYKEMEPYVSKNPRAVYVNYRDLDLGTNELDGDVTSYEKARVSWGDKYFKGNFKRLAAVKTMVDPHDFFRNEQSIPPLPTAKMMIDSI

SEQ ID NO: 582 - DNA, 1928 bp, Zea mays
  misc_feature (1)..(1928): Ceres CLONE ID no.222523
  misc_feature (1)..(1928): Encodes the peptide sequence at SEQ ID NO 583
  misc_feature (3)..(3): w is a or t/u
  misc_feature (5)..(5): w is a or t/u
  misc_feature (366)..(366): s is g or c
ccwawttgaaaagaccaaacacgtacacggtgcagtgcaatccactcacctgctatggcgacatcaaggccccttgccttggcgctcctcttgtgcgccttgtcggcctgcagccacgccgccatttcctacccaccgtcggccatgtccacggcggcacctgccaacaatggcttcctctcgtgcctcatcaagagcgttcccccgcggctcctccacggcaagagctcgcgtgcgtacggctccatctgggagtccaccgtcaggaacgtcaagttcgtgtcggacaagacggtgaagccggtgtacattatcacccccaccgaggccgcgcacatccaggccaccgtggcgtgcgggcgcaascacgggctgcgggtccgcgtgcggagcggcgggcacgactacgagggcctgtcgtaccggtccgccaagccggagacgttcgccgtggtggacctgtccatgatgcggcaggtgcgcatcgatggcaaggccgccacggcgtgggtggactccggcgcgcagctcggcgagctctactacgccgtggcgaagatgacccccagcctcgggttcccggcgggcgtgtgcgccacgatcggcgtcgggggccacttcagcgggggcggcttcggcatgctgctgcgcaagtacggcaccgccggggacaacgtcatcgacgccaaggtggtggacgccaacggcaccctgctggacaggaagtccatgggcgaggactacttctgggcgatcaggggtggcgggggcgagagcttcggcatcatggtgtcgtggcaggtgcagctcgtgccggtcccgcccaaggtgaccgtgttccagatccacaggggggtcaaggacggcgccatcgacctcatcaacaaatggcagcaggtggcgccgtccctccccgatgacctcatgatccggatcatggccatggagcaggatgccatgttcgaggccctgtacctgggcacgtgcaaggacctcctcccgctgatggccagccgcttcccggagctgggcgtcaaacaggaggactgcaacgagatgccgtggatccagtccgtggccttcatccccatgggcaagtcggccaccgtgatggacctcctcaaccggacgtccaacatcaaggccttcggcaagtacaagtctgactacgtgaaggaccccatcccgagggacgtgtgggagaagatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggggcggcgccgacgcagtggagcagggacatgtacgcgttcatggagccgtacgtcagcaagaaccctaggcaggcgtacgccaactacagggacctcgaccttggcgtcaacgaggtggtcggcgacgtctccacctacgacagcggcagggtctggggcgagaagtactacaatggcaacttcgagaggctcgccaggaccaaggccaaggtggacccctgcgactacttcaggaacgagcagagcatcccgccattgctcaagtgatcgatgatacccggtcccatccagatcctttcgaccgcgccaagcaaaaggacgacgagtcgtacatgattctgctgattatattaattagattgatcctgctttgcatgcgttgagccaggtgctttgcatggcgagttagctacgtagttggcatcagccacatgcatgacattaaaacacaagctgacagccggctacccaagtaaataaggatacgcgacatacactgtcgtgccaattagtatggctgcttcttcttttttaatattattagtcaacattttatttct

SEQ ID NO: 583 - protein, 526 aa, Zea mays
  misc_feature (1)..(526): Ceres CLONE ID no.222523
  misc_feature (1)..(526): Bit score of 1305.8 for HMM based on sequences of FIGURE 17.
  misc_feature (463)..(522): Pfam Name: BBE Pfam Description: Berberine and berberine like
  misc_feature (83)..(224): Pfam Name: FAD_binding_4 Pfam Description: FAD binding domain
  misc_feature (1)..(526): Functional Homolog Of Ceres SEEDLINE ID no. ME05194 at SEQ ID NO: 558
  misc_feature (104)..(104): Xaa is any aa, unknown or other
MATSRPLALALLLCALSACSHAAISYPPSAMSTAAPANNGFLSCLIKSVPPRLLHGKSSRAYGSIWESTVRNVKFVSDKTVKPVYIITPTEAAHIQATVACGRXHGLRVRVRSGGHDYEGLSYRSAKPETFAVVDLSMMRQVRIDGKAATAWVDSGAQLGELYYAVAKMTPSLGFPAGVCATIGVGGHFSGGGFGMLLRKYGTAGDNVIDAKVVDANGTLLDRKSMGEDYFWAIRGGGGESFGIMVSWQVQLVPVPPKVTVFQIHRGVKDGAIDLINKWQQVAPSLPDDLMIRIMAMEQDAMFEALYLGTCKDLLPLMASRFPELGVKQEDCNEMPWIQSVAFIPMGKSATVMDLLNRTSNIKAFGKYKSDYVKDPIPRDVWEKIYTWLAKPGAGVMIMDPYGARISSIPQDATPFPHRQGVLFNIQYVSYWFGEGDGAAPTQWSRDMYAFMEPYVSKNPRQAYANYRDLDLGVNEVVGDVSTYDSGRVWGEKYYNGNFERLARTKAKVDPCDYFRNEQSIPPLLK

SEQ ID NO: 584 - protein, 525 aa, Phleum pratense
  misc_feature (1)..(525): Public GI ID no.82492267
  misc_feature (1)..(525): Bit score of 1268.8 for HMM based on sequences of FIGURE 17.
  misc_feature (460)..(519): Pfam Name: BBE Pfam Description: Berberine and berberine like
  misc_feature (78)..(219): Pfam Name: FAD_binding_4 Pfam Description: FAD binding domain
  misc_feature (1)..(525): Functional Homolog Of Ceres SEEDLINE ID no. ME05194 at SEQ ID NO: 558
MANSRAFALVLLFCALASSCQVAFSYFPPPAAKEDFLGCLVKEIPPRLLYAKSSPAYPSVLGQTIRNSRWSSPDNVKPLYIITPTNVSHIQSAVVCGRRHSVRIRVRSGGHDYEGLSYRSLQPETFAVVDLNKMRAVWVDGKARTAWVDSGAQLGELYYAIYKASPTLAFPAGVCPTIGVGGNFAGGGFGMLLRKYGIAAENVIDVKLVDANGKLHDKKSMGDDHFWAVRGGGGESFGIVVAWQVKLLPVPPTVTIFKISKTVSEGAVDIINKWQVVAPQLPADLMIRIIAQGPKATFEAMYLGTCKTLTPLMSSKFPELGMNPSHCNEMSWIQSIPFVHLGHRDALEDDLLNRNNSFKPFAEYKSDYVYQPFPKTVWEQILNTWLVKPGAGIMIFDPYGATISATPESATPFPHRKGVLFNIQYVNYWFAPGAAAAPLSWSKDIYNYMEPYVSKNPRQAYANYRDIDLGRNEVVNDVSTYASGKVWGQKYFKGNFERLAITKGKVDPTDYFRNEQSIPPLIKKY

SEQ ID NO: 585 - protein, 522 aa, Cynodon dactylon
  misc_feature (1)..(522): Public GI ID no.41393750
  misc_feature (1)..(522): Bit score of 1319.6 for HMM based on sequences of FIGURE 17.
  misc_feature (460)..(519): Pfam Name: BBE Pfam Description: Berberine and berberine like
  misc_feature (80)..(221): Pfam Name: FAD_binding_4 Pfam Description: FAD binding domain
  misc_feature (1)..(522): Functional Homolog Of Ceres SEEDLINE ID no. ME05194 at SEQ ID NO: 558
MARSRAFAFALLICAVAASCHVALSAPPPYAKQVERDFLTCLTKDIPPRQLYAKSSPAYASVWSSTVRNIKFLSDKTVKPLYIITPTNASHIQAAVVCGRRHGMRIRVRSGGHDYEGLSYRSEKPEPFAVVDMNKMRAVSIDGKAATAWVDSGAQLGDLYYGIAKASPKLGFPAGVCTTIGVGGHFSGGGFGMLLRKYGTAADNVIDAKVVDAQGRLLDRKAMGEDHFWAIRGGGGESFGIVASWQVKLLPVPPKVTVFQVHKGIKEGAIDLVTKWQTVAPALPDDLMIRIMAMGQGAMFEALYLGTCKDLVLLMTARFPELGMNATHCKEMTWIESVPYIPMGPKGTVRDLLNRTSNIKAFGKYKSDYVLEPIPKSDWEKIFTWLVKPGAGVMIMDPYGGGIASVPESATPFPRRSGVLFNIQYVVYWFGEGAAALPTQWTRDIYDFMTPYVSKNPRQAYVNYRDLDLGVNQVVGNVSTYASGKVWGEKYFKGNFERLARTKGKIDPEDYFRNEQSIPPLL

SEQ ID NO: 586 - protein, 536 aa, Berberis stolonifera
  misc_feature (1)..(536): Public GI ID no.4335857
  misc_feature (1)..(536): Bit score of 1206.4 for HMM based on sequences of FIGURE 17.
  misc_feature (452)..(514): Pfam Name: BBE Pfam Description: Berberine and berberine like
  misc_feature (67)..(206): Pfam Name: FAD_binding_4 Pfam Description: FAD binding domain
  misc_feature (1)..(536): Functional Homolog Of Ceres SEEDLINE ID no. ME05194 at SEQ ID NO: 558
MQTALFFLVTICTITCTLGDVNLSSCLTSNGVSNFTALSTSSDSDYHRLLYVSMQNQIFTRPKYPRPSMIILPQSKEELAASVVCSNRGLWTIRLRSGGHSYEGLSYVADTPFVVIDLMNLNRISIDLESKTAWVESGATLGEIYCAISEASDTLGFSGGYCPTVGSGGHISGGGFGMMSRKYGLAADNVIDALIVDANGAVLDRSSMGEDVFWAIRGGGGGVWGAIYAWKLQLLPVPKQVTVFKLMKNFDNIEEASKMLHKWQVVAPALEDDFTLSVLAGADTNGIWFSFLGLYLGPKELAISSVDQNFPELNLVMEDCKEMSWVESFAHLAGLNSVEEMNNRFLKYDDRAFKTKVDFVKEPIPLEGIKGALTMLTKELRGFMAFNGQGGLMSRISSDSTPFPHRKGTLMMMEYIVAWDRDEDAKSYEFIGWLHGFYNYMGQFLPSDPRIAYVNHVDLDLGRLDWTNSTIASNAIEIARTWGEKYFLSNYERLVRAKTLIDPKNVFHHPQSIPPMPQDDLRPNGIWRTEEMFFLE

SEQ ID NO: 587 - DNA, 1816 bp, Panicum virgatum
  misc_feature (1)..(1816): Ceres CLONE ID no.1776394
  misc_feature (1)..(1816): Encodes the peptide sequence at SEQ ID NO 588
agaagggccagaacagtcgatagatctgtctaggccgccgcccatgtagcaaatcgagtacaagtgtgctgatcgaatcccctccaagctcgcatcaattttgcacctttcgcctcaaaatcatggcaagagcaccaagaatcttgcacctgctcctcgctctgtgctcactttccagcagcagcgtcgccgtcgccgtcgcctcagcttccggcgccgccgatgcgttcgtcggctgcctcaccgccgccggcgtcccgccgggcctcctccagaccccggcgtccccgtcctacgacgcgctcctgcgctcctccgtccgcaacctccgctacgtcgcgccgggcaccccgtggccgctcgccatcgtggccgccaccgagcccgcccacgcgcaggccgccgtgcgctgcggccgccgccacggcgtccgcgtccgcacccgcagcggcgggcacgactacgagggcctctcctacgcgtccctcgacccgcgcgagagcttcgccgtgctcgaccttgccgcgttccgggaggtccgcgtcgacgccgcgcgcgccgaggcctgggccgggtcgggagccacgctcggcgaggtctactacgccgtcggcgccgctagccgcgcgctcgcgttccccgcgggggtctgccccaccgtcggcgtcggcgggcacctcggcggcggcgggttcggcacgctgatgcgccggtacggcctcgcggccgacaacgtcctcgacgccgtcctcgtggacgccgacgggaggctcctcaatcggaccaccatgggggaggacctcttctgggccatccgcggtggcggcggcgagagcttcggcgtcgtgctgtcttggaagctccgcctcgtgcccgtgccggagacggtcaccgtgttcaccgtccgccggtcaagaaaccagtccgcgtccgagctcatcaccaaatggcaggaaatcgcgccggcgctgccgcgggacctcatcctccgcgtcgtggtgcagggccggcacgcgcagttcgaagccctgttcctcggccgctgcagccgcgtcctcgagcacatgcgagctcacttccccgagctcggcgtggcgcgagcggactgcgaggagatcagctggatccaatccaccgtctacttcgccttctactccagctccaagccgccggagctcctcctcgacaggatcggggagacaggccggtacgtcaaggccaagtccgactacgtgcaagaacccatcccacggcacgcgtgggagagcacatggtcgtggctggagaagcccgaggccgggctgctcatcctggacccctacggcggccggatggccagcatctcgccgtcggcgacgccgttcccgcaccggaaggggaacctctacaacctccagtactactccttttggttcgagaacggcacggcggcgatggagaagcggatgaactgggtccgaggactgtacagggagatggagccgtacgtgtccaagaatccaagaactgggtatgtgaactacagggacctggatctcgggacgaatgagctggagggcaacgtgactagctacgcgaaggcgaggatttggggggagaagtatttcagaggtaattttgagaggttggcagctgtgaaggccatggtggatcctgatgatttcttcaggaatgagcagagcatccctcctctgccggctgccaagggatggagctccatttgattggaggtcctcgcttttggaatgtatacagttctttttgtggtgaatacgggatttccttttgaaaaaaaaataaaagggattttcttttc

SEQ ID NO: 588 - protein, 533 aa, Panicum virgatum
  misc_feature (1)..(533): Ceres CLONE ID no.1776394
  misc_feature (1)..(533): Bit score of 1267.4 for HMM based on sequences of FIGURE 17.
  misc_feature (463)..(522): Pfam Name: BBE Pfam Description: Berberine and berberine like
  misc_feature (79)..(221): Pfam Name: FAD_binding_4 Pfam Description: FAD binding domain
  misc_feature (1)..(533): Functional Homolog Of Ceres SEEDLINE ID no. ME05194 at SEQ ID NO: 558
MARAPRILHLLLALCSLSSSSVAVAVASASGAADAFVGCLTAAGVPPGLLQTPASPSYDALLRSSVRNLRYVAPGTPWPLAIVAATEPAHAQAAVRCGRRHGVRVRTRSGGHDYEGLSYASLDPRESFAVLDLAAFREVRVDAARAEAWAGSGATLGEVYYAVGAASRALAFPAGVCPTVGVGGHLGGGGFGTLMRRYGLAADNVLDAVLVDADGRLLNRTTMGEDLFWAIRGGGGESFGVVLSWKLRLVPVPETVTVFTVRRSRNQSASELITKWQEIAPALPRDLILRVVVQGRHAQFEALFLGRCSRVLEHMRAHFPELGVARADCEEISWIQSTVYFAFYSSSKPPELLLDRIGETGRYVKAKSDYVQEPIPRHAWESTWSWLEKPEAGLLILDPYGGRMASISPSATPFPHRKGNLYNLQYYSFWFENGTAAMEKRMNWVRGLYREMEPYVSKNPRTGYVNYRDLDLGTNELEGNVTSYAKARIWGEKYFRGNFERLAAVKAMVDPDDFFRNEQSIPPLPAAKGWSSI

SEQ ID NO: 589 - protein, 526 aa, Oryza sativa subsp. indica
  misc_feature (1)..(526): Public GI ID no.125555681
  misc_feature (1)..(526): Bit score of 1252.5 for HMM based on sequences of FIGURE 17.
  misc_feature (461)..(522): Pfam Name: BBE Pfam Description: Berberine and berberine like
  misc_feature (79)..(220): Pfam Name: FAD_binding_4 Pfam Description: FAD binding domain
  misc_feature (1)..(526): Functional Homolog Of Ceres SEEDLINE ID no. ME05194 at SEQ ID NO: 558
MTTTSRALALVLLSSCCLLVAVDAAYAKKPNLSKNDFLSCLAAGIPARQLYAKGSPSYGSVLTSTIRNLRYLSSKTCNPLYIVTPTDVKHIQVAVSCGRRHNVRIRVRSGGHDYEGLSYRSEIPEPFAIVDLVNMRNVTVDGKARTAWVESGAQIGELYYGISKASPTLAFPAGVCPTIGVGGHFSGGGFGMLLRKFGLASDNVLDVKVVDANGKVQDRKSMGEDYLWAVRGGGGSSFGIVVSWKLRLLPVPATVTVIQMPKMVNEGAVDLLTKWQSLAPTFPEDLMIRVMAQAQKAVFEGLYLGTCDALLPLVTSRFPELGVNRSHCNEMSWVQSIAFIHLGKNATVKDILNRTSSIRAFGKYKSDYVTQPLSKATWDTIYKDWFSKPGSGIMIMDPYGATISKPGEADTPFPHRKGMLYNIQYITFWFGEGAPAEAPIKWIRDFYAFMEPYVTKNPRQAYVNYRDLDLGVNAVEAGANVSCYQVGKVWGEKYFKGNFERLARTKAKVDPTDFFRNEQSIPPLLA

SEQ ID NO: 590 - protein, 531 aa, Oryza sativa subsp. japonica
  misc_feature (1)..(531): Public GI ID no.115468460
  misc_feature (1)..(531): Bit score of 1252.5 for HMM based on sequences of FIGURE 17.
  misc_feature (466)..(527): Pfam Name: BBE Pfam Description: Berberine and berberine like
  misc_feature (84)..(225): Pfam Name: FAD_binding_4 Pfam Description: FAD binding domain
  misc_feature (1)..(531): Functional Homolog Of Ceres SEEDLINE ID no. ME05194 at SEQ ID NO: 558
MARTSMTTTSRALALVLLSSCCLLVAVDAAYAKKPNLSKNDFLSCLAAGIPARQLYAKGSPSYGSVLTSTIRNLRYLSSKTCNPLYIVTPTDVKHIQVAVSCGRRHNVRIRVRSGGHDYEGLSYRSEIPEPFAIVDLVNMRNVTVDGKARTAWVESGAQIGELYYGISKASPTLAFPAGVCPTIGVGGHFSGGGFGMLLRKFGLASDNVLDVKVVDANGKVQDRKSMGEDYLWAVRGGGGSSFGIVVSWKLRLLPVPATVTVIQMPKMVNEGAVDLLTKWQSLAPTFPEDLMIRVMAQAQKAVFEGLYLGTCDALLPLVTSRFPELGVNRSHCNEMSWVQSIAFIHLGKNATVKDILNRTSSIRAFGKYKSDYVTQPLSKATWDTIYKDWFSKPGSGIMIMDPYGATISKPGEADTPFPHRKGMLYNIQYITFWFGEGAPAEAPIKWIRDFYAFMEPYVTKNPRQAYVNYRDLDLGVNAVEAGANVSCYQVGKVWGEKYFKGNFERLARTKAKVDPTDFFRNEQSIPPLLA

SEQ ID NO: 591 - protein, 535 aa, Thalictrum flavum subsp. glaucum
  misc_feature (1)..(535): Public GI ID no.51980210
  misc_feature (1)..(535): Bit score of 1164.3 for HMM based on sequences of FIGURE 17.
  misc_feature (453)..(516): Pfam Name: BBE Pfam Description: Berberine and berberine like
  misc_feature (68)..(207): Pfam Name: FAD_binding_4 Pfam Description: FAD binding domain
  misc_feature (1)..(535): Functional Homolog Of Ceres SEEDLINE ID no. ME05194 at SEQ ID NO: 558
MLGICILLVFLNNFTCAIIDDDLPSCLTIHGVHNYTTHQSTSNSDAYHRLLYVSMQNQIFTRSTFPQPRVIILPESMDQLANVISCCTRGSWTIRLRSGGHSYEGLSHIADNPFVIIDLMNLNGISIDLDTQTAWVESGATLGEIYHAIGKSSGTMAFSAGYCPTGGSGGHIAPGGFGMMSRKYGLAADNVVDALLVDANGVVLDRESMGEDVFWAIRGGGGGVWGAVYAWKLQLVPVPKNVTIFRLMKHSEVEDASKLLHKWQLVAPKLEDDFSLAVLAGTNKDSSIWLTFLGLYLGPKELASSSMHKKFPELNLLLEDCMEMSWVEATAELAGLKSVSELKDRFLRYDDRAFKTKVDFPKEAIPLEGIQGALEILKKEQRGFMVMNGQGGMMDRISTDASPFPHRSGTLSMVEYIVAWDKHEDLHSNEFIHWLHQLFDYMGKFVSNNPRVGYVNHVDLDLGRIDWVNKTISSGRAIEIARTWGEKYFMSNYDRLVRAKTMIDPKNVFNHPQSIPPLLEIMLDNVKENDVIYKL

SEQ ID NO: 592 - DNA, 865 bp, Arabidopsis thaliana
  misc_feature (1)..(865): Ceres SEEDLINE ID no.ME05267
  misc_feature (1)..(865): Ceres CLONE ID no.21608
  misc_feature (1)..(865): Inplanta Sequence
  misc_feature (1)..(865): Encodes the peptide sequence at SEQ ID NO. 593
aattccgactaaggacgccgtgtcggagtcgtcagattcgaaaaacatacaaaaccaagtcgaagcttttaaaaccctaaatccccaaatcgggaactgagattccgattcgaagatgtcgtcgtcttctccgagtggaagcggtagtgatttgactgagagaagagggatccctgccgccaaattcatccaagatgtggagacttatctctctcagtctggtctcgatcctaactctgctctcgcctttcaccaagaaaggcttcagcaatataaagttgttgagatgaagcttcttgctcaacaaagggatcttcaggctaaaatcccagatattgaaaagtgtttagaggttgttgctactttggaagcaaagaagggtactggtgaggcgctcttagctgattttgaggtgtctgaaggaatatattcacgggcctgcattgaagacacagactcagtgtgtttgtggttgggagctaatgtcatgctggaatattcctgtgaagaggcttcagctcttctgaaaaacaatctggaaaatgctaaagccagcctggaggttcttgtagctgatttacagttcttgagggatcaagtcacagttactcaggtaactattgcacgtgtttataactgggatgttcatcaaaggagggttaaacaagttacccctactgctattgctgttgcagattcatgaactagagatccaaattataatcgtgtgggcttaaacgaggtaatatgattatttggacaccttttgcctcaatcaggttgtttgtaactcttaatctttgctatctttatgaaatttgtgttgctgcgacaaacctatgaatagaacattagcattgttacc

SEQ ID NO: 593 - protein, 195 aa, Arabidopsis thaliana
  misc_feature (1)..(195): Ceres SEEDLINE ID no.ME05267
  misc_feature (1)..(195): Ceres CLONE ID no.21608
  misc_feature (1)..(195): Bit score of 491.5 for HMM based on sequences of FIGURE 18.
  misc_feature (53)..(175): Pfam Name: Prefoldin Pfam Description: Prefoldin subunit
MSSSSPSGSGSDLTERRGIPAAKFIQDVETYLSQSGLDPNSALAFHQERLQQYKVVEMKLLAQQRDLQAKIPDIEKCLEVVATLEAKKGTGEALLADFEVSEGIYSRACIEDTDSVCLWLGANVMLEYSCEEASALLKNNLENAKASLEVLVADLQFLRDQVTVTQVTIARVYNWDVHQRRVKQVTPTAIAVADS

SEQ ID NO: 594 - DNA, 591 bp, Populus balsamifera subsp. trichocarpa
  misc_feature (1)..(591): Ceres ANNOT ID no.1511954
  misc_feature (1)..(591): Encodes the peptide sequence at SEQ ID NO 595
atggcatcatcatcatcaacagcagtagcaacagcaacagaaacaactacagagagaagaggaataccaggagctcagtttgtagaagatgttgaaacctatcttaatcaatctggtcttgatgtcaactctgccctgtcttttctgcaagaaagattacagcaatataagttggtggagatgaaacttcttgcccaacaaagggatcttcaggcaaagatccctgatatagagaagtgcttagatgtggttgccactttacaggctaagaagggtactggtgagcctcttattgctgattttgaagtttccgaaggcatatattctcaggctcgcattgaggatgccgagtcggtttgtttatggctaggagcaaatgtcatgttggagtattcatgtgaagaggccaatgatcttctacaaaagaatttggacaacgctaaagctagtctagaagttctagttgccgatctattattcttaagggatcaagtcactataacacaggttactattgcccgcgtgtataactgggatgttcaccagaagcgcagaatgcgcgaagctgttactgctgagaaagactcatga

SEQ ID NO: 595 - protein, 196 aa, Populus balsamifera subsp. trichocarpa
  misc_feature (1)..(196): Ceres ANNOT ID no.1511954
  misc_feature (1)..(196): Bit score of 501.9 for HMM based on sequences of FIGURE 18.
  misc_feature (56)..(178): Pfam Name: Prefoldin Pfam Description: Prefoldin subunit
  misc_feature (1)..(196): Functional Homolog Of Ceres SEEDLINE ID no. ME05267 at SEQ ID NO: 593
MASSSSTAVATATETTTERRGIPGAQFVEDVETYLNQSGLDVNSALSFLQERLQQYKLVEMKLLAQQRDLQAKIPDIEKCLDVVATLQAKKGTGEPLIADFEVSEGIYSQARIEDAESVCLWLGANVMLEYSCEEANDLLQKNLDNAKASLEVLVADLLFLRDQVTITQVTIARVYNWDVHQKRRMREAVTAEKDS

SEQ ID NO: 596 - DNA, 579 bp, Populus balsamifera subsp. trichocarpa
  misc_feature (1)..(579): Ceres ANNOT ID no.1517556
  misc_feature (1)..(579): Encodes the peptide sequence at SEQ ID NO 597
atggcatcgtcgtcatcaacggaagcggaaacaacgacagagagaagaggaataccaggagctcaattcgtagaggatgttgaaacctatctcactcaatctggtcttgatgttaactcttccctttcttttctgcaagaaagactacagcaatataagctggtggagatgaaacttcttgcccaacatagagatcttcaggcaaagattcccgacatagagaagtgcttagatgtggttgccattttactggctaagaagggtaccggtgagcctcttatcgctgattttgaagtttctgaaggcatatattctcaggctcgcattgaggatgctggctcagtctgtttatggctgggagcaaatgtcatgttagagtattcatgtgaagaggccactgctcttctacaaaagaatttggataacgctaaagctagtttagaagttctagttgccgatctacaattcttgagggatcaagtcacaataacacaggttactattgctcgtgtgtataattgggatgttcaccagaagcgcagaatgcgagaagctgttactgctgagaaagactcatga

SEQ ID NO: 597 - protein, 192 aa, Populus balsamifera subsp. trichocarpa
  misc_feature (1)..(192): Ceres ANNOT ID no.1517556
  misc_feature (1)..(192): Bit score of 475.5 for HMM based on sequences of FIGURE 18.
  misc_feature (52)..(174): Pfam Name: Prefoldin Pfam Description: Prefoldin subunit
  misc_feature (1)..(192): Functional Homolog Of Ceres SEEDLINE ID no. ME05267 at SEQ ID NO: 593
MASSSSTEAETTTERRGIPGAQFVEDVETYLTQSGLDVNSSLSFLQERLQQYKLVEMKLLAQHRDLQAKIPDIEKCLDVVAILLAKKGTGEPLIADFEVSEGIYSQARIEDAGSVCLWLGANVMLEYSCEEATALLQKNLDNAKASLEVLVADLQFLRDQVTITQVTIARVYNWDVHQKRRMREAVTAEKDS

SEQ ID NO: 598 - DNA, 856 bp, Glycine max
  misc_feature (1)..(856): Ceres CLONE ID no.560687
  misc_feature (1)..(856): Encodes the peptide sequence at SEQ ID NO 599
  misc_feature (725)..(725): m is a or c
gtgtgagcgtcaacaatggcttcttcgtcttcagaatcggcggtgtcggagcgaagaggaataccaggggctcagttcgtagaggatgtccaaacttacctcactcaatcgggtctcgatgttggttcagccctggcttttctccaagagagacttcagcagtacaaggtagtagaaatgaagcttcttgctcagcaaagggatcttcaggcaaagataccagatattgaaaagtgcttagacgttgttgctacattgaaagctaagaagggtactggtgaggaacttattgctgattttgaggtatcagaaggcatctattcacgagcacgcatagaagaaaccaattccgtgtgtttatggctgggagctaatgttatgctggaatattcattagaagaggctactggtcttctacagaagaacctggataatgctagagccagtttggaagttcttattgctgatttacagtttttgagggaccaggtgacaattactcaggttacaattgctcgtgtgtataattgggatgttcatcaacggagagttcaacaagctgttgctacaactgctcaagactagttaaaaaggagagtttattcaaacctagatccaaaattgaaaactcataccttttgcttagagtatgatttttatctcttgccaatttctgatttagataaattgtgggttgctccctttctctagttccggttttaccmcagtagacactagtaggagctttttcgtatatttatgttattattgtcttggtctcttgtaaaatgcccatatgttaggttgatgggaaagttttggtttggtgtgatcatatggatatattctactctgc

SEQ ID NO: 599 - protein, 189 aa, Glycine max
  misc_feature (1)..(189): Ceres CLONE ID no.560687
  misc_feature (1)..(189): Bit score of 485.5 for HMM based on sequences of FIGURE 18.
  misc_feature (50)..(172): Pfam Name: Prefoldin Pfam Description: Prefoldin subunit
  misc_feature (1)..(189): Functional Homolog Of Ceres SEEDLINE ID no. ME05267 at SEQ ID NO: 593
MASSSSESAVSERRGIPGAQFVEDVQTYLTQSGLDVGSALAFLQERLQQYKVVEMKLLAQQRDLQAKIPDIEKCLDVVATLKAKKGTGEELIADFEVSEGIYSRARIEETNSVCLWLGANVMLEYSLEEATGLLQKNLDNARASLEVLIADLQFLRDQVTITQVTIARVYNWDVHQRRVQQAVATTAQD

SEQ ID NO: 600 - DNA, 732 bp, Glycine max
  misc_feature (1)..(732): Ceres CLONE ID no.720301
  misc_feature (1)..(732): Encodes the peptide sequence at SEQ ID NO 601
  misc_feature (623)..(623): m is a or c
gtgtgagcgtcaacaatggcttcttcgtcttcagaatcggcggtgtcggagcgaagaggaataccaggggctcagttcgtagaggatgtccaaacttacctcactcaatcgggtctcgatgttggttcagccctggcttttctccaagagagacttcagcagtacaaggtagtagaaatgaagcttcttgctcagcaaagggatcttcaggcaaagataccagatattgaaaagtgcttagacgttgttgctacattgaaagctaagaagggtactggtgaggaacttattgctgattttgaggtatcagaaggcatctattcacgagcacgcatagaagaaaccaattccgtgtgtttatggctgggagctaatgttatgctggaatattcattagaagaggttacaattgctcgtgtgtataattgggatgttcatcaacggagagttcaacaagctgttgctacaactgctcaagactagttaaaaaggagagtttattcaaacctagatccaaaattgaaaactcataccttttgcttagagtatgatttttatctcttgccaatttctgatttagataaattgtgggttgctccctttctctagttccggttttaccmcagtagacactagtaggagctttttcgtatatttatgttattattgtcttggtctcttgtaaaatgcccatatgttaggttgatgggaaagttttggtttggtgtgatc

SEQ ID NO: 601 - protein, 155 aa, Glycine max
  misc_feature (1)..(155): Ceres CLONE ID no.720301
  misc_feature (1)..(155): Bit score of 347.0 for HMM based on sequences of FIGURE 18.
  misc_feature (50)..(129): Pfam Name: Prefoldin Pfam Description: Prefoldin subunit
  misc_feature (1)..(155): Functional Homolog Of Ceres SEEDLINE ID no. ME05267 at SEQ ID NO: 593
MASSSSESAVSERRGIPGAQFVEDVQTYLTQSGLDVGSALAFLQERLQQYKVVEMKLLAQQRDLQAKIPDIEKCLDVVATLKAKKGTGEELIADFEVSEGIYSRARIEETNSVCLWLGANVMLEYSLEEVTIARVYNWDVHQRRVQQAVATTAQD

SEQ ID NO: 602 - DNA, 917 bp, Triticum aestivum
  misc_feature (1)..(917): Ceres CLONE ID no.579724
  misc_feature (1)..(917): Encodes the peptide sequence at SEQ ID NO 603
tcttcggctgggccttctctcctcgtctcctctctctctctctctctctctctctctctctctctcatggcggcggccacctcctcgtcggcggtggcggtatctacgccgcagggagtggcggagcggcggggaatcccggcggcatccttcgtcgaggatgtcgaaacctacctccggcaggccgggctcgaggtcaactccgccctcgccttcctccaagaaaggctgcagcagtacaaaatggtggagatgaaacttttagcacaacaaagagaacttcaggcgaaaattcctgatatagagaaatgcttggatattgttgcgacattgaaagctaaaaaagctttgggtgaggcactcatagctgattttgaattatctgagggaatctattcgcgtgctaaaatcgaggactctgactcagtgtgcctatggttgggtgcaaatgtgatgctggaatactcctgtgacgaggccaatgagctcttgaaaagtaacttggaaaatgcgagggccagtttagaagtccttgttggcgatcttcatttcttacgggaccagcaaacgataactcaggttacaattgctcggatatttaactgggacgtgcaccagcggagaagcaagcagtctgttatgaaagaaacatgatcatcatagggtatgcgcagccaatgaaatcgggttatttttgtacttcttgctgcctctggcgatttagtttatcgtcatagtgtgtgtgctctttgctattgatggtgccttggccgcgtgacagaaatgtatcaatcacattcagttttatggtgttggaactctagaccgtgtggtgtagatgacattcgcttctgttttgggctgcatgtacttgtttagcgcttgatgaaacaaaatttgcaaaaaaaaaaaaaaaa

SEQ ID NO: 603 - protein, 195 aa, Triticum aestivum
  misc_feature (1)..(195): Ceres CLONE ID no.579724
  misc_feature (1)..(195): Bit score of 493.6 for HMM based on sequences of FIGURE 18.
  misc_feature (58)..(180): Pfam Name: Prefoldin Pfam Description: Prefoldin subunit
  misc_feature (1)..(195): Functional Homolog Of Ceres SEEDLINE ID no. ME05267 at SEQ ID NO: 593
MAAATSSSAVAVSTPQGVAERRGIPAASFVEDVETYLRQAGLEVNSALAFLQERLQQYKMVEMKLLAQQRELQAKIPDIEKCLDIVATLKAKKALGEALIADFELSEGIYSRAKIEDSDSVCLWLGANVMLEYSCDEANELLKSNLENARASLEVLVGDLHFLRDQQTITQVTIARIFNWDVHQRRSKQSVMKET

SEQ ID NO: 604 - DNA, 949 bp, Zea mays
  misc_feature (1)..(949): Ceres CLONE ID no.286197
  misc_feature (1)..(949): Encodes the peptide sequence at SEQ ID NO 605
aaccaagcaaaccaaacacccaaacacctctaagtttcaaactggccctaaaccgctgctctttgggcttgactctgcccgcttttctccatctccacttggtccctctctcgcatggcggcggcggcatcggcgtcgacgccgcagggggtggcggagcggcggggcatcccggcggcggccttcgtcgaggacgtcgaggcctacctccggcaggccgggctcgacgttaactccgccctcgccttcctccaggaaaggttgcaacagtacaaaatagtggagatgaagcttctagcacaacaacgagaccttcaggcaaagattcctgatatagagaagtgtttggatattgtttcaacattacaagctaaaaaggatttgggtgaggcacttatagctgattttgaattatccgaggggatatactcctgtgcgaaaatcgaggatactgactcagtgtgcctgtggttgggtgcaaatgtgatgctggagtactcttgcgatgaggccaatgccctcttgaagaaaaacttggaaaatgctaaggccagcttagaagtccttgttgctgatcttcagttcttgcgagaccagcaaaccatcactcaggttacaattgctcgggtattcaactgggatgtacaccaccggagaagcaaacaggctgtaaaggaaccttaatgagttagatcacgaggtcaaccaatgtgattgggacaaattttttcgtaccttttggtacctctggcagattagtccatcatagcgagctctttgtttgttgatggtttctttgctgtgtaacaatgtatcggtttattctctttaatggtgtgggaacattagtagaagatgaaacattttactgcctttttccccactggatgtccactggatcacgtcgcaaaatattttttttcatgattcatgcataattcctgctttc

SEQ ID NO: 605 - protein, 189 aa, Zea mays
  misc_feature (1)..(189): Ceres CLONE ID no.286197
  misc_feature (1)..(189): Bit score of 491.0 for HMM based on sequences of FIGURE 18.
  misc_feature (53)..(175): Pfam Name: Prefoldin Pfam Description: Prefoldin subunit
  misc_feature (1)..(189): Functional Homolog Of Ceres SEEDLINE ID no. ME05267 at SEQ ID NO: 593
MAAAASASTPQGVAERRGIPAAAFVEDVEAYLRQAGLDVNSALAFLQERLQQYKIVEMKLLAQQRDLQAKIPDIEKCLDIVSTLQAKKDLGEALIADFELSEGIYSCAKIEDTDSVCLWLGANVMLEYSCDEANALLKKNLENAKASLEVLVADLQFLRDQQTITQVTIARVFNWDVHHRRSKQAVKEP

SEQ ID NO: 606 - DNA, 963 bp, Zea mays
  misc_feature (1)..(963): Ceres CLONE ID no.256812
  misc_feature (1)..(963): Encodes the peptide sequence at SEQ ID NO 607
attaaagttttatagagtagtagagattatcatctctatatggatttcatccattacgtttggcccgagcggtctagcaaccattcccagccggtgggttttgtgggccttttattgttagccgcccggtttgtgctcggccctgatatgtacttagttgctctttggttagtctgactgctgctcctctctctctccctctccatttgggtcccccgtctctttctcatggcggcggcgtcggtgtcgacgccgcagggagtggcggagcggcggggcatcccggcggcggccttcgttgaggacgtcgaggcctacctccgccaggtcgggctcgacgtcaactccgcgctcgcttttctccaggaaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattgtccgaggggatctactcccgtgcgaaaattgaggatactgactcggtgtgcctgtggttgggtgcaaatgtgatgctggagtactcttgcgatgaggccaatgccctcttgaagaaaaacttggaaaatgccaaggccagcttagaagtccttgttgctgatctccatttcctgcgagaccagcaaaccatcactcaggttacaattgctcgggtattcaactgggacgtgcaccatcggagaagcaaacaggccgtaaaagaaacctgactacttacatcacgaggccgaccaatgcgactgggacatttcttttttgtaccttctgctacctctggcagattagcccgtcatagcaagcagtttgttgttgtatcggtttgttcagagttttacggtgtgggactgggaacattagtagaaatgtcatttcaattc

SEQ ID NO: 607 - protein, 188 aa, Zea mays
  misc_feature (1)..(188): Ceres CLONE ID no.256812
  misc_feature (1)..(188): Bit score of 487.0 for HMM based on sequences of FIGURE 18.
  misc_feature (52)..(174): Pfam Name: Prefoldin Pfam Description: Prefoldin subunit
  misc_feature (1)..(188): Functional Homolog Of Ceres SEEDLINE ID no. ME05267 at SEQ ID NO: 593
MAAASVSTPQGVAERRGIPAAAFVEDVEAYLRQVGLDVNSALAFLQERLQQYKIVEMKLLAQQRDLQAKIPDIEKCLDIVATLQAKKDLGEALIADFELSEGIYSRAKIEDTDSVCLWLGANVMLEYSCDEANALLKKNLENAKASLEVLVADLHFLRDQQTITQVTIARVFNWDVHHRRSKQAVKET

SEQ ID NO: 608 - DNA, 831 bp, Zea mays
  misc_feature (1)..(831): Ceres CLONE ID no.282278
  misc_feature (1)..(831): Encodes the peptide sequence at SEQ ID NO 609
cctgatatgtacttagttgctctttggttagtctgactgctgctcctctctctctccctctccatttgggtcccccgtctctttctcatggcggcggcgtcggtgtcgacgccgcagggagtggcggagcggcggggcatcccggcggcggccttcgttgaggacgtcgaggcctacctccgccaggtcgggctcgacgtcaactccgcgctcgcttttctccaggaaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattgtccgaggggatctactcccgtgcgaaaattgaggatactgactcggtgtgcctgtggttgggtgcaaatgtgatgctggagtactcttgcgatgaggccaatgccctcttgaagaaaaacttggaaaatgccaaggccagcttagaagtccttgttgctgatctccatttcctgcgagaccagcaaaccatcactcaggttacaatttctcgggtattcaactgggacgtgcaccatcggagaagcaaacaggccgtaaaagaaacctgactacttacatcacgaggccgaccaatgcgactgggacatttcttttttgtaccttctgctacctctggcagattagcccgtcatagcaagcagtttgttgttgtatcggtttgttcagagttttacggtgtgggactgggaacaattaatatatccatgtggctgtgtttgccattc

SEQ ID NO: 609 - protein, 188 aa, Zea mays
  misc_feature (1)..(188): Ceres CLONE ID no.282278
  misc_feature (1)..(188): Bit score of 484.5 for HMM based on sequences of FIGURE 18.
  misc_feature (52)..(174): Pfam Name: Prefoldin Pfam Description: Prefoldin subunit
  misc_feature (1)..(188): Functional Homolog Of Ceres SEEDLINE ID no. ME05267 at SEQ ID NO: 593
MAAASVSTPQGVAERRGIPAAAFVEDVEAYLRQVGLDVNSALAFLQERLQQYKIVEMKLLAQQRDLQAKIPDIEKCLDIVATLQAKKDLGEALIADFELSEGIYSRAKIEDTDSVCLWLGANVMLEYSCDEANALLKKNLENAKASLEVLVADLHFLRDQQTITQVTISRVFNWDVHHRRSKQAVKET

SEQ ID NO: 610 - protein, 196 aa, Oryza sativa subsp. japonica
  misc_feature (1)..(196): Public GI ID no.115489090
  misc_feature (1)..(196): Bit score of 496.9 for HMM based on sequences of FIGURE 18.
  misc_feature (60)..(182): Pfam Name: Prefoldin Pfam Description: Prefoldin subunit
  misc_feature (1)..(196): Functional Homolog Of Ceres SEEDLINE ID no. ME05267 at SEQ ID NO: 593
MAAAAASSSSSSAAATPQGVTERRGIPAASFVEDVETYLRQAGLDVNSGLAFLQERLQQYKIVEMKLLAQQRDLQAKIPDIEKCLDIVATLQAKKALGEALTADFELSEGIYSRAKIEDTDSVCLWLGANVMLEYSCDEANALLKKNLENAKASLEVLVADLQFLRDQQTITQVTIARVFNWDVHQRRSKQAIKET

SEQ ID NO: 611 - protein, 179 aa, Oryza sativa subsp. japonica
  misc_feature (1)..(179): Public GI ID no.125579734
  misc_feature (1)..(179): Bit score of 407.1 for HMM based on sequences of FIGURE 18.
  misc_feature (60)..(168): Pfam Name: Prefoldin Pfam Description: Prefoldin subunit
  misc_feature (1)..(179): Functional Homolog Of Ceres SEEDLINE ID no. ME05267 at SEQ ID NO: 593
MAAAAASSSSSSAAATPQGVTERRGIPAASFVEDVETYLRQAGLDVNSGLAFLQERLQQYKIVEMKLLAQQRDLQAKIPDIEKCLDIVATLQAKKALGEALTADFELSEGIYSRAKIEDTDSVCLWLGANVMLEYSCDEANALLKKNLENAKASLEVLVADLQFLRDQQTITQIRLSED

SEQ ID NO: 612 - DNA, 582 bp, Arabidopsis thaliana
  misc_feature (1)..(582): Ceres SEEDLINE ID no.ME05300
  misc_feature (1)..(582): Ceres CLONE ID no.2031
  misc_feature (1)..(582): Encodes the peptide sequence at SEQ ID NO. 613
atttctcagtctcctctcctccccaaaacaaattcgccgtaaaatttccagagaagtcgttcatcatttgcaatttctcgattagttctgaatcatggcgttgagcaccagcatcagatctgtatctaagatcattgcttcttccgaagcatcagtctccagatctgtgactagaagcttccactcgactggagttaagaagatgagcggaggaggacatggtggttacgatgaatactacctccacgcaaaacacatgtacaatttggaccgcatgaagtaccaagctctcaagatgtctctcggtgtattcaccgctttcagcatcggtgttggggttcctatcttcgcagtcgttttccagcagaggaagactcaatctggttaagtccctcaggatgctcttgttcacagcttgaataatttgtatgaattctcaaactctgcttttgcaagagagtttttctttctccctttggatcttagccacaagtcttatcgttatggttaagtcttctgtgtcttcctcttttgctggctgtttgatgctgtaataatgataatctgacagatatatttttt

SEQ ID NO: 613 - protein, 97 aa, Arabidopsis thaliana
  misc_feature (1)..(97): Ceres SEEDLINE ID no.ME05300
  misc_feature (1)..(97): Ceres CLONE ID no.2031
  misc_feature (1)..(97): Bit score of 206.9 for HMM based on sequences of FIGURE 19.
MALSTSIRSVSKIISSSEASVSRSVTRSFHSTGVKKMSGGGHGGYDEYYLHAKHMYNLDRMKYQALKMSLGVFTAFSIGVGVPIFAVVFQQRKTQSG

SEQ ID NO: 614 - DNA, 291 bp, Populus balsamifera subsp. trichocarpa
  misc_feature (1)..(291): Ceres ANNOT ID no.6431448
  misc_feature (1)..(291): Encodes the peptide sequence at SEQ ID NO 615
atggcgttgaacaacggtcttagatccgcctccaagctattcactgcttccgaatctcttctatccaagtcagtgaatagaggtatccactcaacaggggtgaagaggatgggaggaggtcatggccatgatgaaccattctatcttcatgcaaagcacatgtacaatttggacaggatgaagtatcagaaaatcaaaatgcctattgctgtattcactgccttcagcattggagtcctggttcctatctatgctgtcattttccagcagaaaaagaccgcatctggctag

SEQ ID NO: 615 - protein, 95 aa, Populus balsamifera subsp. trichocarpa
  misc_feature (1)..(95): Ceres ANNOT ID no.6431448
  misc_feature (1)..(95): Bit score of 217.3 for HMM based on sequences of FIGURE 19.
  misc_feature (1)..(95): Functional Homolog Of Ceres SEEDLINE ID no. ME05300 at SEQ ID NO: 613
MAMIRGIGSGIKLLTSSEAALFRSVTREFHATGMKRMGGHGHDEPYYLHAKHMYNLDQMKHQKLKVALSVWSAFGIGMAVPVYAVMFQQKKAASA

SEQ ID NO: 616 - DNA, 297 bp, Populus balsamifera subsp. trichocarpa
  misc_feature (1)..(297): Ceres ANNOT ID no.6431449
  misc_feature (1)..(297): Encodes the peptide sequence at SEQ ID NO 617
atggcgttgaacaacggtcttagatcagcctgcaagctattcactgcttccgaatctcttctatccaagtcagtgaatagatgtatccactcgacaggggtgaagaggatgggaggaggtcatgcacatggccatgacgaaccattctatcttcatgcgaagcacatgtacaatttggacaggatgaagtatcagaaaatcaaaatgcctcttgctgtgctcactgccttcagcattggagtaattgtacctgtctatgctgtcattttccagcagaaaaagaccgcttctggctaa

SEQ ID NO: 617 - protein, 98 aa, Populus balsamifera subsp. trichocarpa
  misc_feature (1)..(98): Ceres ANNOT ID no.6431449
  misc_feature (1)..(98): Bit score of 195.6 for HMM based on sequences of FIGURE 19.
  misc_feature (1)..(98): Functional Homolog Of Ceres SEEDLINE ID no. ME05300 at SEQ ID NO: 613
MALNNGLRSACKLFTASESLLSKSVNRCIHSTGVKRMGGGHAHGHDEPFYLHAKHMYNLDRMKYQKIKMPLAVLTAFSIGVIVPVYAVIFQQKKTASG

SEQ ID NO: 618 - protein, 97 aa, Arabidopsis thaliana
  misc_feature (1)..(97): Public GI ID no.18409974
  misc_feature (1)..(97): Bit score of 207.6 for HMM based on sequences of FIGURE 19.
  misc_feature (1)..(97): Functional Homolog Of Ceres SEEDLINE ID no. ME05300 at SEQ ID NO: 613
MALSTSIRSVSKIIASSEASVSRSVTRSFHSTGVKKMSGGGHGGYDEYYLHAKHMYNLDRMKYQALKMSLGVFTAFSIGVGVPIFAVVFQQRKTQSG

SEQ ID NO: 619 - DNA, 612 bp, Brassica napus
  misc_feature (1)..(612): Ceres CLONE ID no.969084
  misc_feature (1)..(612): Encodes the peptide sequence at SEQ ID NO 620
atcgtaaacataagaagtcccccgaacaaattcgccgtaaaactcgcagagtcgtcgtcgtcgtcgtcgtttatcgttcgtagctgttttctcgattgatttctaatcatggcactgaacaccggaatcagatctatctcaaagatcatagctttctccgaagcatcagtctccagatctgtgagcagaagcttccactcgactggagctaagaagatgagcggaggacatggccatgacgagccatactacctccacgccaagcacatgtacaatttggaccgcatgaagtaccaaggtctcaagatgtccctcggtgtcttcaccgctttcagcatcggtgttggcgttcccatctttgccgttgtcttccagcagaggaagaccgcctctggttgagtctctctctctctctcatggcgctgctcttgttcctcaccttgaataatttgtatgatttctcaaaacttttgcttgtgcaagagagagtttcttgcttcattttggatcttatatatacaagtcttaccgttacggtaaagtatatttgtttctgtttcttcatcatttgttggctgtttgacgctggaataatgaaaatctgatattgat

SEQ ID NO: 620 - protein, 96 aa, Brassica napus
  misc_feature (1)..(96): Ceres CLONE ID no.969084
  misc_feature (1)..(96): Bit score of 220.0 for HMM based on sequences of FIGURE 19.
  misc_feature (1)..(96): Functional Homolog Of Ceres SEEDLINE ID no. ME05300 at SEQ ID NO: 613
MALNTGIRSISKIIAFSEASVSRSVSRSFHSTGAKKMSGGHGHDEPYYLHAKHMYNLDRMKYQGLKMSLGVFTAFSIGVGVPIFAVVFQQRKTASG

SEQ ID NO: 621 - DNA, 598 bp, Glycine max
  misc_feature (1)..(598): Ceres CLONE ID no.471052
  misc_feature (1)..(598): Encodes the peptide sequence at SEQ ID NO 622
tatcttttcaacaacagtcgaacggcgaacgttcgcaagagacgcaacacaaagttgaacgaggaataggcgtgtagggaaaccgtttcattttcaagcgcgtgactttcaaatccaatcttccataccaatggccttcagcaacgctctcagatctgccgcgaagcttgtcgcttcttccgaatcctccctctctaactcagtgagcagaggttttcattcaactggcatgaagaggatgggaggtggacatggccatgatgagccctattatcttcatgcaaagcacatgtacaacttggacaggatgaagcaccaggggttgaaaatgtcccttgctgtattcactgctttcagcattggggttgcagttccagtgtatgctgtcattttccagcaaaagaagacagcttctagctaggctcgtctttttacttccatttgcaacaataaggtggatttggggatcctagactagcctatggattttgctgttcattattgctttggactttatgttcaaccttctatatggattttccaaatatatctgataataatcaatttctctgcacgatcaaatactcgtgcttggacg

SEQ ID NO: 622 - protein, 96 aa, Glycine max
  misc_feature (1)..(96): Ceres CLONE ID no.471052
  misc_feature (1)..(96): Bit score of 218.3 for HMM based on sequences of FIGURE 19.
  misc_feature (1)..(96): Functional Homolog Of Ceres SEEDLINE ID no. ME05300 at SEQ ID NO: 613
MAFSNALRSAAKLVASSESSLSNSVSRGFHSTGMKRMGGGHGHDEPYYLHAKHMYNLDRMKHQGLKMSLAVFTAFSIGVAVPVYAVIFQQKKTASS

SEQ ID NO: 623 - DNA, 559 bp, Triticum aestivum
  misc_feature (1)..(559): Ceres CLONE ID no.733048
  misc_feature (1)..(559): Encodes the peptide sequence at SEQ ID NO 624
acaactccggcggcggcgaccagacgaacacgagcaccaaggcgatggcgactgctctcaaccgcggcctccgctccgggatccgcctcctcgccaccggcgccgaggcctccaagccagcttcacgtggattccatgctaccggcgtgaagaggatgtcagggcacggccatgatgagccatactacctccacgccaagcacatgtacaacttgcacaggatgaagcatcagaagctgactgcatggacttcggtgctgggagccgtaagcattggtatcggtgtcccggtcttcgcggtcgtcttccagcaaaagaagacctcctccggatgagctcacataccctcccagggcctacttattggacctattttgaatttagcattttgtgaaagccaaagctgtcacttcacttgactattgttgtttcgtgttactccatttgctcttagcagatgatctgaatctgtaagctcgtttctttacggcactgctttctgttaataatacagtggcttgaactttccaggctgtggagaaaccctgcagtgtgatcc

SEQ ID NO: 624 - protein, 96 aa, Triticum aestivum
  misc_feature (1)..(96): Ceres CLONE ID no.733048
  misc_feature (1)..(96): Bit score of 214.0 for HMM based on sequences of FIGURE 19.
  misc_feature (1)..(96): Functional Homolog Of Ceres SEEDLINE ID no. ME05300 at SEQ ID NO: 613
MATALNRGLRSGIRLLATGAEASKPASRGFHATGVKRMSGHGHDEPYYLHAKHMYNLHRMKHQKLTAWTSVLGAVSIGIGVPVFAVVFQQKKTSSG

SEQ ID NO: 625 - DNA, 574 bp, Zea mays
  misc_feature (1)..(574): Ceres CLONE ID no.1062332
  misc_feature (1)..(574): Encodes the peptide sequence at SEQ ID NO 626
agttcgccgtcgttgagcttttatccgcttctccatcaactctgatcatggcgttgaacaccggcatcagatctgtctcaaggctcatagcttcatccgaatcgtcagtctccagatctgtgagcagaagcttccactcaactggagctaagaagatgagcggaggacatggccatgacgagccttactacctccacgccaagcacatgtacaatttggaccgcatgaagttccaaggtctcaagatgtctctcgctgtcttcaccgctttcagcatcggtgttggtgttcccatctttgctgttgtcttccagcagaggaagaccgcttctggttgaatttactcgagtctctctgcttcaataaatttgtatgagttatcaaacttttctctttctgcaagagagaatgtttcttgcttcttatggatcttagctacaagtatttgtcatttcttttctgtttcttcatcctttgctggctgtttgacgctggaataatgataatccgacaattatgtatttttttaatttggattcgggagcttctgtctgaatgttgttcagttcgagcc

SEQ ID NO: 626 - protein, 96 aa, Zea mays
  misc_feature (1)..(96): Ceres CLONE ID no.1062332
  misc_feature (1)..(96): Bit score of 220.4 for HMM based on sequences of FIGURE 19.
  misc_feature (1)..(96): Functional Homolog Of Ceres SEEDLINE ID no. ME05300 at SEQ ID NO: 613
MALNTGIRSVSRLIASSESSVSRSVSRSFHSTGAKKMSGGHGHDEPYYLHAKHMYNLDRMKFQGLKMSLAVFTAFSIGVGVPIFAVVFQQRKTASG

SEQ ID NO: 627 - DNA, 633 bp, Zea mays
  misc_feature (1)..(633): Ceres CLONE ID no.210710
  misc_feature (1)..(633): Encodes the peptide sequence at SEQ ID NO 628
gaaggcccgaccgcaacaaatcacaccgaatcaccctctcgcccaccaggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggggaaaactcagcgctgataccatttgtc

SEQ ID NO: 628 - protein, 92 aa, Zea mays
  misc_feature (1)..(92): Ceres CLONE ID no.210710
  misc_feature (1)..(92): Bit score of 201.3 for HMM based on sequences of FIGURE 19.
  misc_feature (1)..(92): Functional Homolog Of Ceres SEEDLINE ID no. ME05300 at SEQ ID NO: 613
MATALNRGLRLLAAGAEASKPASRGFHATGVKRMGGHGHDEPYYIHAKHMYNLHRMKHQGLKVTLSVLGAVGIGVGVPVYAVIFQQKKTASG

SEQ ID NO: 629 - DNA, 621 bp, Zea mays
  misc_feature (1)..(621): Ceres CLONE ID no.1451028
  misc_feature (1)..(621): Encodes the peptide sequence at SEQ ID NO 630
ccattcccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaggcggcacgacatgaaaacatgcctgcccgtgaaatttcttttcccatttcccacatagcattttgagaggttcaggctggagcttcagttttgcttggccatttctctctctatatatttttttctctcttgctgcaggtttactctgctcattggattttgacataggaataccgatgtctgttaataatacgatgtcttgaactgacagaaagcatatgctgttatcctttct

SEQ ID NO: 630 - protein, 97 aa, Zea mays
  misc_feature (1)..(97): Ceres CLONE ID no.1451028
  misc_feature (1)..(97): Bit score of 180.3 for HMM based on sequences of FIGURE 19.
  misc_feature (1)..(97): Functional Homolog Of Ceres SEEDLINE ID no. ME05300 at SEQ ID NO: 613
MATALGLGARSGLRLLSAGAEAASATSSRAFHSTGTRRMGAHAHDEPYYVHAKHMYNLHRMKHQQLKVCLAVLAAVGTGIGVPVYAVVFQQKKTASA

SEQ ID NO: 631 - DNA, 722 bp, Zea mays
  misc_feature (1)..(722): Ceres CLONE ID no.1457278
  misc_feature (1)..(722): Encodes the peptide sequence at SEQ ID NO 632
ctccaagcctcgaaccgcatctccggcggcctagtggaacgcgaagatggcgacggcgctcggcctcggtgcgcgctccggcctccgactcctgtccgcaggcgccgaggccgcctcagcaacgtggaaaatatggctagcattcgcgaagcgtgtagccgttttgggtagcctgtattttgatctgatgcaaatacgcagctcatgcaaacatcaggattgcgccaaccaggagatgattctggggcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaggcggcacgacatgaaaacatgcctgcccgtgaaatttcttttcccatttcccacatagcattttgagaggttcaggctggagcttcagttttgcttggccatttctctctctatatatttttttctctcttgctgcaggtttactctgctcattggattttgacataggaataccgatgtctgttaataatacgatgtcttgaactgacagaaagcatatgctgttatcctttctaattttgcttc

SEQ ID NO: 632 - protein, 85 aa, Zea mays
  misc_feature (1)..(85): Ceres CLONE ID no.1457278
  misc_feature (1)..(85): Bit score of 140.1 for HMM based on sequences of FIGURE 19.
  misc_feature (1)..(85): Functional Homolog Of Ceres SEEDLINE ID no. ME05300 at SEQ ID NO: 613
MQTSGLRQPGDDSGASRAFHSTGTRRMGAHAHDEPYYVHAKHMYNLHRMKHQQLKVCLAVLAAVGTGIGVPVYAVVFQQKKTASA

SEQ ID NO: 633 - DNA, 511 bp, Musa acuminata
  misc_feature (1)..(511): Ceres CLONE ID no.1743166
  misc_feature (1)..(511): Encodes the peptide sequence at SEQ ID NO 634
gccgccggaagtctccaggagaggagtcgtctatcgggagttcctcgagagccagacatggcgttgagccgcggcatccgatccgggttgaagcttttgtcgcactccgaagccgcccttcccagatcagtgacccatgaattccatgcgacgagcatgaagagaatgggaggacatggccatgatgagcccttctacattcatgctaaacacatgtataacctggatcgcatgaagcatcagaagctaaaggtgactctgggagtgctatctgcattcagcatcggtgtggtagttccgatttatgcagttattttccagcagaagaaagctgcctctggatgagatttgcatgcaacctaggaaaaataatgacttttgcttgatttcctctggtatttgtttgctggagacatttgcttttccatcgatttcttatgttcttctctaaaaattgaaaacagattcccatagtctattgcgacgtggtgattgtttgcttttttcttct

SEQ ID NO: 634 - protein, 95 aa, Musa acuminata
  misc_feature (1)..(95): Ceres CLONE ID no.1743166
  misc_feature (1)..(95): Bit score of 218.5 for HMM based on sequences of FIGURE 19.
  misc_feature (1)..(95): Functional Homolog Of Ceres SEEDLINE ID no. ME05300 at SEQ ID NO: 613
MALSRGIRSGLKLLSHSEAALPRSVTHEFHATSMKRMGGHGHDEPFYIHAKHMYNLDRMKHQKLKVTLGVLSAFSIGVVVPIYAVIFQQKKAASG

SEQ ID NO: 635 - DNA, 502 bp, Musa acuminata
  misc_feature (1)..(502): Ceres CLONE ID no.1736555
  misc_feature (1)..(502): Encodes the peptide sequence at SEQ ID NO 636
gagactatcgatcgaggaagaaggcggtcgccgagcggtatcaatggcgatgattcgtggaatcggatccggcatcaagctcctgacctcttcagaggctgcccttttcagatcagtgacccgagagttccatgccactgggatgaagagaatgggaggacatggccatgatgagccctattatctccatgccaagcacatgtacaacctggaccaaatgaagcatcagaaactaaaggtggctctttcagtttggtccgcctttggtattggcatggctgttccagtttatgctgtcatgttccagcagaaaaaggctgcttctgcttgagatatcagataatgtgcacttagaaataagatctttgtttgatcatcttgtcgcctgttgttggtctttgagccttgcagtcggcctactgaaaccgaaaactggtggcttgtttctacctgctggtttcttgttaacttgtttcttggtttaaatcttcaaacctaagct

SEQ ID NO: 636 - protein, 95 aa, Musa acuminata; identical to SEQ ID NO: 615
  misc_feature (1)..(95): Ceres CLONE ID no.1736555
  misc_feature (1)..(95): Bit score of 217.3 for HMM based on sequences of FIGURE 19.
  misc_feature (1)..(95): Functional Homolog Of Ceres SEEDLINE ID no. ME05300 at SEQ ID NO: 613

SEQ ID NO: 637 - DNA, 597 bp, Panicum virgatum
  misc_feature (1)..(597): Ceres CLONE ID no.1778589
  misc_feature (1)..(597): Encodes the peptide sequence at SEQ ID NO 638
atcacagtgagaacccccctctcgcccaccaccacaccagacctccggcggcggcgaccccagtcgagaacacgaaggcgacggcaatggcgacggcgctcaaccgcggcctccgctccgggatccgcctcctcgccgccggcgccgaggcgtccaagccagcttctcgtggattccatgccactggtgtgaagagaatgggagggcacggccacgatgagccgtactatctccatgccaagcacatgtacaacttgcacaggatgaagcatcaggggttgaaggtgactctttccgtgctgggagcagttagcatcggcgttggagtccccgtgtacgcagtcattttccagcagaagaagaccgcctcaggttgagcgatcatgctctcaaagcctacatattggagacttattttcaacaacattttgtgaagttttaagcttgattctaccttggtggttgcttattattaccatgttttcttacgagaagttgtaacctcgtttcttgccatgttttcaagtaggacacaactttctgttaataatatcgtggcttgaactttccaggctgttgagaaacctcagcagtgat

SEQ ID NO: 638 - protein, 96 aa, Panicum virgatum
  misc_feature (1)..(96): Ceres CLONE ID no.1778589
  misc_feature (1)..(96): Bit score of 222.4 for HMM based on sequences of FIGURE 19.
  misc_feature (1)..(96): Functional Homolog Of Ceres SEEDLINE ID no. ME05300 at SEQ ID NO: 613
MATALNRGLRSGIRLLAAGAEASKPASRGFHATGVKRMGGHGHDEPYYLHAKHMYNLHRMKHQGLKVTLSVLGAVSIGVGVPVYAVIFQQKKTASG

SEQ ID NO: 639 - DNA, 569 bp, Panicum virgatum
  misc_feature (1)..(569): Ceres CLONE ID no.1787407
  misc_feature (1)..(569): Encodes the peptide sequence at SEQ ID NO 640
aggaaacacaagcggcccccctctcgcccaccaccacaccagacctccggcggcggcgaccccagtcgagaacacgaaggcgacggcgatggcgacggcgctcaaccgcggcctccgcctcctcgccgccggcgccgaggcgtccaagccagcttctcgtggattccatgccactggtgtgaagagaatgggagggcacggccacgatgagccgtactatctccatgccaagcacatgtacaacttgcacaggatgaagcatcaggggttgaaggtgactctttccgtgctgggagcagttagcatcggcgttggagtccccgtgtacgcagtcattttccagcagaagaagaccgcctcaggttgagcgatcatgctctcaaagcctacatattggagacttattttcaacaacattttgtgaagttttaagcttgattctaccttggtggttgcttattattaccatgttttcttacgagaagttgtaacctcgtttcttgccatgttttcaagtaggacacaactttctgttaataatatcgtggcttgaactttccaggctgtgg

SEQ ID NO: 640 - protein, 92 aa, Panicum virgatum
  misc_feature (1)..(92): Ceres CLONE ID no.1787407
  misc_feature (1)..(92): Bit score of 203.3 for HMM based on sequences of FIGURE 19.
  misc_feature (1)..(92): Functional Homolog Of Ceres SEEDLINE ID no. ME05300 at SEQ ID NO: 613
MATALNRGLRLLAAGAEASKPASRGFHATGVKRMGGHGHDEPYYLHAKHMYNLHRMKHQGLKVTLSVLGAVSIGVGVPVYAVIFQQKKTASG

SEQ ID NO: 641 - DNA, 538 bp, Panicum virgatum
  misc_feature (1)..(538): Ceres CLONE ID no.1763840
  misc_feature (1)..(538): Encodes the peptide sequence at SEQ ID NO 642
aaccaattttccctttcccttttccttgcgcacgcgctcgtccccggaggcctcgaacagcaccgccggcgaccaccggaagagagggaaacgacgacggcgatggcgctcaacggggtacgggccagcctccgcttcctcgtctccagcgccgagggcgccgccgcccccgcttctcctggatttcattccactggagtgaggcggatgggcgcgcacgcacatgatgagccatactacgtccatgccaagcacatgtacaacctgcacaggatgaagcaccagcagcttaaggtttccctcgccgtgctggctgccgtgggcactggtgttggagtccctgtgtacgcagttgttttccagcagaagaagactgcctctgcatagtttgaaataccagagacagcacagcttaaaatacccgtccatgagatttattttcccattctctcttcacacaggtttaccctttgcttattggattttgacgtaggaacagctgtcccttttaataatactgtggcctgaactttttgcc

SEQ ID NO: 642 - protein, 94 aa, Panicum virgatum
  misc_feature (1)..(94): Ceres CLONE ID no.1763840
  misc_feature (1)..(94): Bit score of 167.5 for HMM based on sequences of FIGURE 19.
  misc_feature (1)..(94): Functional Homolog Of Ceres SEEDLINE ID no. ME05300 at SEQ ID NO: 613
MALNGVRASLRFLVSSAEGAAAPASPGFHSTGVRRMGAHAHDEPYYVHAKHMYNLHRMKHQQLKVSLAVLAAVGTGVGVPVYAVVFQQKKTASA

SEQ ID NO: 643 - protein, 85 aa, Oryza sativa subsp. indica
  misc_feature (1)..(85): Public GI ID no.125548354
  misc_feature (1)..(85): Bit score of 172.9 for HMM based on sequences of FIGURE 19.
  misc_feature (1)..(85): Functional Homolog Of Ceres SEEDLINE ID no. ME05300 at SEQ ID NO: 613
MAAAAAAAGEEEGEASRGFHATGVKRMGGHGHDEPYYLHAKHMYNLHRMKHQKPKVYLSVLGAVGIGIAVPVYAVVFQQKKTASG

SEQ ID NO: 644 - protein, 98 aa, Oryza sativa subsp. japonica
  misc_feature (1)..(98): Public GI ID no.115458464
  misc_feature (1)..(98): Bit score of 216.3 for HMM based on sequences of FIGURE 19.
  misc_feature (1)..(98): Functional Homolog Of Ceres SEEDLINE ID no. ME05300 at SEQ ID NO: 613
MATATALNRGLRSGIRLLATGAEASKTDSRGFHATGVKRMGGHGHDEPYYLHAKHMYNLHRMKHQKPKVYLSVLGAVGIGIAVPVYAVVFQQKKTASG

SEQ ID NO: 645 - DNA, 729 bp, Arabidopsis thaliana
  misc_feature (1)..(729): Ceres SEEDLINE ID no.ME05341
  misc_feature (1)..(729): Ceres CLONE ID no.94503
  misc_feature (1)..(729): Inplanta Sequence
  misc_feature (1)..(729): Encodes the peptide sequence at SEQ ID NO. 646
aaaaaaaaaaaggcaaagagagagcttcaatggagttagcttctttccttggtagagctctgtttgtttccgtatttcttctctccgcatggcaagagttcaatgattttggtgaagatggtggccgatcagctaaatctttgaaaccaaaattcaatgcctttgtaaaccatgtgacaactcacactggccagcaattgccaccagtcgatatgaagattcttgttgctgctgctatagccttgaagggtattgggggactattgtttgtctttggcagctcattgggagcttatctcttgcttctgcatcaagccgttgccaccccaattctgtatgatttctacaactacgatgttgacagaaaggaattcggccaactattttcaaaatttacacagagcttggctcttcttggaggactgctcttcttcattggaatgaaaaactcaaggaaacacggtaggcaactcaggaaaaaggctccaaaggcaaaagcaaactgaagaagccatatctttcatcggttttattcggtctgtattttattttcattttggaatccaggatgggtttaaagagtctatctgatgaggccattgaaaggcaaaatctctgcaaatcattttgcttacttcaagaagcttttatgacacttttttgtagaaatatttatggattattgtttcttagagacaccacttcaatgttaatgttccaacttatttc

SEQ ID NO: 646 - protein, 158 aa, Arabidopsis thaliana
  misc_feature (1)..(158): Ceres SEEDLINE ID no.ME05341
  misc_feature (1)..(158): Ceres CLONE ID no.94503
  misc_feature (1)..(158): Bit score of 348.0 for HMM based on sequences of FIGURE 20.
  misc_feature (1)..(138): Pfam Name: HR_lesion Pfam Description: HR-like lesion-inducing
MELASFLGRALFVSVFLLSAWQEFNDFGEDGGRSAKSLKPKFNAFVNHVTTHTGQQLPPVDMKILVAAAIALKGIGGLLFVFGSSLGAYLLLLHQAVATPILYDFYNYDVDRKEFGQLFSKFTQSLALLGGLLFFIGMKNSRKHGRQLRKKAPKAKAN

SEQ ID NO: 647 - DNA, 842 bp, Gossypium hirsutum
  misc_feature (1)..(842): Ceres CLONE ID no.1808421
  misc_feature (1)..(842): Encodes the peptide sequence at SEQ ID NO 648
atcgtttttacactgatctctctctctctctatctttataaaaaaacctccggctattggggtttttggtttcgtagattcgtttcgcttcatttttgtctcgttttaaacagtaatttccttctttttttttcatttttttcttggaatttttgaagtgtttaataaaaaaaaatggcgttagtttcattcgtcgggagggttcttttcgcttcagtgttcatcctctctgcttggcaagagttcaatgaatttggtgttgatggagggcctgcagctaaggcactcaaaccaaaattcaatgtcttctcaaagactgtgacagctcatacaggggtggaagtaccagaatttgatattaaggttctagttgctgctgctgtagccttcaagggtgttgggggtatcctttttatctttggcagcactatcggtgcttatcttctggctctgcaacaggtaattgttactaccatattgtacgacttctacaactatgacacggaaaagaaagaatttgggctactcttttcaaagttctcacagaacttggcattgctgggggcattactcttcttcatcggcatgaagaactcaatccccagcagacaactcaagaaaaaggctcctaaaaccaaaacagtttgaaggaggaacatctggtaaaccaagggtctattgctcaatctctacgttttccttagtcaacccagatttattttttgtatgctttgtatcaaggctttgttcttcaatattaggtggggaaaagggcatactactttcattatgatactgttaactaagttgatgctgatttaattgagtttgagaattttatc

SEQ ID NO: 648 - protein, 157 aa, Gossypium hirsutum
  misc_feature (1)..(157): Ceres CLONE ID no.1808421
  misc_feature (1)..(157): Bit score of 356.3 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MALVSFVGRVLFASVFILSAWQEFNEFGVDGGPAAKALKPKFNVFSKTVTAHTGVEVPEFDIKVLVAAAVAFKGVGGILFIFGSTIGAYLLALQQVIVTTILYDFYNYDTEKKEFGLLFSKFSQNLALLGALLFFIGMKNSIPSRQLKKKAPKTKTV

SEQ ID NO: 649 - DNA, 937 bp, Gossypium hirsutum
  misc_feature (1)..(937): Ceres CLONE ID no.1838135
  misc_feature (1)..(937): Encodes the peptide sequence at SEQ ID NO 650
acactgatctctctctctctctctctctctctctctctctctctctctctctctctttataaaaaaacctccggctattggggtttttggtttcgtagattcgtttcgcttcatttttgtctcgttttcaaacagtaatttccttttttttttcattgttatttttcttggaattttttgaagtgtttaatccaaaaaaatggcgttagtttcattcgtcgggagggttcttttcgcttcaatgttcatcctctctgcttggcaagagttcaatgaatttggtgttgatggagggcctgcagctaaggcactcaaaccaaaattcaatgtcttctcaaagactgtgacagctcatacaggggtggaagtgccagaatttaatattaaggttctagttgctgctgctgtagccttcaagggtgttgggggtatcctttttatctttggaagcactatcggtgcttatcttctggctctgcaacaggtcattattactcctatattgtacgacttctacaactatgacacggaaaagaaagaatttggcctacttttttcaaagttctcacagaacttggcattgctgggagcattactcttcttcatcggcatgaagaactcaatccccaggagacaactcaagaaaaaggctcctaaaaccaaaacagtttgaaggaggaacatctggtaaaccaagggtctattgttcaatctctacgtttccttgtatcaaggctttgttcttcaatgttaggggggaaaaagggcatactactttcattttgatactgttaactactaagtagatgttgatttaattgagtttgagagaattttatcattttgattttaattttaatgttttattttaatttagttttgaccgttttcatggaatgtttagttatgaaatcatggtgcttggtggtgttatcag

SEQ ID NO: 650 - protein, 157 aa, Gossypium hirsutum
  misc_feature (1)..(157): Ceres CLONE ID no.1838135
  misc_feature (1)..(157): Bit score of 356.0 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MALVSFVGRVLFASMFILSAWQEFNEFGVDGGPAAKALKPKFNVFSKTVTAHTGVEVPEFNIKVLVAAAVAFKGVGGILFIFGSTIGAYLLALQQVIITPILYDFYNYDTEKKEFGLLFSKFSQNLALLGALLFFIGMKNSIPRRQLKKKAPKTKTV

SEQ ID NO: 651 - DNA, 789 bp, Gossypium hirsutum
  misc_feature (1)..(789): Ceres CLONE ID no.1916986
  misc_feature (1)..(789): Encodes the peptide sequence at SEQ ID NO 652
gtatctctcaagtcttgtctcggtttcagacagtagtttcttttgttcctcaaaaccaccccccctttttttcgattgtttttcgttgaatttgaaggtttttaatcgaaaaaaatggggtttgtttctttcgtgggaagagttcttttcgcttcagtatttctcctctctgcttggcaagagttcaatgaatttgatgttgatggagggccagcagcaaaggcattgaagccgaaattcaatgtcttctcaaagactgtgacatctcacacaggggtgcaagtgccggaattcgatattaagtatctagttgctgctgctgtggcctttaaaggtgttgggggtatcttatttacattcgacagcagtatcggagcttatcttctggttctgcatcagcttatcgttactcccatattgtacgacttctacaactatgacacggaaaagaaggaattcggtatacttttcacaaaattcacacagaacttggctctgttaggggccttattcttctttattggcatgaagaactcgatgcctaggggacaacacaagaaaaaggctccaaaaacaaaaacattttgaagaggaacatctaggatttttgttcgatatccgtctacttcagtgaatccatatctatctttatttatgctttgtatcatggctttgtttcttaaagactagggaaaaggggcatatattactcggaatggcttgatattattaattacgaagttaagctcgttatttaattttcagaaagggtttgataatattactttt

SEQ ID NO: 652 - protein, 157 aa, Gossypium hirsutum
  misc_feature (1)..(157): Ceres CLONE ID no.1916986
  misc_feature (1)..(157): Bit score of 344.6 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFVGRVLFASVFLLSAWQEFNEFDVDGGPAAKALKPKFNVFSKTVTSHTGVQVPEFDIKYLVAAAVAFKGVGGILFTFDSSIGAYLLVLHQLIVTPILYDFYNYDTEKKEFGILFTKFTQNLALLGALFFFIGMKNSMPRGQHKKKAPKTKTF

SEQ ID NO: 653 - DNA, 932 bp, Gossypium hirsutum
  misc_feature (1)..(932): Ceres CLONE ID no.1895590
  misc_feature (1)..(932): Encodes the peptide sequence at SEQ ID NO 654
tactctcttgtctctgcttcccgacagcaatttcttctcattttcgagaacatttttttaaagattttttctatatattctttgaagatattaatcagaaaaatggcgctggtttctttcatcggaagggttctttttgcgtcagtgttcatcctctctgcttggcaagagttcaatgaatttggcgtcgatggtggtccagcggtgaaggagctgaggccaaagttcaacgtcttctcaaagactgtctcatctcacacagggttgcaagtgcctgaatttgatatcaagtatgtggttgctgctgctgtagcctttaaaggtgttgggagtattctctttacctttggcagcaccatcggagcttatcttctggttttgcatcaactcattcttactcccattgtttatgacttctacaattacgagaaggagaagaaagaatttggccttctttttacgaagttctcacagaacttggcgctgttaggggcattgctgttcttcattggcatgaagaactcaatccccacaagacaactgaagaaaaaggctccgaaaaccaaaacagtttgaagacgtaacacgtccggttaaaaccgaagagggtctggtttttctcgttcgatcttaatttgtatacctcggtgaaactagatctgtttctgtatgcttgtatcaaggctttgttgttctttcgaagttcatagctatttaatttgagttccacaaaaggatttcataattttgcccttcaatctgctgtttacctttttggattttgccaatctcatggaacttttaatcatggattcatggtattctagatgatatattaggaaatatacttattaggttagtttgggttcatttgttagtgaaatgattcaatatgtttatgaactggatagggatatggcattcatttcttc

SEQ ID NO: 654 - protein, 157 aa, Gossypium hirsutum
  misc_feature (1)..(157): Ceres CLONE ID no.1895590
  misc_feature (1)..(157): Bit score of 343.4 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MALVSFIGRVLFASVFILSAWQEFNEFGVDGGPAVKELRPKFNVFSKTVSSHTGLQVPEFDIKYVVAAAVAFKGVGSILFTFGSTIGAYLLVLHQLILTPIVYDFYNYEKEKKEFGLLFTKFSQNLALLGALLFFIGMKNSIPTRQLKKKAPKTKTV

SEQ ID NO: 655 - DNA, 474 bp, Populus balsamifera subsp. trichocarpa
  misc_feature (1)..(474): Ceres ANNOT ID no.1452653
  misc_feature (1)..(474): Encodes the peptide sequence at SEQ ID NO 656
atggctttcacttcatttcttggacgagtcctctttgcctctgttttcatactctctgcttaccaagagttcaatgaattcggggttgatggaggaccggctgcgaaggcactgaaaccaaagtttggtgtgtttaccagtcatgtgcaatctcacgccggcatacaagtaccggaaattgaaatcaaacatttagtcagcgctgctatatttctcaagggcattggaggcatcctttttatcattggcagctctcttggagcctacctgctgattatacatcagctgattgcaattccaatcctatatgatttctacaactatgacagtgaggagaaagagtttaatcaacttttcatcaaatttacacagaatatggctctctatggagcactactgtttttcattgggatgaagaactcatttcccaggagacagcacaagaagaaggttcctaaaactaaaactggttag

SEQ ID NO: 656 - protein, 157 aa, Populus balsamifera subsp. trichocarpa
  misc_feature (1)..(157): Ceres ANNOT ID no.1452653
  misc_feature (1)..(157): Bit score of 364.3 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MAFTSFLGRVLFASVFILSAYQEFNEFGVDGGPAAKALKPKFGVFTSHVQSHAGIQVPEIEIKHLVSAAIFLKGIGGILFIIGSSLGAYLLIIHQLIAIPILYDFYNYDSEEKEFNQLFIKFTQNMALYGALLFFIGMKNSFPRRQHKKKVPKTKTG

SEQ ID NO: 657 - DNA, 474 bp, Populus balsamifera subsp. trichocarpa
  misc_feature (1)..(474): Ceres ANNOT ID no.1463345
  misc_feature (1)..(474): Encodes the peptide sequence at SEQ ID NO 658
atggctttcgtttctttcgtcgggagagttctctttgcctctgttttcattctctctgcttggcaagagttcaatgaatttggtaccaatggtgagccggcagcacatcttttggagcctaaattccatgttttctcaaaacatgtgtcatctcaaactgggtttcaagtgccacattttgaaatgaagcatgcagttgctgcagctatatctgtgaaagcttttggaagccttcttttcatctttggcagttctgttggagcttatcttctgcttttgcaccagatcatcattaccccaatattgtatgatttttacaactacgatgctgacactaaggaatttaatctgctctttgcgaagttcgcacagaacttggcactgtttggggcattgctcttttttattggcatgaagaactcaatcccaaggaggcaactgaagaaaaagtctcccaaatcaaaaacaacataa

SEQ ID NO: 658 - protein, 157 aa, Populus balsamifera subsp. trichocarpa
  misc_feature (1)..(157): Ceres ANNOT ID no.1463345
  misc_feature (1)..(157): Bit score of 327.2 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MAFVSFVGRVLFASVFILSAWQEFNEFGTNGEPAAHLLEPKFHVFSKHVSSQTGFQVPHFEMKHAVAAAISVKAFGSLLFIFGSSVGAYLLLLHQIIITPILYDFYNYDADTKEFNLLFAKFAQNLALFGALLFFIGMKNSIPRRQLKKKSPKSKTT

SEQ ID NO: 659 - DNA, 940 bp, Glycine max
  misc_feature (1)..(940): Ceres CLONE ID no.1660955
  misc_feature (1)..(940): Encodes the peptide sequence at SEQ ID NO 660
atttttctgccgaggaaaagaaagaaagaaaaaaaaaaacagcgccctagatttgctcttctttgcttcggaagaaagagaaaaacaaataacaatggcgttcgcttctttcctcggcagagttctcttcgcttccgtcttcatactctctgcttaccaagaatttaacgaatttggagttgatgggggacctgcagcaaaagcactcagacctaagtttgatgcctttacacatcgagtgcattctcaagttggctttcaacttcctgagattgatctgaaatttttaattgctggggctattgctctgaagggccttggaggggttcttttcatatttggcagctcttttggagctttgcttctgctcctgcaccagctgattgctaccccaatccattatgatttttacaattatgacagtgaggacaaagaatttactcaactgttcatcaaatttacacagaacatggctcttttcggggctctattgtttttcattggcatgaaaaactccatccctagaagggtacccaagaaggctccaaagacaaaaacctattagtttttgcagcattggacccctttcattgggggctgttgtttcctggttcttcatcatatcctctccaatctgccaggatttgggttgagtactctctggttcagaatcaatcttcctccctttgagcttggtagttttggcttcacttggattaaattattggctattattatttttgtatgatctgttatcatggcgttagaaactatctttcaattgctaaacttgtctttcaaaaaggaaaacaaaaggatgagaagcctttgcgcataatcttcagagtgtcactttcattctgttttatctatcttgatgtaaagtctttgaaagtctggcacgtgatgttattatataactcaacttgagttctccacc

SEQ ID NO: 660 - protein, 156 aa, Glycine max
  misc_feature (1)..(156): Ceres CLONE ID no.1660955
  misc_feature (1)..(156): Bit score of 351.5 for HMM based on sequences of FIGURE 20.
  misc_feature (1)..(138): Pfam Name: HR_lesion Pfam Description: HR-like lesion-inducing
  misc_feature (1)..(156): Functional Homolog Of Ceres SEEDLINE ID no. ME05341 at SEQ ID NO: 646
MAFASFLGRVLFASVFILSAYQEFNEFGVDGGPAAKALRPKFDAFTHRVHSQVGFQLPEIDLKFLIAGAIALKGLGGVLFIFGSSFGALLLLLHQLIATPIHYDFYNYDSEDKEFTQLFIKFTQNMALFGALLFFIGMKNSIPRRVPKKAPKTKTY

SEQ ID NO: 661 - DNA, 912 bp, Glycine max
  misc_feature (1)..(912): Ceres CLONE ID no.581661
  misc_feature (1)..(912): Encodes the peptide sequence at SEQ ID NO 662
attctctcacttttaatttgaaatcttttctttctttctttcttcttttttctgccgaggaaaagaaagaaatagaaaaagaagaaaaaaacacagcgtcctagatttcctcttctctgcttcggaagaaagagaaaacaaacaaaacaatggcgttcgcttctttcctcggcagagtcctcttcgcttctgtcttcatactctctgcttaccaacaatttaatgaatatggagttgatgggggacctgctacaaaagcactcagacctaagtttgatgcctttacacatcgggtgcattctcaagtgggctttcaaattccagagattaatctgaaatttttaattgctggggctattgctctgaagggtcttggaggggttcttttcatatttggcagctcttttggagctttgcttctgctcctgcaccagctgattgctactccaatccattatgatttttacaattatgatagtgaggacaaagaatttactcaactgttcatcaaatttacacagaatatggctcttttcggggctgtattgtttttcattggcatgaaaaactccatccctaaaagggtacccaagaaggctccaaagacaaaaacatattagttttgcagcattgaggacccctttcaagaagtgggggctgtgggagctgttgtttcctggtttttcatcatatcctctccaatctggcaggatttgcaccgagtactctcttctctggttcagaaccaatcttcctccctttgagttttgtagttttggcttcacttggattatattattggctactattattatttttgtatgatctgttatcacggcgttaggaactatctttcaattgccaaacttgtctgtcaaaaaggaaaacaaaaggatgagaagcctttgcgcc

SEQ ID NO: 662 - protein, 156 aa, Glycine max
  misc_feature (1)..(156): Ceres CLONE ID no.581661
  misc_feature (1)..(156): Bit score of 338.4 for HMM based on sequences of FIGURE 20.
  misc_feature (1)..(138): Pfam Name: HR_lesion Pfam Description: HR-like lesion-inducing
  misc_feature (1)..(156): Functional Homolog Of Ceres SEEDLINE ID no. ME05341 at SEQ ID NO: 646
MAFASFLGRVLFASVFILSAYQQFNEYGVDGGPATKALRPKFDAFTHRVHSQVGFQIPEINLKFLIAGAIALKGLGGVLFIFGSSFGALLLLLHQLIATPIHYDFYNYDSEDKEFTQLFIKFTQNMALFGAVLFFIGMKNSIPKRVPKKAPKTKTY

SEQ ID NO: 663 - DNA, 935 bp, Glycine max
  misc_feature (1)..(935): Ceres CLONE ID no.482621
  misc_feature (1)..(935): Encodes the peptide sequence at SEQ ID NO 664
  misc_feature (378)..(378): k is g or t/u
tttcgttctcgctctgaccgggaaaagaaaaaccagctttcttcaagcacctagatttcctctctctctaaatggcgttctcttcttttctcggcagagtcctcttcgcctccgttttcatcctctccgcttaccaagaatttaattcttatggagttgatgggggacccgcagcaaaagcactcagaccgaagtttgatgcctttgcacatcaagtacattctaaagttggctttcaacttccagatattgatatgaaatttttagtggctggggctattgctctcaagggccttggagggattcttttcatactcagcagctcttttggagctttccttttgcttttgcatcaagtgatcactactccaatactgkatgatttctacaattatcacagcgaggacaaagaatttatccaacttttcatcaaatttactcagaatatggctctcttcggggcattgttgtttttcattgggatgaaaaactctattcctagaaggcaacccaagaagaaggctgccaaaacaaaaacatattagttgaaaggacttctcggattgttcctggttgctcattatacccattttccatttctccaggattttggctttggtctctgtctggttcagaacgaatgtaccttctgtccgatggattatgtataatttataattatttatatatgtatgctatttttttgtttgcttgacattagaaactgtctttcgattactaaacttgtatacgaagagggggaaaaatgatcatagcctgttcattcagactgggtgtcaatttcgttctgtccaacggatttgatcgaaaggtgaagtctggcacttgcagttgctattgaactaagcttgatcttcacgttgtcacatggatttgtgtttcctattttttattcatttggttctttacttggc

SEQ ID NO: 664 - protein, 157 aa, Glycine max
  misc_feature (1)..(157): Ceres CLONE ID no.482621
  misc_feature (1)..(157): Bit score of 337.4 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
  misc_feature (103)..(103): Xaa is any aa, unknown or other
MAFSSFLGRVLFASVFILSAYQEFNSYGVDGGPAAKALRPKFDAFAHQVHSKVGFQLPDIDMKFLVAGAIALKGLGGILFILSSSFGAFLLLLHQVITTPILXDFYNYHSEDKEFIQLFIKFTQNMALFGALLFFIGMKNSIPRRQPKKKAAKTKTY

SEQ ID NO: 665 - DNA, 892 bp, Glycine max
  misc_feature (1)..(892): Ceres CLONE ID no.549431
  misc_feature (1)..(892): Encodes the peptide sequence at SEQ ID NO 666
  misc_feature (490)..(490): k is g or t/u
  misc_feature (596)..(596): r is g or a
  misc_feature (653)..(653): y is t/u or c
  misc_feature (681)..(681): y is t/u or c
  misc_feature (768)..(768): k is g or t/u
  misc_feature (887)..(887): y is t/u or c
ggccgaggaaaagaaagaatagaaaaagaagaaaaaaacacagcgtcctagatttcctcttctctgcttcggaagaaagagaaaacaaacaaaacaatggcgttcgcttctttcctcggcagagtcctcttcgcttctgtcttcatactctctgcttaccaacaatttaatgaatatggagttgatgggggacctgctacaaaagcactcagacctaagtttgatgcctttacacatcgggtgcattctcaagtgggctttcaaattccagagattaatctgaaatttttaattgctggggctattgctctgaagggtcttggaggggttcttttcatatttggcagctcttttggagctttgcttctgctcctgcaccagctgattgctactccaatccattatgatttttacaattatgatagtgaggacaaagaatttactcaactgttcatcaaatttacacagaatatggctcttttcgggggckgtattgtttttcattggcatgaaaaactccatccctaaaagggtacccaagaaggctccaaagacaaaaacatattagttttgcagcattgaggacccctttcaaraagtgggggctgtgggagctgttgtttcctggtttttcatcatatcctctccaatcyggcaggatttgcaccgagtactctcttytttggttcagaaccaatcttcctccctttgagttttgtagttttggcttcacttggattatattattgggctactattattattttkgtatgatctgttatcacggcgttaggaactatctttcaattgccaaacttgtctgtcaaaaaggaaaacaaaaggatgagaagcctttgcgcttaatcttcacagtgccaatttcattytgttc

SEQ ID NO: 666 - protein, 143 aa, Glycine max
  misc_feature (1)..(143): Ceres CLONE ID no.549431
  misc_feature (1)..(143): Bit score of 254.9 for HMM based on sequences of FIGURE 20.
  misc_feature (1)..(131): Pfam Name: HR_lesion Pfam Description: HR-like lesion-inducing
  misc_feature (1)..(143): Functional Homolog Of Ceres SEEDLINE ID no. ME05341 at SEQ ID NO: 646
  misc_feature (132)..(132): Xaa is any aa, unknown or other
MAFASFLGRVLFASVFILSAYQQFNEYGVDGGPATKALRPKFDAFTHRVHSQVGFQIPEINLKFLIAGAIALKGLGGVLFIFGSSFGALLLLLHQLIATPIHYDFYNYDSEDKEFTQLFIKFTQNMALFGGXIVFHWHEKLHP

SEQ ID NO: 667 - DNA, 890 bp, Zea mays
  misc_feature (1)..(890): Ceres CLONE ID no.1287179
  misc_feature (1)..(890): Encodes the peptide sequence at SEQ ID NO 668
cccggccgtctcgatcccagcatccgagagagctccacaggccaggtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaagggtcttggaagcctcctttttattttgagcagctctctcggtgcttatctcctgctgctgtaccttgctttgatcactcctatcatccatgacttctacaactacgatatggagaaggcagaatttgcaggcctctttgcgaagttcacccaggatttggcgctgatcggagctctgctcttctttctgggcatgaagaactccatcccgaagcggcagggcggcaagaagaaggcccccaaggcgaagacgaactagggctgcttagatagctgcacgcctcaggtggggtgtatcaggagacaggtctatttcgaagcaggctcagcgcgatgcagcgaatgccatcgagctgcgcttttacatgtttatcatcagattccattttgcggcccgaacaaaggtgtgaccggggtgggttaggcgactagattgcacgattatgtacttgagatttgtttgttgaactgggttgccgacggttaatcttctccatttgattttatcttgttagcagcgcaggaaccgttgctgattcagtggttggtagtttcttcc

SEQ ID NO: 668 - protein, 158 aa, Zea mays
  misc_feature (1)..(158): Ceres CLONE ID no.1287179
  misc_feature (1)..(158): Bit score of 354.5 for HMM based on sequences of FIGURE 20.
  misc_feature (1)..(138): Pfam Name: HR_lesion Pfam Description: HR-like lesion-inducing
  misc_feature (1)..(158): Functional Homolog Of Ceres SEEDLINE ID no. ME05341 at SEQ ID NO: 646
MGFVSFVGRVLFVAAFLLSAYQEFNEFGADGGPAAKALRPKFNVFVKNVSAHLGVAVPHIELKHVIAATIGLKGLGSLLFILSSSLGAYLLLLYLALITPIIHDFYNYDMEKAEFAGLFAKFTQDLALIGALLFFLGMKNSIPKRQGGKKKAPKAKTN

SEQ ID NO: 669 - DNA, 883 bp, Zea mays
  misc_feature (1)..(883): Ceres CLONE ID no.228878
  misc_feature (1)..(883): Encodes the peptide sequence at SEQ ID NO 670
ctctcgcccgtctcgatcccacaggatccgagagacctcacaagccgccacgccaggtccccatcccatcgcggcgcctgccccacccccgccctgctcccgcccggtagtagtagcagagcctcgccgccgctgccgagaatagatggggttcgtgtccttcgtcgggcgggtgctcttcgtcgccgctttcctcctctccgcctaccaggagtttaatgaatttggcgctgatggtgggccagcagctaaggcccttcagcccaagttcaatgtgtttgtaaaaaatatctctgcacatctgggagtagctgtcccgcacattgagttgaagcatgtgattgctgctacaattgctcttaagggacttggaagtctcctttttattttgaccagctccctcggtgcttatctcctgctgctgtacctcgctctgatcagtcctatcgttcacgacttctacaactacgacacggggaaggaagaattcgcgcggctgtttgcgaagttcacccaggacgtggcgctagttggagctctcctcgtcttcctgggcatgaagaactccaccccgaagcggcagggcaagaagaaggctcacaaggcgaagacgaactagtaagaggttgctcgctcggcctcaggcgggtgtcaggagacgaatagtggcccagtgcgaagcagtcgatgcgcatcgagctgtcggctgcgcttttacatgtatcggatattcagattccattttgcggggcgcggcccgaacgaaggtgtgactagtgggcggcgggttaggcgacacgacacggtcatgtatgtgattgcgattggttggttggtttcttgaactgggctgacggtggttaatcttttcgatttgattagc

SEQ ID NO: 670 - protein, 157 aa, Zea mays
  misc_feature (1)..(157): Ceres CLONE ID no.228878
  misc_feature (1)..(157): Bit score of 338.6 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFVGRVLFVAAFLLSAYQEFNEFGADGGPAAKALQPKFNVFVKNISAHLGVAVPHIELKHVIAATIALKGLGSLLFILTSSLGAYLLLLYLALISPIVHDFYNYDTGKEEFARLFAKFTQDVALVGALLVFLGMKNSTPKRQGKKKAHKAKTN

SEQ ID NO: 671 - DNA, 835 bp, Zea mays
  misc_feature (1)..(835): Ceres CLONE ID no.1505134
  misc_feature (1)..(835): Encodes the peptide sequence at SEQ ID NO 672
tccatcacagattccgagagctcccaaggtcgcgccgcggctcccccctcccccaccgcatcccgccggtcgctcgactcgcctcaccgccgccgccggtcgacatggggttcgtgtccttcgccgggagggtcctcttcgcctccgtcttcctcctctccgcctaccaggagtttactgaatttggaactgatggcgggccagctgcaaagaatctgcagccaaagtttaacagtttcaccaaaaatatctccgtacacctcggagtggtggtgcctcatgtagagttgaagcatgtcattgccgctaccattggtctgaagggtctgggaggtctcctgtttatcgtcagcagttcatttggtgcttatctcctggccctctaccttgctttcatcacgcctgttgtctacgacttctacaactacgacatggagaaggctgaattcgtgcagatcttcatgaagttcacacagaacctggcactgtttggagcccttctcttcttcctgggcatgaagaactcggtccccaagaggcaggccaagaagaaggccgccaagtccaagacaacctagagcatctctctctgccaagatagctgtggccgtaggggctttgcgggaaagacggtcttatttaacaaagctaccgtacctgttcttctcttatgtgtaatggatccgtttttgaagggggcgtaggccttacaaggtgtgggtggcggtttaggcgactagattgtgtatcattattatgtgctacttccgatttgattgttgtagggctaaagattgttatcccatttgtttattctgcaaccaatattgttact

SEQ ID NO: 672 - protein, 157 aa, Zea mays
  misc_feature (1)..(157): Ceres CLONE ID no.1505134
  misc_feature (1)..(157): Bit score of 344.2 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFAGRVLFASVFLLSAYQEFTEFGTDGGPAAKNLQPKFNSFTKNISVHLGVVVPHVELKHVIAATIGLKGLGGLLFIVSSSFGAYLLALYLAFITPVVYDFYNYDMEKAEFVQIFMKFTQNLALFGALLFFLGMKNSVPKRQAKKKAAKSKTT

SEQ ID NO: 673 - DNA, 967 bp, Zea mays
  misc_feature (1)..(967): Ceres CLONE ID no.454469
  misc_feature (1)..(967): Encodes the peptide sequence at SEQ ID NO 674
tatgtttgtctgccaaaaaaaatgcataccattaatgaggtagtaagatttctatgcagcttacacttaattagacccataatctttttatcatcaagacctgtgcacttttgggtttcatttttgactgttacaactcttgggtcttcaccaatgatctttagtgccaaagttatgtgcatctatgttctccaatccccaagatgcttttaagtttctctctttcaattgtcgcacaattacttcgttcttttgatgcaccagtttattgttgagaatgttgaaataatgcttttcgctcatatatttaggttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctacaaccatgaaatggagtcaacactgtttgtcgatttttttttcaagttcatacagaacttggcgtttatgggtgccctgcttttcttccttgggatgaagaactcaattccaaaacgtcgctccaagggaaggacaacaaaaaccaagacaaactgatgtcagtggttgtaggaggggaagcaattgggctcattatgtttgcatactatacaggaatagatgtcccacttttgttcttggtgcgccaattgaattgtgaattgggacttacagaacttagcatgtaggatatttaagttatcttccgcaattttattttcttatgttgcgatgtgttcttatgtcacattccattttgctacaagaactgctttgacagtaaaaaaatatattaagtcgcatagcc

SEQ ID NO: 674 - protein, 153 aa, Zea mays
  misc_feature (1)..(153): Ceres CLONE ID no.454469
  misc_feature (1)..(153): Bit score of 252.9 for HMM based on sequences of FIGURE 20.
  misc_feature (20)..(134): Pfam Name: HR_lesion Pfam Description: HR-like lesion-inducing
  misc_feature (1)..(153): Functional Homolog Of Ceres SEEDLINE ID no. ME05341 at SEQ ID NO: 646
MHQFIVENVEIMLFAHIFRFIEFGNDGGPAAKTLKPKFNLFVKLVSKNTGLGLPHMDIKTVIAATMFLKGFGGLLFIVSSSFGAFLLLIYLAFITPIVYDFYNHEMESTLFVDFFFKFIQNLAFMGALLFFLGMKNSIPKRRSKGRTTKTKTN

SEQ ID NO: 675 - DNA, 901 bp, Panicum virgatum
  misc_feature (1)..(901): Ceres CLONE ID no.1770929
  misc_feature (1)..(901): Encodes the peptide sequence at SEQ ID NO 676
ggaggcttcgttataattttcttccaaagaaaaagctgcgttgttataagtacagcgtggggctcccctcggacaagcccccggccgtctccatccccagattccgagagcgctccacaggccaggacccatcgcgccgcggcacccccggcacgcaccgcctctcccatcccgcccggtcgcctcgccgccgctgctgccgagatggggttcgtgtccttcgtcgggagagtgctcttcgtcgccgccttcctcctctccgcctaccaggagtttaatgaatttggaactgatggtgggccagcagcaaaggcccttcagcccaagttcaatgtgtttgtcaaaaatatctcttcccacttgggagttgccgtgcctcatattgagttgaagcatgtaattgctgccacaattgcgctcaagggccttggaggtcttctttttatcttgagctgctctcttggtgcctatctcctgttgttgtaccttgctattgtcacccctattgtgcatgacttctacaactacgacatggagaaggcagaatttgcacagatctttgggaagttcacccaggatctggcactcattggagcacttctcttcttcctgggcatgaagaactccatcccgaagcggcagtccaagaagaaggctcccaaggcgaagacaaactaaggctctctagatagtattgttgcaactgtaggggcctcaggcggtgtcaggagacggtctattttgaagcaaagctgcgatgcgaaaccaatgccatcgagctgcgctttcatatgtatcagattccattttgcagggcacggcccgaacggtgtgagtggcggattaggcgactagattgtaccattatgtactcgtgattggtttgttggactaggttgcc

SEQ ID NO: 676 - protein, 157 aa, Panicum virgatum
  misc_feature (1)..(157): Ceres CLONE ID no.1770929
  misc_feature (1)..(157): Bit score of 364.1 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFVGRVLFVAAFLLSAYQEFNEFGTDGGPAAKALQPKFNVFVKNISSHLGVAVPHIELKHVIAATIALKGLGGLLFILSCSLGAYLLLLYLAIVTPIVHDFYNYDMEKAEFAQIFGKFTQDLALIGALLFFLGMKNSIPKRQSKKKAPKAKTN

SEQ ID NO: 677 - DNA, 869 bp, Panicum virgatum
  misc_feature (1)..(869): Ceres CLONE ID no.1772805
  misc_feature (1)..(869): Encodes the peptide sequence at SEQ ID NO 678
acaaaataccagcccatcctccccggcctgcggtctcccgtctccccacctcctcctcctcgccttccccgctcggccctcccctcctcgggtgcctccaccgtcgagagggcgagcgaggtgggcggagaagaaggcgaagcgcgaccatgggcttcgtctcgttcgtcggtcgggtgctcttcgcctccctcttcctcctctccgcctaccaagagtttatagaatttggaaatgatggtggaccagcggcaaaggtcttgaagccaaaattcaatctctttatcaagcaagtgtccaagaacactggattgggggtgccgcatattgatgtaaaaactgtcattgctgctaccatgtttcttaaaggctttggtgggcttttgttcatctttagcagctcatttggagctttcctactgcttatttacttggcatttataacccctgttgtgtacgacttctacaactatgaaatggagtcagcacaatttgtccagctgtttttcaagttctcacagaacttggcgtttatcggtgccctgcttttcttcctgggaatgaagaactctattccaagaaggcgctccaaaggaaggacaacaaagaccaagacaaattgaagtcagcagttgtaggatgggaggctattaagctccttatgtttgcatactatacagcggtagatgtcccacttttgttcttggcacgccaattgaattgtgaattggggggacttacagaacttagcatgtagggtatttaagttgtcttggacgattctattttgtatgtctcatttgtgtttatgtaatgatacattttgctacaagaactgctttgtcagtttaaaatcgaaagttgcagtc

SEQ ID NO: 678 - protein, 157 aa, Panicum virgatum
  misc_feature (1)..(157): Ceres CLONE ID no.1772805
  misc_feature (1)..(157): Bit score of 337.9 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFVGRVLFASLFLLSAYQEFIEFGNDGGPAAKVLKPKFNLFIKQVSKNTGLGVPHIDVKTVIAATMFLKGFGGLLFIFSSSFGAFLLLIYLAFITPVVYDFYNYEMESAQFVQLFFKFSQNLAFIGALLFFLGMKNSIPRRRSKGRTTKTKTN

SEQ ID NO: 679 - protein, 157 aa, Oryza sativa subsp. indica
  misc_feature (1)..(157): Public GI ID no.125542421
  misc_feature (1)..(157): Bit score of 361.9 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFAGRVLFASVFLLSAYQEFSEFGADGGPAAKALRPKYNVFTKNISAHLGVAVPHVELKHIVAATIGLKGLGGLLFILSSSFGAYLLLIYLAFITPVVYDFYNYNMEKSEFVQLFMKFTQNLALFGALLFFLGMKNSIPKRQAKKKAPKSKTN

SEQ ID NO: 680 - protein, 157 aa, Oryza sativa subsp. indica
  misc_feature (1)..(157): Public GI ID no.116308887
  misc_feature (1)..(157): Bit score of 339.6 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFISFVGRVLFASIFLLSAYQEFSEFGTDGGPAAKALKPKFNLFMQQVSKSLGMAVPHIDIKTVIAATMFLKGFGGLLFIISSSFGAFLLLLYLAFITPVVYDFYNYEMESSQFVQLFVKFSQNLALFGALLFFLGMKNSIPRRHSKRRAGKTKTN

SEQ ID NO: 681 - protein, 157 aa, Oryza sativa subsp. japonica
  misc_feature (1)..(157): Public GI ID no.115450741
  misc_feature (1)..(157): Bit score of 364.0 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFVSFAGRVLFASVFLLSAYQEFSEFGADGGPAAKALRPKYNVFTKNISAHLGVAVPHVELKHIVAATIGLKGLGGLLFILSSSFGAYLLLIYLAFITPVVYDFYNYDMEKSEFVQLFMKFTQNLALFGALLFFLGMKNSIPKRQAKKKAPKSKTN

SEQ ID NO: 682 - protein, 158 aa, Oryza sativa subsp. japonica
  misc_feature (1)..(158): Public GI ID no.115482234
  misc_feature (1)..(158): Bit score of 318.1 for HMM based on sequences of FIGURE 20.
  misc_feature (1)..(138): Pfam Name: HR_lesion Pfam Description: HR-like lesion-inducing
  misc_feature (1)..(158): Functional Homolog Of Ceres SEEDLINE ID no. ME05341 at SEQ ID NO: 646
MGFLSFAGRVLFAAAFLLSAYQEFSEFGVDGGPAAKALQPKFNTIVANISTRTGLVVPHIELKHIVAAMISLKGLGGLLFILSSSLGAYLLLFHLAFITPVVHDFYNYDIESAEFVQLFTKFAQNCALVGALLFFLAMKNSIPKRQPNRKKAPKPKST

SEQ ID NO: 683 - protein, 157 aa, Oryza sativa subsp. japonica
  misc_feature (1)..(157): Public GI ID no.115457158
  misc_feature (1)..(157): Bit score of 342.3 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFISFVGRVLFASIFLLSAYQEFSEFGTDGGPAAKALKPKFNLFTQQVSKSLGMAVPHIDIKTVIAATMFLKGFGGLLFIISSSFGAFLLLLYLAVITPVVYDFYNYEMESSQFVQLFVKFSQNLALFGALLFFLGMKNSIPRRHSKRRAGKTKTN

SEQ ID NO: 684 - DNA, 474 bp, Sorghum bicolor
  misc_feature (1)..(474): Ceres ANNOT ID no.6063505
  misc_feature (1)..(474): Encodes the peptide sequence at SEQ ID NO 685
atgggcttcatctcgttcgtcggccgggtgctcttcgcctccctcttcctcctctccgcctaccaagagttcattgaatttggaaatgatggtggaccggcagcgaagaccttgaagccaaagttcaatctcttcgtcaagctagtgtccaagaataccggattgggggtgccgcatattgatataaaaactgtcattgcggctaccatgtttcttaaaggctttggtggtcttctgttcatattcagcagctcatttggagcattcctcctgctcatttacttggcgtttatgacccctatcgtgtatgatttctacaactatgaaatggagtcagagcagtttgtccagctttttttcaagttcacacagaacttggcgtttatcggtgccctgcttttcttcctggggatgaagaactcgattccaagaaggcgctccaagggaaggacaacaaaaaccaagacaaactga

SEQ ID NO: 685 - protein, 157 aa, Sorghum bicolor
  misc_feature (1)..(157): Ceres ANNOT ID no.6063505
  misc_feature (1)..(157): Bit score of 344.8 for HMM based on sequences of FIGURE 20.
  misc_feature (1)..(138): Pfam Name: HR_lesion Pfam Description: HR-like lesion-inducing
  misc_feature (1)..(157): Functional Homolog Of Ceres SEEDLINE ID no. ME05341 at SEQ ID NO: 646
MGFISFVGRVLFASLFLLSAYQEFIEFGNDGGPAAKTLKPKFNLFVKLVSKNTGLGVPHIDIKTVIAATMFLKGFGGLLFIFSSSFGAFLLLIYLAFMTPIVYDFYNYEMESEQFVQLFFKFTQNLAFIGALLFFLGMKNSIPRRRSKGRTTKTKTN

SEQ ID NO: 686 - DNA, 754 bp, Arabidopsis thaliana
  misc_feature (1)..(754): Ceres SEEDLINE ID no.ME05392
  misc_feature (1)..(754): Ceres CLONE ID no.21740
  misc_feature (1)..(754): Inplanta Sequence
  misc_feature (1)..(754): Encodes the peptide sequence at SEQ ID NO. 687
aaaaatcttctctatcctttctcgagagaatatggatcagatcttcaacaaggttggatcctactggttaggccaaaaggctaacaagcagtttgactccgtcggcaacgatctcaactcggtgtcaacgagcattgaaggaggaacaaaatggttggtcaacaaaatcaaagggaaaatgcagaagccgttgcctgagttactaaaagaatatgatttgccgattggaatcttcccgggagatgctacaaactacgagttcgatgaagagacaaagaaactaaccgttttgatcccatcgatatgcgaagttggatacaaggattcatcagtgttgaagttcacaacaacagtaacaggacatcttgagaaaggaaagctaacagatgtggaaggaatcaagacaaaagtaatgatatgggtaaaagtgacaagcatatctacagatgcatcaaaggtctatttcactgcaggaatgaagaagagcagaagcagagatgcttatgaggttcaaagaaatggtctccgagtcgataaattctaacacctgtctgtgttctgtctggttccaaagtttcaagcttttccatttacgttttggttttgatttaaagcctcctactgtgagtatacatcaacttatttataaatctgatcataacttcaatatggccggagcaattctactttgttctttttttttccaattgtaaagaactactattcgtgtgctcaatgatttggtcttacaatt

SEQ ID NO: 687 - protein, 170 aa, Arabidopsis thaliana
  misc_feature (1)..(170): Ceres SEEDLINE ID no.ME05392
  misc_feature (1)..(170): Ceres CLONE ID no.21740
  misc_feature (1)..(170): Bit score of 410.9 for HMM based on sequences of FIGURE 21.
  misc_feature (32)..(170): Pfam Name: DUF538 Pfam Description: Protein of unknown function, DUF538
MDQIFNKVGSYWLGQKANKQFDSVGNDLNSVSTSIEGGTKWLVNKIKGKMQKPLPELLKEYDLPIGIFPGDATNYEFDEETKKLTVLIPSICEVGYKDSSVLKFTTTVTGHLEKGKLTDVEGIKTKVMIWVKVTSISTDASKVYFTAGMKKSRSRDAYEVQRNGLRVDKF

SEQ ID NO: 688 - DNA, 894 bp, Gossypium hirsutum
  misc_feature (1)..(894): Ceres CLONE ID no.1841531
  misc_feature (1)..(894): Encodes the peptide sequence at SEQ ID NO 689
acggaagctcatctctctctttctctctctctctctctagatttcaccccttaggtttctctttcctcacagagacagagagagaatcagaggagcttaatcgagatttgatattcctcaccacagatggatcagatattgaacaaggtgggctcctattggctcggccagaaggccaacaaggagatcgattccgtcggcgacgacctcaactcattatccaccagtattgaagggggagccaaatggttggttaataaaatcaaaggaaaaatgcaaaagccgttgccagagctgttaagagagtataacctgccaataggaatcttccctcgtgatgccacaaattatgaattcaatgaagagactgggaagctcactgtttttattccagcaatatgtgaagtgggatacaaggactcatctttctgcgcttcttcaccactgtgactgggtatctggagaaaggaaagctggctgatatagagggtatgaagacaaaggtgatgatatgggtaaaagtaaccagtatcacttgtgaaggatcgaagatctatgtcacagccggaatgaagaaaagcaggaatagagaggcgtacgaggtttccagggatggagtaagtgtagataagttttaaagtggttaggatgccttggagatcctatttcttttaacttttaactctgaaccttcatacttttgtgtccataataagttttaggattcaagtgcaaagactggttaactttatggtttctactgtgataaggcttttactctgttctactatgttgaaggtgtctggccaaatatatatatatgtatataatgaaggtggcaatgcatgaaccttgtgtattaagatattataaattgtatggaaggtgctttag

SEQ ID NO: 689 - protein, 107 aa, Gossypium hirsutum
  misc_feature (1)..(107): Ceres CLONE ID no.1841531
  misc_feature (1)..(107): Bit score of 177.3 for HMM based on sequences of FIGURE 21.
  misc_feature (32)..(100): Pfam Name: DUF538 Pfam Description: Protein of unknown function, DUF538
  misc_feature (1)..(107): Functional Homolog Of Ceres SEEDLINE ID no. ME05392 at SEQ ID NO: 687
MDQILNKVGSYWLGQKANKEIDSVGDDLNSLSTSIEGGAKWLVNKIKGKMQKPLPELLREYNLPIGIFPRDATNYEFNEETGKLTVFIPAICEVGYKDSSFCASSPL

SEQ ID NO: 690 - DNA, 513 bp, Populus balsamifera subsp. trichocarpa
  misc_feature (1)..(513): Ceres ANNOT ID no.1507382
  misc_feature (1)..(513): Encodes the peptide sequence at SEQ ID NO 691
atggatgcggtattgaacaaggttggctcttattggctcggtcagaaagctagcaaggagttcaattctgtaggcgacgacatcaactcattgtcaacgagcattgaaggtggaaccaaatggttggtaaacaaactcaaaggaaaaatgcaaaagccgttaccagatttgcttaaggagtatgacttgccaataggaatcttccctcgtgatgccaccaactatgagttcaatgaagagacgagaaagcttactgtctttattccctcaatctgtgaagtcggctacaaggactcatctgttgtgcgctttttgaccaccgtaactgggtatttggagaaaggaaaaatagctgatatagaggggatgaagactaaagtgatgatttgggttaaagtgacctgtattgcatctactggatcaaagctcaacttcacagctgggatgaagaaaaccagagatagaggggcttatgaggttcttcgagatggagtgggcatagataagttctga

SEQ ID NO: 691 - protein, 170 aa, Populus balsamifera subsp. trichocarpa
  misc_feature (1)..(170): Ceres ANNOT ID no.1507382
  misc_feature (1)..(170): Bit score of 413.9 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDAVLNKVGSYWLGQKASKEFNSVGDDINSLSTSIEGGTKWLVNKLKGKMQKPLPDLLKEYDLPIGIFPRDATNYEFNEETRKLTVFIPSICEVGYKDSSVVRFLTTVTGYLEKGKIADIEGMKTKVMIWVKVTCIASTGSKLNFTAGMKKTRDRGAYEVLRDGVGIDKF

SEQ ID NO: 692 - DNA, 513 bp, Populus balsamifera subsp. trichocarpa
  misc_feature (1)..(513): Ceres ANNOT ID no.1476001
  misc_feature (1)..(513): Encodes the peptide sequence at SEQ ID NO 693
atggatgcgatattgaacaaagttgggtcttattgggtcggtcagaaagctagcaaggagttcaattctgtcggcgacgacatcaattcattatcgacaagcattgaaggaggaaccaaatggttggtgaacaagctcaaaggaaaaatgcaaaagccgttaccagatctgcttaaggagtatgacttgccaattggaatctttcctcgtgatgccaccaactatgagttcaatgaagagacacggaagcttactgtgtttattccttcgatctgtgaagttggctacaaggactcatctgttgtgcgtttttcgaccacagtaactgcatttttggagcaaggaaaactagctgatatagaggggatgaagactaaagtgatgatctgggttaaagtgtcctgtattgtatctgctggatcaaagctcaacttcacagctgggatgaagagaaccagggatagaggggcttatgaggttcttcgagatggggtgggcgtagataagttctga

SEQ ID NO: 693 - protein, 170 aa, Populus balsamifera subsp. trichocarpa
  misc_feature (1)..(170): Ceres ANNOT ID no.1476001
  misc_feature (1)..(170): Bit score of 399.9 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDAILNKVGSYWVGQKASKEFNSVGDDINSLSTSIEGGTKWLVNKLKGKMQKPLPDLLKEYDLPIGIFPRDATNYEFNEETRKLTVFIPSICEVGYKDSSVVRFSTTVTAFLEQGKLADIEGMKTKVMIWVKVSCIVSAGSKLNFTAGMKRTRDRGAYEVLRDGVGVDKF

SEQ ID NO: 694 - protein, 170 aa, Arabidopsis thaliana
  misc_feature (1)..(170): Public GI ID no.28466909
  misc_feature (1)..(170): Bit score of 406.1 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQIFNKVGSYWLGQKANKQFDSVGNDLNSVSTSIEGGTKWLVNKIKGKMQKPLPELLKECDLPIGIFPGDATNYEFDEETKKLTVLIPSICEVGYKDSSVLKFTTTVTGHLEKGKLTDVEGIKTKVMIWVKVTSISTDASKVYFTAGMKKSRSRDAYEVQRNGLRVDKF

SEQ ID NO: 695 - DNA, 800 bp, Arabidopsis thaliana
  misc_feature (1)..(800): Ceres CLONE ID no.20180
  misc_feature (1)..(800): Encodes the peptide sequence at SEQ ID NO 696
gatagaaccaaaaaaaaaacacctccgatctcggcgagagaaagagaaacgatctgtgagagagaatggatcagatcttgaacaaggtaggctcgtactggttaggtaagaaggcgaacaagcagctcgattccgtcggtgacgatatcaactctctgtcttcgagcatcgaaggaggaacaaaatggttggtgaacaaaatcaaaggaaaaatgcagaagccattgcccgagttattaaaggagtttggtttgcctgtggggatctttccacgtgatgcaaccaactacgagttcaatgaacagacgaggaagttaactgtctttattccatcaatctgcgaagttggttacaaagatacatcagtcttgagattcaccactacagttaccggatttctcgagaagggaaagctagctgatgttgaagggatgaagacaaaagtaatgatatgggttaaagtcacaagtatttctgcagattcttcaaaggtacatttcacagcagggatgaagaaaagcagaagccgagatgcttatgaggttttaagagatggcgttgagattgataaattctagctctgttttgctggtaattctcaattcttttatcatctttctccaatctctatctttaaagtttcaagtttcttaaaaaaatggtttttgtatatgctgattttcaattatgttgaagttcatgaatttgataaactgaagaatatggttactcagtacaccaaacaatgttcttatgtcttttggtattacttactgagtcactgtttaagcatatgaccg

SEQ ID NO: 696 - protein, 170 aa, Arabidopsis thaliana
  misc_feature (1)..(170): Ceres CLONE ID no.20180
  misc_feature (1)..(170): Bit score of 411.1 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQILNKVGSYWLGKKANKQLDSVGDDINSLSSSIEGGTKWLVNKIKGKMQKPLPELLKEFGLPVGIFPRDATNYEFNEQTRKLTVFIPSICEVGYKDTSVLRFTTTVTGFLEKGKLADVEGMKTKVMIWVKVTSISADSSKVHFTAGMKKSRSRDAYEVLRDGVEIDKF

SEQ ID NO: 697 - protein, 170 aa, Arabidopsis thaliana
  misc_feature (1)..(170): Public GI ID no.15240103
  misc_feature (1)..(170): Bit score of 404.9 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQILNKVGSYWLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGMKTKVMIWVKVTCISADSSKVYFTAGIKKSRSRDAYEVIRPGVGVDKF

SEQ ID NO: 698 - DNA, 665 bp, Brassica napus
  misc_feature (1)..(665): Ceres CLONE ID no.978410
  misc_feature (1)..(665): Encodes the peptide sequence at SEQ ID NO 699
  misc_feature (68)..(68): m is a or c
gccttcaaatttttggatttcctgaagaaatctttgtgtaatcgagaataaatggatcaggtgttcamcaaggttggatcctactggttaggccagaaggcgaacaagcagtttgactctgtcggcaaggatgtcagctcgctatcaacgagcatcgaaggaggaacaaaatggttggtcaacaaattcaaaggaacaatgcagaagccgttggctgagttgctaaaagactatgatttgccggttggcatcttcccacgcgatgctacaaactacgagttcgatgagcagacaaagaaactgacggtgctgatcccatcagtctgcgaagttggctacaaagactcatctgtcttaaaattcaccacaacagtaacgggacgtcttgagaaaggaaagctaggtgacttggaaggaatgaagacaaaagtaatgatatgggtcaaagtcacaagcatctctgcagattcatcaaaggtctatttcactgcaggtgtgaagaagagcagaaaccgagatgcttatgaggtgctaagagatggcgtccgagccgataaattttagttactccatatattcttctccttaccgactcttcttacttgaaacatataaatatttttccttcttcaatttgcacgatcggcttcatttgaagatacatt

SEQ ID NO: 699 - protein, 170 aa, Brassica napus
  misc_feature (1)..(170): Ceres CLONE ID no.978410
  misc_feature (1)..(170): Bit score of 396.6 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
  misc_feature (6)..(6): Xaa is any aa, unknown or other
MDQVFXKVGSYWLGQKANKQFDSVGKDVSSLSTSIEGGTKWLVNKFKGTMQKPLAELLKDYDLPVGIFPRDATNYEFDEQTKKLTVLIPSVCEVGYKDSSVLKFTTTVTGRLEKGKLGDLEGMKTKVMIWVKVTSISADSSKVYFTAGVKKSRNRDAYEVLRDGVRADKF

SEQ ID NO: 700 - DNA, 667 bp, Brassica napus
  misc_feature (1)..(667): Ceres CLONE ID no.949096
  misc_feature (1)..(667): Encodes the peptide sequence at SEQ ID NO 701
  misc_feature (53)..(53): r is g or a
aaacttcacttcctccgatctcggcgagagagagagaatggatcagatcttgracaaagtcggatcgtactggctagggaagaaggctaacaagcagctcgattccgtcggcgacgatatcaactctctgtccacgagcatcgaaggaggaacaaaatggctggtgaacaaaatcaaagggaagatgcagaagccattacccgagttactcaaggagtttggtttgcctgttgggatctttccacgcgacgcaaccaactacgagttcaatgaacagaccaggaaactcaccgtctttatcccaacgatctgcgaagtcggctacaaagactcatcggtcttgaggttcaccacgaccgttacagggtttttggagaaaggaaagctggccgatgttgaagggatgaaaacaaaagtaatgatttgggttaaagtcacgagcatctctgctgactcttcaaaggtgcatttcacggcagggatgaagaaaagcagaagccgtgatgcttatgaggttttgagagacggcgttgagattgataagttctaagctctgatttgccgttatctcctatcttcttatgtttccatctttatgtcttttctaaatctgtctttgtatatgcaattgacgttggtgttcatgaatctcatgaattgaattggt

SEQ ID NO: 701 - protein, 170 aa, Brassica napus
  misc_feature (1)..(170): Ceres CLONE ID no.949096
  misc_feature (1)..(170): Bit score of 410.1 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
  misc_feature (6)..(6): Xaa is any aa, unknown or other
MDQILXKVGSYWLGKKANKQLDSVGDDINSLSTSIEGGTKWLVNKIKGKMQKPLPELLKEFGLPVGIFPRDATNYEFNEQTRKLTVFIPTICEVGYKDSSVLRFTTTVTGFLEKGKLADVEGMKTKVMIWVKVTSISADSSKVHFTAGMKKSRSRDAYEVLRDGVEIDKF

SEQ ID NO: 702 - DNA, 810 bp, Glycine max
  misc_feature (1)..(810): Ceres CLONE ID no.527314
  misc_feature (1)..(810): Encodes the peptide sequence at SEQ ID NO 703
  misc_feature (223)..(223): r is g or a
  misc_feature (431)..(431): n is a, c, t, g, unknown, or other
  misc_feature (531)..(531): r is g or a
  misc_feature (538)..(538): y is t/u or c
  misc_feature (545)..(545): y is t/u or c
  misc_feature (563)..(563): k is g or t/u
  misc_feature (603)..(603): r is g or a
  misc_feature (759)..(759): y is t/u or c
acattacgtttgtgtttggttctctttctcttctctttatctgaacgaaggagagagtgaaagatccttttgtggatcgaacatcttgcgttttattgtggtgttgaggatcgaaaatggatcagatattcaacaaggtcggatcctattggttcaaccagaaagcctccagccagctcaattccgttggtgatgacatcaattcgatgacaaacagtattgragggggaaccaaatggttggtcaacaaaataaaaggaaagatgcaaaaggcattgccagagttgctaaaggagtacgatctaccaataggaatctttcctcgtgatgcaacaaactatgaattcaatgaagaaacaggaaagcttgttgtttacattcctcaagtatgtgaagttggctacaaggattcatcagtcttgcgtttcttnaccaccgtgactggttatctggagaaaggaaagttagcagacatagaaggaatgaagacaaaagtattgatctgggtgaaagtaacaaccattttgtcaragggatygaagctytatgtgacagctggcatkaagaaaacaaggagtagggaagcgtacgaggttacaagaratggtgtatgcatagataagttttaaaaccatcaatgtttgttaatagttttataatctgtaaaacccatctgttattttgacctccctgtgcatgattgttaattgtaagtagtgttccaatatgtacttcaaatattgtccttggattcgaatyttgcaatttggtgaaagtaaaatgtccttatggtcatgctgtgtttggatt

SEQ ID NO: 703 - protein, 170 aa, Glycine max
  misc_feature (1)..(170): Ceres CLONE ID no.527314
  misc_feature (1)..(170): Bit score of 402.7 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
  misc_feature (36)..(36): Xaa is any aa, unknown or other
  misc_feature (105)..(105): Xaa is any aa, unknown or other
  misc_feature (139)..(139): Xaa is any aa, unknown or other
  misc_feature (141)..(141): Xaa is any aa, unknown or other
  misc_feature (143)..(143): Xaa is any aa, unknown or other
  misc_feature (149)..(149): Xaa is any aa, unknown or other
  misc_feature (163)..(163): Xaa is any aa, unknown or other
MDQIFNKVGSYWFNQKASSQLNSVGDDINSMTNSIXGGTKWLVNKIKGKMQKALPELLKEYDLPIGIFPRDATNYEFNEETGKLVVYIPQVCEVGYKDSSVLRFXTTVTGYLEKGKLADIEGMKTKVLIWVKVTTILSXGXKXYVTAGXKKTRSREAYEVTRXGVCIDKF

SEQ ID NO: 704 - DNA, 841 bp, Glycine max
  misc_feature (1)..(841): Ceres CLONE ID no.624000
  misc_feature (1)..(841): Encodes the peptide sequence at SEQ ID NO 705
  misc_feature (510)..(510): m is a or c
acacttctcagaatttatgttgtgaagtttgtttattctgagaaggaagagagaatagaacgccatggatgagatattgaacaaggtggggtcttactggttctccaagaaggccagcaaggaatttaactctgtcggcgatgatatcaactcactgtcaaccagtattgaagggggaaccaaatggttggtcaacaagttaaaaggaaagatgcaaaaggcattaacagagttgctaaaggagtatgatctacccataggaatctttcctcgcgatgcgacaaactacgaatttaacgaagagacaggaaagcttgttgtttacattcctcaagtgtgtgaggttggctacagggattcgtcagttctgcgtttctccaccagcgtgagtggctattttggagaaagggaagctagcagaaatagaaggaatcaagaccaaagtgctgatatgggtaaaagtgactgccatttcatccgagggaccaaagctccatttcacggccggcmtgaagaaaacaaggaaaagggaagcatatgaggttactagagatggtgtaacggtagataagttctaatatattaacaaggagctccttttgttaagtagttttacaatttagtaaaataaattgtcccttcttgtggaccattttattctattagatttgaatgtagtgaaacctgagacttggtggaactcctcctgagtcctttttgatgatgtagtttcagtttttttctgcttgggtttattaagttctattcctaatgtcacatggcttgtattaaatactgaaacttatgggcaagtgatattgtcatagtattattttagctc

SEQ ID NO: 705 - protein, 158 aa, Glycine max
  misc_feature (1)..(158): Ceres CLONE ID no.624000
  misc_feature (1)..(158): Bit score of 231.8 for HMM based on sequences of FIGURE 21.
  misc_feature (32)..(114): Pfam Name: DUF538 Pfam Description: Protein of unknown function, DUF538
  misc_feature (1)..(158): Functional Homolog Of Ceres SEEDLINE ID no. ME05392 at SEQ ID NO: 687
  misc_feature (149)..(149): Xaa is any aa, unknown or other
MDEILNKVGSYWFSKKASKEFNSVGDDINSLSTSIEGGTKWLVNKLKGKMQKALTELLKEYDLPIGIFPRDATNYEFNEETGKLVVYIPQVCEVGYRDSSVLRFSTSVSGYFGEREASRNRRNQDQSADMGKSDCHFIRGTKAPFHGRXEENKEKGSI

SEQ ID NO: 706 - protein, 170 aa, Medicago truncatula
  misc_feature (1)..(170): Public GI ID no.92893019
  misc_feature (1)..(170): Bit score of 414.7 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQVFNKVGSYWFNQKASKELNSVGDEINSLSNSIEGGTKWLVNKVKGKMQKPLPELLKEYDLPIGIFPRDATNYEFNEETGKLEVFIPQVCEVGYKDSSVLRFFTTVTGYLEKGKLADIEGMKTKVIIWVKVTTIFSEGSKLYVTAGMKKTRSREAYDVTRDGVPVDKF

SEQ ID NO: 707 - DNA, 773 bp, Triticum aestivum
  misc_feature (1)..(773): Ceres CLONE ID no.638935
  misc_feature (1)..(773): Encodes the peptide sequence at SEQ ID NO 708
acgacgaggctccccacaattccctcctcctgcgaacgcatcgtatcccaagaaaccaagaaacagagcaagaaatatcatagagggagcagagtacagagagagaaagagggataagcgcttgcttgctgggagagccatggatgagatcatgaacaagatgggctcctactggctggggcagagggccaacaaagagatgtcgtcggccggtgacgacatcgagtcgctctcaaccagtgtcggggacggagcaaaatggctggtaaacaagctcaagggtaagatgcagaagccgctggcggagctgctccaggagcacgaccttccggcggggctgttcccgcgggaggccaccaactacgagttcgagccggagacgcggcggctgacggtgcacatcccggcggtctgcgaggtcggctacagggacggctccgagctgcgtttcgacaccacggtgaccggcacgctggacaagggcagcctgacgggggtggagggcctcaaagccaaggtgctcgtctgggccagggtcaccgccgtcaaggccgacgccgcaaaggtctacttcgccgtaggcatcaagaagtcgcgcagccgcgaggcatacgaggtcgtcagaggcgccatcaccgtcgacgagttctagattctagtcgcgcgctcgccgagatgattattctaccgaaataattgatcatgtgctcacactacctgctgtaagaggaggatgcttgtaaatggggattcataattcagtttcgcagctc

SEQ ID NO: 708 - protein, 170 aa, Triticum aestivum
  misc_feature (1)..(170): Ceres CLONE ID no.638935
  misc_feature (1)..(170): Bit score of 380.2 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDEIMNKMGSYWLGQRANKEMSSAGDDIESLSTSVGDGAKWLVNKLKGKMQKPLAELLQEHDLPAGLFPREATNYEFEPETRRLTVHIPAVCEVGYRDGSELRFDTTVTGTLDKGSLTGVEGLKAKVLVWARVTAVKADAAKVYFAVGIKKSRSREAYEVVRGAITVDEF

SEQ ID NO: 709 - DNA, 1013 bp, Triticum aestivum
  misc_feature (1)..(1013): Ceres CLONE ID no.685975
  misc_feature (1)..(1013): Encodes the peptide sequence at SEQ ID NO 710
  misc_feature (665)..(665): y is t/u or c
  misc_feature (779)..(779): y is t/u or c
  misc_feature (902)..(902): y is t/u or c
acacaattccctcctcctgcgaacgcatcgtatcccaagaaaccaagaaacagagcaagaaatatcatagagggagcagagtacagagagagaaagagggataagcgcttgcttgctgggagagccatggatgagatcatgaacaagatgggctcctactggctggggcagagggccaacaaagagatgtcgtcggccggtgacgacatcgaggtccgtgcatgagacaccgtctcatcaatcttctgttctgttctgttgtcgcaccatatttcccctgattattgtttggtcatggtattgtttctgttctcgctagcatgttttccttctggttttagatcgatcctggctggaccgccatgtgatacttttggttcgacgttcaagctcgctataacaaatttgaaatccgactctgataattaagatctatgattcgatgtattcctctggctgatgatctattggtggtgcagtcgctctcaaccagtgtcggggacggagcaaaatggctggtaaacaagctcaagggtaagatgcagaagccgctggcggagctgctccaggagcacgaccttccggcggggctgttcccgcgggaggccaccaactacgagttcgagccggagacgcggcggctgacggtgcacatcccggcggtytgcgaggtcggctacagggacggctccgagctgcgtttcgacaccacggtgaccggcacgctggacaagggcagcctgacgggggtggagggcctcaaagccaaggtgctcgtytgggccagggtcaccgccgtcaaggccgacgccgcaaaggtctacttcgccgtaggcatcaagaagtcgcgcagccgcgaggcatacgaggtcgtcagaggcgccatcaccgtcgacgagttytagattctagtcgcgcgctcgccgagatgattattctaccgaaataattgatcatgtgctcacactacctgctgtaagaggaggatgcttgtaaatggggattcataatcc

SEQ ID NO: 710 - protein, 156 aa, Triticum aestivum
  misc_feature (1)..(156): Ceres CLONE ID no.685975
  misc_feature (1)..(156): Bit score of 269.9 for HMM based on sequences of FIGURE 21.
  misc_feature (18)..(155): Pfam Name: DUF538 Pfam Description: Protein of unknown function, DUF538
  misc_feature (1)..(156): Functional Homolog Of Ceres SEEDLINE ID no. ME05392 at SEQ ID NO: 687
  misc_feature (77)..(77): Xaa is any aa, unknown or other
  misc_feature (115)..(115): Xaa is any aa, unknown or other
  misc_feature (156)..(156): Xaa is any aa, unknown or other
MIRCIPLADDLLVVQSLSTSVGDGAKWLVNKLKGKMQKPLAELLQEHDLPAGLFPREATNYEFEPETRRLTVHIPAXCEVGYRDGSELRFDTTVTGTLDKGSLTGVEGLKAKVLXWARVTAVKADAAKVYFAVGIKKSRSREAYEVVRGAITVDEX

SEQ ID NO: 711 - DNA, 712 bp, Zea mays
  misc_feature (1)..(712): Ceres CLONE ID no.1437744
  misc_feature (1)..(712): Encodes the peptide sequence at SEQ ID NO 712
ccttcctccgattccggcgatccagaccgaatccggccgattcgaggtggactgggggttcgggttcggggcggggaagaggggaggagggggagatggaccaggtgctgaacaaggtggggagctactggttcagcaagagggccagcaaggagatcgactccatcggcgacgacctcaactcggtctcttccagtattggcgggggagctaaatggatggtgaacaagatcaaagggaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttctgacatcgagggcatgaagaccaaggtgcttgtatggaccaaggtgacctccatcaagaccgagggctcaaaggtccatttcactgccggcatgaagaagacccgcagccgcgatgcgtatgaggttgtcagagatggcatcatcatagacaagttctagagcatacctgtacctgggctggtaggtgcaatgtaattacttagatatgctacattggaatctgttgtgctatcggattggcctattaatcaactgtgttgcac

SEQ ID NO: 712 - protein, 170 aa, Zea mays
  misc_feature (1)..(170): Ceres CLONE ID no.1437744
  misc_feature (1)..(170): Bit score of 409.2 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQVLNKVGSYWFSKRASKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 713 - DNA, 999 bp, Zea mays
  misc_feature (1)..(999): Ceres CLONE ID no.219707
  misc_feature (1)..(999): Encodes the peptide sequence at SEQ ID NO 714
  misc_feature (135)..(135): k is g or t/u
caggagggagcggatgagatagacaaacagaaagagcccgtgtgcgtgacgcacggacgccgtgactccgccgcaaagagagggagtccacggtctgaagaagcaacggcgacgcccccgacgacgagcatagckgccccgcaaactagcagcgccctcgtcagttccgtctcgttcccaacctctcccggattcgattcgattgacccgtccgctccaaatcgaatctaatcagcagttttggagttgcggaagggagaaagagagaggagagggggcatggatcaggtgctaaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcacttccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgaaaaggggaagttttccgacatcgagggcatgaagaccaaagtgctggtctggaccaaggtgactgccatcaagaccgagggcccaaaggtccatttcactgcaggcgtgaagaagactcggagccgtgatgcctatgaggtcgtcagagatggtatcaccatagacaagttctagagcatatacctggcatgaaaaatgtgacgcggttattcatatatgcttctctcctctcagttggtacaccgaaattcatacaatatcgtgggctaattctgcatttgtatgaaagtttaatatgcttgacgtgttaatcacactgctagagcatgcgataaatcgcagttggttcattattaggaaattgcattgagctgtaatcac

SEQ ID NO: 714 - protein, 170 aa, Zea mays
  misc_feature (1)..(170): Ceres CLONE ID no.219707
  misc_feature (1)..(170): Bit score of 403.6 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQVLNKVGSYWFSKRASKEIDSIGDDISSISSSIGGSAKWMVNKIKGKMQKALPDLLKEYDMPAGLFPRDTTNYEFNEETKKLTVYIPSACDVGYKDSSVLRFFTCVTGYLEKGKFSDIEGMKTKVLVWTKVTAIKTEGPKVHFTAGVKKTRSRDAYEVVRDGITIDKF

SEQ ID NO: 715 - DNA, 899 bp, Zea mays
  misc_feature (1)..(899): Ceres CLONE ID no.283477
  misc_feature (1)..(899): Encodes the peptide sequence at SEQ ID NO 716
  misc_feature (72)..(72): s is g or c
aacgcacgacctgttgaaccagggcgcgccctcccagggttcctttcttctccgtctccgcgtaggcgtagsgaagaagctaacctagaatcaaagagatcgcacgcaagagggagcaccggagcagcgagccagcgacagcagcagagagatcgccggggccgctcgcctgtctggagagaggaaggaaacaagagatggacgagatcatgaacaaggtgggcgcttactggctggggcagagggccaacaaggagatctcctcggcaggcgacgacctcgattcgctctcgaccagcgtcggggatggagcgaaatggctggtgaacaagctgaagggcaagatgcagaagccgctggcggacctgctcaaggagcacaacctccccgtgggcctgttcccgcgcgaggcgaccaactacgagttcgtgccagagacgcggcgcctgacggtgtacatcccgtccccctgcgaggtcggctaccgcgacggctccgagctgcggttcgacgccacggtgttgggcacgctgggcgagggccgcctcacggaggtggaagggatcaagaccaaggtgctcgtctgggccagggtcaccgccgtcaaggccgacgccgccaaggtccacttcaccgccgggatcaagaggtcgcgcagccgggacgcctacgaggtcgtcaggggcggcatcaccgtcgacgagttctagcttagttttgctttcgcggctcacatggatggacgggcttcctcttgctcgctgcacgctgagatggacagattgttgctttcagttgcaggaataaattctacacccattagctatgtgggagatctgcgtgcactgtgcatcgtgtgttttgtgctttgttgtgagaatgtaacacctgaaggattc

SEQ ID NO: 716 - protein, 170 aa, Zea mays
  misc_feature (1)..(170): Ceres CLONE ID no.283477
  misc_feature (1)..(170): Bit score of 365.3 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDEIMNKVGAYWLGQRANKEISSAGDDLDSLSTSVGDGAKWLVNKLKGKMQKPLADLLKEHNLPVGLFPREATNYEFVPETRRLTVYIPSPCEVGYRDGSELRFDATVLGTLGEGRLTEVEGIKTKVLVWARVTAVKADAAKVHFTAGIKRSRSRDAYEVVRGGITVDEF

SEQ ID NO: 717 - DNA, 772 bp, Musa acuminata
  misc_feature (1)..(772): Ceres CLONE ID no.1728293
  misc_feature (1)..(772): Encodes the peptide sequence at SEQ ID NO 718
gaaaggggggcttttggatctcgattccttcccaagtggaagagatagcagcgagagatggatcagatactgaacaaggtcgggtcgtattggattaacaagagagccaacaaggagatttcctccgtcggtgacgacctcaactcactctctagcagcattgaagggggagcaaaatggttggtcaataagttaaaaggaaagatgcagaaatcattgcctgaactgctgagggaatacgacatgccaataggcctctttccacaagacgccactcactatgaatttaacgaagagacggggaagcttactgttttcataccctccatatgcgaggtgggttacagggattcctcagtcttgcgatttttaaacatcgtgactgggtatctggagaaaggaaagctagttgacatagaaggaatcaagaccaaagtgctgatttggtcgaaagtaactcgcatctccacggaaggatccaaaatccatttcacgactggagtgaagaaaacccggagtcgtgatgcatatcaggtgctcagagctggtatcactgtggataaattttaggctgctttgagatggtaaattactgtgtggaagatactaatgtcagctaagatgtcatcatttacatgatgttatcctgttaatctctaaaccctgcacttcaagatgcttctctattgttttctttttcttagcatgtcaatgtgcttgtaaataaaggcaccatttcttatcagctttatgcagcttacaaactgttccc

SEQ ID NO: 718 - protein, 170 aa, Musa acuminata
  misc_feature (1)..(170): Ceres CLONE ID no.1728293
  misc_feature (1)..(170): Bit score of 407.2 for HMM based on sequences of FIGURE 21.
  misc_feature (32)..(170): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQILNKVGSYWINKRANKEISSVGDDLNSLSSSIEGGAKWLVNKLKGKMQKSLPELLREYDMPIGLFPQDATHYEFNEETGKLTVFIPSICEVGYRDSSVLRFLNIVTGYLEKGKLVDIEGIKTKVLIWSKVTRISTEGSKIHFTTGVKKTRSRDAYQVLRAGITVDKF

SEQ ID NO: 719 - DNA, 888 bp, Musa acuminata
  misc_feature (1)..(888): Ceres CLONE ID no.1716262
  misc_feature (1)..(888): Encodes the peptide sequence at SEQ ID NO 720
ctgcctctgtcttcgcttccatcccccttgtcgaattcttatcgccctcggaagagaagaagcgaaagggagggggcttttggattctcgattccgttgcaagaggaagaactagcagtgagatggatcagatactgaacaaggttggatcgtattggatcaacaagcgagccgacaaggagatctcctccgtcggtgacgacatcaactcactctctagcagcattgaagggggagcaaaatggttggtcaataagctcaaaggaaagatgcagaaatcattgcctgaactgctgagggaatacgatatgccgataggcctgtttcctcaggatgcaactcactacgagttcaacgaagagacagggaagctcgctgtatacataccctccatatgcgaggttggctacagggattcttcggtctttgcgctttttaaccatcgtgacccggttatctagagaaaggaaagctggtcgagatcgaagggatcaaaaccaaagtgctgatttgggcaaaagtgaattccatcaccaccgagggatccaaaatccacttcaccaccggcgtgaagaagaccaggagccgcgatgcatatgaggtgcttagaggtggtatcaccgtggacaagttttaggctgctatgagatggtttactagtgtgcgtagtgcataagctaccatgttattgatgtgggactctttgaaccttgtcaatcctcctatctcaataattatatcatcttggaattgtggtgacatatcagtggtttcttgctctttatttcttctccttccaggctatcgtgaggtgatttatgtaaaaggatgaaagaaaataatgttcaagaccacccaacttggcaaagtccaataaactgcatgacg

SEQ ID NO: 720 - protein, 112 aa, Musa acuminata
  misc_feature (1)..(112): Ceres CLONE ID no.1716262
  misc_feature (1)..(112): Bit score of 172.7 for HMM based on sequences of FIGURE 21.
  misc_feature (32)..(102): Pfam Name: DUF538 Pfam Description: Protein of unknown function, DUF538
  misc_feature (1)..(112): Functional Homolog Of Ceres SEEDLINE ID no. ME05392 at SEQ ID NO: 687
MDQILNKVGSYWINKRADKEISSVGDDINSLSSSIEGGAKWLVNKLKGKMQKSLPELLREYDMPIGLFPQDATHYEFNEETGKLAVYIPSICEVGYRDSSVFALFNHRDPVI

SEQ ID NO: 721 - protein, 170 aa, Oryza sativa subsp. indica
  misc_feature (1)..(170): Public GI ID no.125526460
  misc_feature (1)..(170): Bit score of 400.7 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQIMGKVGGYWFKQNAGKEINNIGDDINSISSSIGDGAKWMVNKIKGKMQKPLPEFLKEYDLPVGLFPQDATNYEFNEETKKLTVYISSVCEVGYKDSSVLRFSTTVTGYLENGKLSEVEGLKTKILIWTKVTAVRTEATKVHFAAGMNKARNRDAYEVVRDGVGIDKF

SEQ ID NO: 722 - protein, 199 aa, Oryza sativa subsp. indica
  misc_feature (1)..(199): Public GI ID no.125551916
  misc_feature (1)..(199): Bit score of 371.9 for HMM based on sequences of FIGURE 21.
  misc_feature (61)..(198): Pfam Name: DUF538 Pfam Description: Protein of unknown function, DUF538
  misc_feature (1)..(199): Functional Homolog Of Ceres SEEDLINE ID no. ME05392 at SEQ ID NO: 687
MDQVLNKVGSYWFSKRASKEIDSIGDDISLLVEADAADTGKGIEWNSRRRLVEIVTVQSISTSIGTGAKWMVNKIKGKMQKALPDLLKEYDMPAGLFPRDATNYEFNEETKKLTVYIPSACDVGYKDSSVLRFFTCVTGYLEKGKLSDIEGLKTKVLVWTKVTAIKTEGSKVHFTAGVKKTRSRDAYEVVRDGIPIDKF

SEQ ID NO: 723 - protein, 206 aa, Oryza sativa subsp. indica
  misc_feature (1)..(206): Public GI ID no.125543488
  misc_feature (1)..(206): Bit score of 319.1 for HMM based on sequences of FIGURE 21.
  misc_feature (68)..(205): Pfam Name: DUF538 Pfam Description: Protein of unknown function, DUF538
  misc_feature (1)..(206): Functional Homolog Of Ceres SEEDLINE ID no. ME05392 at SEQ ID NO: 687
MDDIMNKLGGYWLGQKANKEISSAGDDIEVRFFFLSFDRILFLCRCPDDDRRRRRRRRRRRVVVQSLSTSVGEGAKWLVNKLKGKMQKPLQELLREHDLPEGLFPREATNYEFSPETRRLTVHIPAACEVGYRDGSVLRFDATVSGTLEKGRLAEVEGLKTKVLVWARVTAVRADAAKVHFTAGIRKSRSRDAYEVVRGGIIVEEF

SEQ ID NO: 724 - protein, 170 aa, Oryza sativa subsp. japonica
  misc_feature (1)..(170): Public GI ID no.115463325
  misc_feature (1)..(170): Bit score of 412.2 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQVLNKVGSYWFSKRASKEIDSIGDDISSISTSIGTGAKWMVNKIKGKMQKALPDLLKEYDMPAGLFPRDATNYEFNEETKKLTVYIPSACDVGYKDSSVLRFFTCVTGYLEKGKLSDIEGLKTKVLVWTKVTAIKTEGSKVHFTAGVKKTRSRDAYEVVRDGIPIDKF

SEQ ID NO: 725 - protein, 170 aa, Oryza sativa subsp. japonica
  misc_feature (1)..(170): Public GI ID no.115437694
  misc_feature (1)..(170): Bit score of 396.4 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQIMGKVGGYWFKQNAGKEINNIGDDINSISSSIGDGAKWMVNKIKGKMQKPLPEFLKEYDLPVGLFPQDATNYEFNEETKKLTVYISSACEVGYKDSSVLRFSTTVTGYLEKGKLSEVEGLKTKILIWTKVMAVRTEATKVHFAAGMNKARNRDAYEVVRDGVGIDKF

SEQ ID NO: 726 - protein, 170 aa, Oryza sativa subsp. japonica
  misc_feature (1)..(170): Public GI ID no.115452467
  misc_feature (1)..(170): Bit score of 367.9 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDDIMNKLGGYWLGQKANKEISSAGDDIESLSTSVGEGAKWLVNKLKGKMQKPLQELLREHDLPEGLFPREATNYEFSPETRRLTVHIPAACEVGYRDGSVLRFDATVCGTLEKGRLAEVEGLKTKVLVWARVTAVRADAAKVHFTAGIRKSRSRDAYEVVRGGIIVEEF

SEQ ID NO: 727 - protein, 206 aa, Oryza sativa subsp. japonica
  misc_feature (1)..(206): Public GI ID no.125585930
  misc_feature (1)..(206): Bit score of 318.8 for HMM based on sequences of FIGURE 21.
  misc_feature (68)..(205): Pfam Name: DUF538 Pfam Description: Protein of unknown function, DUF538
  misc_feature (1)..(206): Functional Homolog Of Ceres SEEDLINE ID no. ME05392 at SEQ ID NO: 687
MDDIMNKLGGYWLGQKANKEISSAGDDIEVRFFFLSFDRILFLCRCPDDDRRRRRRRRRRRVVVQSLSTSVGEGAKWLVNKLKGKMQKPLQELLREHDLPEGLFPREATNYEFSPETRRLTVHIPAACEVGYRDGSVLRFDATVCGTLEKGRLAEVEGLKTKVLVWARVTAVRADAAKVHFTAGIRKSRSRDAYEVVRGGIIVEEF

SEQ ID NO: 728 - protein, 170 aa, Celosia cristata
  misc_feature (1)..(170): Public GI ID no.40642817
  misc_feature (1)..(170): Bit score of 409.2 for HMM based on sequences of FIGURE 21.
  misc_feature (32)..(169): Pfam Name: DUF538 Pfam Description: Protein of unknown function, DUF538
  misc_feature (1)..(170): Functional Homolog Of Ceres SEEDLINE ID no. ME05392 at SEQ ID NO: 687
MDQIFNKVGSYWLGQKANKEFNSVGDDINSMGSSIGDGTKWLVNKLKGKMQKPLPELLKDYDLAVGIFPRDATHYEFDERQGKLTVYVPQICEVGYKDSSVLRFFATVTGYLEKGKLADIEGLKTKIIIWVKVTAITSEGSKLHFTAGVKKTRSREAYQVLRDGVLVDKF

SEQ ID NO: 729 - DNA, 586 bp, Arabidopsis thaliana
  misc_feature (1)..(586): Ceres SEEDLINE ID no.ME05429
  misc_feature (1)..(586): Ceres CLONE ID no.5609
  misc_feature (1)..(586): Inplanta Sequence
  misc_feature (1)..(586): Encodes the peptide sequence at SEQ ID NO. 730
aaatcggagaaaagacggcgaaaatggaggaacagaacgctggaaccggtgccggcgaaagcagtttgttggatggatcaggtcactggtggtgggcattgggaagtggagcccaaatcatgtggggaatacgattgattcggagaggttacgccggcgacgttcgattaatgccgctcaaagccttcggtgtcgcatcactcttcgtcgggtcgttagccaccagctccgtcgcattagtccgcgccacggggatccacacggttcaagatgcgattgatcttggagccaacattagaaccaatttgggggttactcctcaaataccggataagcaaatcaccgagagagacgggtgatttatcatgaacagatcgagcttgaagctctatcggaattactgtgagacgatcatggaattaggtctctggtagatgattccataattatgtatgttttatataagataataccataatttataaggtttttgggttcataaaaatcagatgttatgtgaaaaattaaaaggttatgtgctctgagactctgattggttcaataaatcatatctcaagattgacgg

SEQ ID NO: 730 - protein, 111 aa, Arabidopsis thaliana
  misc_feature (1)..(111): Ceres SEEDLINE ID no.ME05429
  misc_feature (1)..(111): Ceres CLONE ID no.5609
  misc_feature (1)..(111): Bit score of 215.44 for HMM based on sequences of FIGURE 22.
MEEQNAGTGAGESSLLDGSGHWWWALGSGAQIMWGIRLIRRGYAGDVRLMPLKAFGVASLFVGSLATSSVALVRATGIHTVQDAIDLGANIRTNLGVTPQIPDKQITERDG

SEQ ID NO: 731 - DNA, 294 bp, Populus balsamifera subsp. trichocarpa
  misc_feature (1)..(294): Ceres ANNOT ID no.1539629
  misc_feature (1)..(294): Encodes the peptide sequence at SEQ ID NO 732
atggagaatggctgcggtggcggcatcgagacccagtggtggtggtggtgggcaatggcaagcatggccaagtttgggtggggcatttcagcatataaaagaggcttcgctggagactctcgtctcatgcccttaaaagcgttcgccgttgcctccctctttgtgggttccgccgcctctgcttccattgcttcccttcaagcgtctggcatccacaaggtacaagatcttatagaattgggagcaaatataaggactgggcttggggttcctccaagagtagcaaaagagtaa

SEQ ID NO: 732 - protein, 97 aa, Populus balsamifera subsp. trichocarpa
  misc_feature (1)..(97): Ceres ANNOT ID no.1539629
  misc_feature (1)..(97): Bit score of 241.3 for HMM based on sequences of FIGURE 22.
  misc_feature (1)..(97): Functional Homolog Of Ceres SEEDLINE ID no. ME05429 at SEQ ID NO: 730
MENGCGGGIETQWWWWWAMASMAKFGWGISAYKRGFAGDSRLMPLKAFAVASLFVGSAASASIASLQASGIHKVQDLIELGANIRTGLGVPPRVAKE

SEQ ID NO: 733 - protein, 126 aa, Arabidopsis thaliana
  misc_feature (1)..(126): Public GI ID no.7287996
  misc_feature (1)..(126): Bit score of 269.3 for HMM based on sequences of FIGURE 22.
  misc_feature (1)..(126): Functional Homolog Of Ceres SEEDLINE ID no. ME05429 at SEQ ID NO: 730
MEEQNAGTGAGESSLLDGSGHWWWALGSGAQIMWGIRLIRRGYAGDVRLMPLKAFGVASLFVGSLATSSVALVRATGIHTVQDAIDLGANIRTNLGVTPQIPDKQITERRVIYHEQIELEALSELL

SEQ ID NO: 734 - DNA, 766 bp, Glycine max
  misc_feature (1)..(766): Ceres CLONE ID no.682471
  misc_feature (1)..(766): Encodes the peptide sequence at SEQ ID NO 735
gattggtgccgccggtaaatgtcgccaaggtagatagaattagaagccctcgctggtgatttagtgaacccagaatcataagagaatatgaagatggaggaagccgcaggcagtggcaacagtgacggtggcaacaaatggtggtggggagtggccagcgctgctcaaatgggattgggaattcgtaccttcgccaaagggcacggaggcgattcgcgcctcatgcctttcaaagccttcgttgtagcttccctcttcgtcagcagcgccgcctccgcctccgttctactcctccaagctaacggcatccacagggtggaagatctcatgaaagcaggagcaaatttaagagcaaaacttggattacgtccacgaacgcagaataagaatatggatgattcatgacaatagactcagccatgtcttgtgctgatacctctggtgggttggttccctggtggatacaacaataattataataaacattcatgggatggtatttggaagtgttgaaggtttcatgcacaagtcagcaatcatattatggttgtcagaaacttcaactgatggattttctcagtttttgcccccaggtttcgcattacctagcccatttggtgcatcaactatccattgggtcatctgttatttacttaatttttaattgaatatagtcagtcagcacgttttttagtactcgcattggtaccattgtttcatgaagtggaatctaacttgacccctcaataaaagagattatttttcc

SEQ ID NO: 735 - protein, 105 aa, Glycine max
  misc_feature (1)..(105): Ceres CLONE ID no.682471
  misc_feature (1)..(105): Bit score of 247.2 for HMM based on sequences of FIGURE 22.
  misc_feature (1)..(105): Functional Homolog Of Ceres SEEDLINE ID no. ME05429 at SEQ ID NO: 730
MKMEEAAGSGNSDGGNKWWWGVASAAQMGLGIRTFAKGHGGDSRLMPFKAFVVASLFVSSAASASVLLLQANGIHRVEDLMKAGANLRAKLGLRPRTQNKNMDDS

SEQ ID NO: 736 - DNA, 621 bp, Triticum aestivum
  misc_feature (1)..(621): Ceres CLONE ID no.729869
  misc_feature (1)..(621): Encodes the peptide sequence at SEQ ID NO 737
gagccttgtgtgtttcagtgtgtgcatagtttgcaactcccaccgagctgtggtgtcccccaaataacctagcggcggcggcggcggcggcggtgatggatgagctgggtggaggcggcgggaagaagggcaaggcatggccctggtggcttggagcgagtgcggcccagatcaccggcgcgctggtttggttccggcgaggcaagggcggcagcgacatgacgatgccgttcagggcgttcgccgtcgcctcgctcttcgtcggcgccggcgccacgaccgtcaccgccggagtgtccgcggcgggcgtcggatcggtggaggagatgaagggcttgggcgcgaggatccggaagtggagcagagttcctcctcgccgggtggagggaggcgagtagcagtactgccatggatttgatctactgctagagcggcaagagtttccatgtgaggatcaagattgcttcacatgatcacacatttgggagatgcaaatcaataatcacatctgtactgtactactactctgtaggagtaactttgtagcgaaagcttgtttactcgaattttgatcctgccttctggaatatagccattgtactcgtctcccagattgaaacc

SEQ ID NO: 737 - protein, 100 aa, Triticum aestivum
  misc_feature (1)..(100): Ceres CLONE ID no.729869
  misc_feature (1)..(100): Bit score of 225.0 for HMM based on sequences of FIGURE 22.
  misc_feature (1)..(100): Functional Homolog Of Ceres SEEDLINE ID no. ME05429 at SEQ ID NO: 730
MDELGGGGGKKGKAWPWWLGASAAQITGALVWFRRGKGGSDMTMPFRAFAVASLFVGAGATTVTAGVSAAGVGSVEEMKGLGARIRKWSRVPPRRVEGGE

SEQ ID NO: 738 - protein, 101 aa, Oryza sativa subsp. japonica
  misc_feature (1)..(101): Public GI ID no.115459766
  misc_feature (1)..(101): Bit score of 219.4 for HMM based on sequences of FIGURE 22.
  misc_feature (1)..(101): Functional Homolog Of Ceres SEEDLINE ID no. ME05429 at SEQ ID NO: 730
MEEGGGGEEAERWPWWAGASAAQVAAGVAWFRRGRGGAAFAMPFKAFAIATLFVGAGATAVTAGVLAAGVGSVDEMKGVGASIRRWMGAPPRRRVEGGGDP

SEQ ID NO: 739 - DNA, 1824 bp, Populus balsamifera subsp. trichocarpa
  misc_feature (1)..(1824): Ceres ANNOT ID no.1450452
  misc_feature (1)..(1824): Encodes the peptide sequence at SEQ ID NO 740
atgggtgatactgaggaagcaaatagtgaaatgatacaaaggttgcaatcttcttttggaacaacgcaatcatcatctactaccatggctaagcaacccttttctttgataaaccaaatagatgtgtctcagttgagtttgaacccaacccaaatgcgggcgaggcattttacgaatttttctcagaattttagtggggatagtaacaaaagagtagggtttccgccttcccatcctaatcagatcccacccatttcgccttattcccagatcccagtgtccaggccagtgaaccagcaaatgggtccgcagagttttagtctggggcctactcattcgcgatctttgtcgcagccatcatcgtttttctcccttgattccttgcccccgttgagtccggcccctttccgggattcctcttcgccttcggtttcggaccctatttctactgacgtgttcatggaggagaaggatggtggttctcattcgttattgcctccctcgccttttaataggggcaatgctccacgggttgttgagagtttgcctccacggaaagcgcatagaaggtctaacagtgatattccatttggacttgctaatgtgttgcaatgttcaccgccccttattccgtcgaggggttcaagtgggttggagcggtcgatgtctgggagagaaaatttagggatggctaagccagcacaatcggtgaaaaaggaatgggagagaggtggtgacagcaatgcggaggggatgggtgagaggaaatctgaaggggaagtcgtggatgatttgttttctgcttacatgaatttagataacattgacgtgttgaactcctcgggtactgatgataagaatggtaatgagaatcgtgaggatttggatagtagagctagtgggaccaagacgaatggtggtgatagcagcgataatgaggcagaaagcagcgtgaatgaaagtggtggcaacctgccaagagcaggattgagttcttcaacagagaagagggaagggatcaaaaggagtgctgggggtgacattgctcctaccaccagacactacagaagtgtgtcaatggatagtttcatgggcaaattgaactttggtaacgaatcaccaaagctgccaccctccccaggaactcgtccaggacagctatcacccaccgattcaatagatgggaatgcctttagcttggattttgggaatggtgaatttagtggtgctgagctgaagaaaattatggcgaatgagaaacttgctgagatcgctttagctgacccaaaacgtgcaaagaggattttggcaaatcgtcaatcagctgcccgttccaaggagaggaagatgagatatatctcagaactggaacacaaggttcagactttgcagacagaagctaccacattgtctgcccagcttactcttttacagagagattctgttggtcttactaaccagaacaatgaattgaaatttcgcatccaagccatggagcaacaagctcaactccgagatgctttaaacgaggcattaactgctgaggtccgacggttgaagattgcgactgcggagcagggtggggactctgatccatccaagagcatggttcagcagcagctttctatcaaccctcagatgtacctgcagcagccacgaccttcacaacttggcatgcatcaattgcagcagcagtcatcagcctcccaattcaacatgcatcaacggcaacggcaacagcaacagcaacagcaacagcagtcctcccagccacagcctcaacaaaatggaaatactaccccaaagccagattcaaatcaatag

SEQ ID NO: 740 - protein, 607 aa, Populus balsamifera subsp. trichocarpa
  misc_feature (1)..(607): Ceres ANNOT ID no.1450452
  misc_feature (1)..(607): Bit score of 1351.8 for HMM based on sequences of FIGURE 56.
  misc_feature (427)..(489): Pfam Name: bZIP_1 Pfam Description: bZIP transcription factor
  misc_feature (1)..(607): Functional Homolog Of Ceres SEEDLINE ID no. ME20628 at SEQ ID NO: 1681
MGDTEEANSEMIQRLQSSFGTTQSSSTTMAKQPFSLINQIDVSQLSLNPTQMRARHFTNFSQNFSGDSNKRVGFPPSHPNQIPPISPYSQIPVSRPVNQQMGPQSFSLGPTHSRSLSQPSSFFSLDSLPPLSPAPFRDSSSPSVSDPISTDVFMEEKDGGSHSLLPPSPFNRGNAPRVVESLPPRKAHRRSNSDIPFGLANVLQCSPPLIPSRGSSGLERSMSGRENLGMAKPAQSVKKEWERGGDSNAEGMGERKSEGEVVDDLFSAYMNLDNIDVLNSSGTDDKNGNENREDLDSRASGTKTNGGDSSDNEAESSVNESGGNLPRAGLSSSTEKREGIKRSAGGDIAPTTRHYRSVSMDSFMGKLNFGNESPKLPPSPGTRPGQLSPTDSIDGNAFSLDFGNGEFSGAELKKIMANEKLAEIALADPKRAKRILANRQSAARSKERKMRYISELEHKVQTLQTEATTLSAQLTLLQRDSVGLTNQNNELKFRIQAMEQQAQLRDALNEALTAEVRRLKIATAEQGGDSDPSKSMVQQQLSINPQMYLQQPRPSQLGMHQLQQQSSASQFNMHQRQRQQQQQQQQQSSQPQPQQNGNTTPKPDSNQ

SEQ ID NO: 741 - DNA, 303 bp, Sorghum bicolor
  misc_feature (1)..(303): Ceres ANNOT ID no.6026765
  misc_feature (1)..(303): Encodes the peptide sequence at SEQ ID NO 742
atggacgaccgaggcggcggcggcggcggggaggccgagaggtggccgtggtgggcggctgcgagtgcggctcaggccgcggccggggtcgcgtggttccgacgcggcaggggcggaacggctgtggcgatgccgttcaaggcattcgccatcgcctccctcttcgtcggggcgggcgccaccgccgtctccgctggggtgcttgccgcgggcgtcggatcggtggaggagatgaagggcgtgggcgcgagcatccggcggtggatgggagctcctcctcgccgagcgggaggtagtgactaa

SEQ ID NO: 742 - protein, 100 aa, Sorghum bicolor
  misc_feature (1)..(100): Ceres ANNOT ID no.6026765
  misc_feature (1)..(100): Bit score of 215.2 for HMM based on sequences of FIGURE 22.
  misc_feature (1)..(100): Functional Homolog Of Ceres SEEDLINE ID no. ME05429 at SEQ ID NO: 730
MDDRGGGGGGEAERWPWWAAASAAQAAAGVAWFRRGRGGTAVAMPFKAFAIASLFVGAGATAVSAGVLAAGVGSVEEMKGVGASIRRWMGAPPRRAGGSD

SEQ ID NO: 743 - DNA, 1803 bp, Populus balsamifera subsp. trichocarpa
  misc_feature (1)..(1803): Ceres ANNOT ID no.1513992
  misc_feature (1)..(1803): Encodes the peptide sequence at SEQ ID NO 744
atgggtgatacggaggatgctaatagtgaaatgatacacaggttgcaatcttcttttggaacaacacaatcgtcatctgctacaatgtctaaacaacccttttctttgataaaccaattagatgtttctcaattgaatttgaaccaaacccagttgcgggcaaggcattttgcgaatttttatcagaattttagtggtgatagtaacaaaagagtagggattccgccttcacatcctaatcagatcccacccatttcgccgtattcccagatcccggtgtctaggccagcgaaccagcaaatgagtacccagaatttcagtatgggacctacccattcgcgatctttatcgcagccatcatcgtttttctgccttgattccttgccaccgttgagtccggccccttttcgtgactcctcttcgccaacggtttcggaccctatttcaactgatgtgtccatggaggataaggatggtagctctcattcgttgttgccaccctccccttttaataggggcaatgctccacgtgttggtgagagtttacctccacggaaagcccatagaaggtctaacagtgatattccatttggtaatgtgttgcaatgttcacctccccttattccgttgaggggttcaggtggcttggagcggtcgttgtccggtagagagaatccagcgatggctaagccagctcagttggtaaaaaaagaatgggagagaggtggtgaaagcattgcggaggggacgggtgagaggaaatctgaaggggatgtggatgatttgttttctgcttatatgaatttagataacattgatgcgttgaactcttcgggtactgatgagaagaatggtaatgagaatcgtgaggatttggatagtagagctagtggaactaagacaaatggtggtgatagcagtgataatgaggcagaaagcagcgttaatgaaagtggtggcagcgtgccaagaggaggatttagttcttcaacagagaagagggaggggatcaaaaggagtgctggaggtgatatcgctcctacctccaggcactacagaagtgtgtcaatggatagtttcatgggcaaattgaactttggtgacgagtctccaaaattgccaccttcaccaggaactcgtccaggtcaactttcacccaccaattcaatggatggcaatgcctttagcttggagtttgggaatggtgaatttagtggtgctgaactgaagaaaattatggctaatgagaaacttgctgagattgcttcaactgacccaaaacgtgcaaagaggattttggcgaatcggcaatcagctgctcgttctaaggagaggaagatgagatatatttcagaattagaacacaaggttcagactttgcagacagaagctaccacattgtctgctcagcttactcttttacagagggattctgttggtcttacaagccagaataatgaattgaaatttcgccttcaagccatggagcaacaagcacaactccgagatgctctaaacgaagcattaaacggtgaagtacgacggttgaagattgctacggcagagcagggtggggattctgacccatccaagggcttggttcagcagcagctttctgtcaaccctcagatgttcatgcagcagccacgaccttctcaacttaacaggcagcaattgcagcagcagcagcagccttcagcctcccaaatcaacatgcatcagttgcaacagcagcagcagtcctcccagccacagcctcaacaaaatggcagtactaccttaaagtcagattcgaatcaatag

SEQ ID NO: 744 - protein, 600 aa, Populus balsamifera subsp. trichocarpa
  misc_feature (1)..(600): Ceres ANNOT ID no.1513992
  misc_feature (1)..(600): Bit score of 1253.0 for HMM based on sequences of FIGURE 56.
  misc_feature (423)..(477): Pfam Name: bZIP_2 Pfam Description: Basic region leucine zipper
  misc_feature (1)..(600): Functional Homolog Of Ceres SEEDLINE ID no. ME20628 at SEQ ID NO: 1681
MGDTEDANSEMIHRLQSSFGTTQSSSATMSKQPFSLINQLDVSQLNLNQTQLRARHFANFYQNFSGDSNKRVGIPPSHPNQIPPISPYSQIPVSRPANQQMSTQNFSMGPTHSRSLSQPSSFFCLDSLPPLSPAPFRDSSSPTVSDPISTDVSMEDKDGSSHSLLPPSPFNRGNAPRVGESLPPRKAHRRSNSDIPFGNVLQCSPPLIPLRGSGGLERSLSGRENPAMAKPAQLVKKEWERGGESIAEGTGERKSEGDVDDLFSAYMNLDNIDALNSSGTDEKNGNENREDLDSRASGTKTNGGDSSDNEAESSVNESGGSVPRGGFSSSTEKREGIKRSAGGDIAPTSRHYRSVSMDSFMGKLNFGDESPKLPPSPGTRPGQLSPTNSMDGNAFSLEFGNGEFSGAELKKIMANEKLAEIASTDPKRAKRILANRQSAARSKERKMRYISELEHKVQTLQTEATTLSAQLTLLQRDSVGLTSQNNELKFRLQAMEQQAQLRDALNEALNGEVRRLKIATAEQGGDSDPSKGLVQQQLSVNPQMFMQQPRPSQLNRQQLQQQQQPSASQINMHQLQQQQQSSQPQPQQNGSTTLKSDSNQ

SEQ ID NO: 745 - DNA, 750 bp, Arabidopsis thaliana
  misc_feature (1)..(750): Ceres SEEDLINE ID no.ME05493
  misc_feature (1)..(750): Ceres CLONE ID no.3137
  misc_feature (1)..(750): Inplanta Sequence
  misc_feature (1)..(750): Encodes the peptide sequence at SEQ ID NO. 746
ctcccacttcttctcctctctctctactccaagttttcagaatgacattcttcatcgaagacactagtctcatcatcagccacgttctctacaaaacggcacttatcatcaccgttttacgatggatctttgcatggatcctccgttaccgctcaagatcatcatcatcatcatcatcatcatctcaatcgtcctcttctccttctatttcatcacaaaccatcaaagaaagcctagccgtgttcgctttccgcgacgcggtggagagatctcccgcggcgataaacgacatgtgtgccgtgtgtctaggagatcttgaagacgaggacgaaatcagagagcttaggaactgtactcacgtgtttcatcgtgattgtattgaccgatggctagattatgaatgttgcggcggtgatgatgataaccaccgtacttgtccgctatgtcgaacgccgttgcttccatctttcactgattattcaaccgttactcaaactagttgggctgttgaacgacttctttacctcttcggcgacgatcttcttccctgacttttatttttcttttagaaaacatttgatttcatattttttttatgaatattgtaattggtagaggggtagaataggaaatataagagtgattgatcgcaattatacgaaatcgaatcaatttgatttgattgtatatacaaatgttaaactgtattaattctcctcttcagataaatgtctaacattttttattatt

SEQ ID NO: 746 - protein, 169 aa, Arabidopsis thaliana
  misc_feature (1)..(169): Ceres SEEDLINE ID no.ME05493
  misc_feature (1)..(169): Ceres CLONE ID no.3137
  misc_feature (1)..(169): Bit score of 363.7 for HMM based on sequences of FIGURE 23.
  misc_feature (85)..(135): Pfam Name: zf-C3HC4 Pfam Description: Zinc finger, C3HC4 type (RING finger)
MTFFIEDTSLIISHVLYKTALIITVLRWIFAWILRYRSRSSSSSSSSSQSSSSPSISSQTIKESLAVFAFRDAVERSPAAINDMCAVCLGDLEDEDEIRELRNCTHVFHRDCIDRWLDYECCGGDDDNHRTCPLCRTPLLPSFTDYSTVTQTSWAVERLLYLFGDDLLP

SEQ ID NO: 747 - DNA, 507 bp, Populus balsamifera subsp. trichocarpa
  misc_feature (1)..(507): Ceres ANNOT ID no.1455092
  misc_feature (1)..(507): Encodes the peptide sequence at SEQ ID NO 748
atgggtttttttgtagaagagtcagggttgatagtgacccatcttttatacaaggcagctcttgtattagcagtcttgagatgggccttggcttgggctctgagattcaaaaacagaacccatttagcctctcccagcaatgattctctacggcgatctcatcctgttccttcttcgcagcaaattagggacggtctgatcttgaccactttcggtgatgtcacagagaggatgccaggagtttgtgacacatgtgctgtctgcttgagccagctgagggatcaagatgaggtcagagagttgaggaattgctgccacgtgttccacagggattgcattgatagatgggtagatcacgatcatgagcatgatgagaatcacaacacctgccctctgtgtagggcaccgttgctgacaacctcgcagagcctggctaggaccagggctgagcctagttgggctgttgagagaattctctacctctttggggatgacttggtgatgtga

SEQ ID NO: 748 - protein, 168 aa, Populus balsamifera subsp. trichocarpa
  misc_feature (1)..(168): Ceres ANNOT ID no.1455092
  misc_feature (1)..(168): Bit score of 345.9 for HMM based on sequences of FIGURE 23.
  misc_feature (85)..(133): Pfam Name: zf-C3HC4 Pfam Description: Zinc finger, C3HC4 type (RING finger)
  misc_feature (1)..(168): Functional Homolog Of Ceres SEEDLINE ID no. ME05493 at SEQ ID NO: 746
MGFFVEESGLIVTHLLYKAALVLAVLRWALAWALRFKNRTHLASPSNDSLRRSHPVPSSQQIRDGLILTTFGDVTERMPGVCDTCAVCLSQLRDQDEVRELRNCCHVFHRDCIDRWVDHDHEHDENHNTCPLCRAPLLTTSQSLARTRAEPSWAVERILYLFGDDLVM

SEQ ID NO: 749 - DNA, 525 bp, Populus balsamifera subsp. trichocarpa
  misc_feature (1)..(525): Ceres ANNOT ID no.1477399
  misc_feature (1)..(525): Encodes the peptide sequence at SEQ ID NO 750
atgggcttctttgcagaagagtcagggttaatagtagcccatcttatctacaaggcagctcttgctttagcagtcttgatatgggcctgggactgggctctgagatttaagaacagagcccatttatcctcctctagcaatgattctctacagcaatatcatcctgttccttctccacatcaagttatggacggtctgatttcgaccactttcaatgacgtcatagagagggtgccaggggtttgtgacacatgtgctgtctgcttgagccagttgagggatcaagatgaggtcagagagttgaggaactgcggccacgtgttccataaggagtgcatagatagatgggtagatcatgatcatgatcacgatcacgatcacgatcatgacgagaatcacaatacctgcccactgtgcagggcaccgttgccgacaacctcacgaagtctggcttggaccaggactgagcctagttgggccgttgagagaattctctacctcttcggggatgatttgattacgtga

SEQ ID NO: 750 - protein, 174 aa, Populus balsamifera subsp. trichocarpa
  misc_feature (1)..(174): Ceres ANNOT ID no.1477399
  misc_feature (1)..(174): Bit score of 263.9 for HMM based on sequences of FIGURE 23.
  misc_feature (85)..(139): Pfam Name: zf-C3HC4 Pfam Description: Zinc finger, C3HC4 type (RING finger)
  misc_feature (1)..(174): Functional Homolog Of Ceres SEEDLINE ID no. ME05493 at SEQ ID NO: 746
MGFFAEESGLIVAHLIYKAALALAVLIWAWDWALRFKNRAHLSSSSNDSLQQYHPVPSPHQVMDGLISTTFNDVIERVPGVCDTCAVCLSQLRDQDEVRELRNCGHVFHKECIDRWVDHDHDHDHDHDHDENHNTCPLCRAPLPTTSRSLAWTRTEPSWAVERILYLFGDDLIT

SEQ ID NO: 751 - protein, 167 aa, Arabidopsis thaliana
  misc_feature (1)..(167): Public GI ID no.15229284
  misc_feature (1)..(167): Bit score of 358.1 for HMM based on sequences of FIGURE 23.
  misc_feature (83)..(133): Pfam Name: zf-C3HC4 Pfam Description: Zinc finger, C3HC4 type (RING finger)
  misc_feature (1)..(167): Functional Homolog Of Ceres SEEDLINE ID no. ME05493 at SEQ ID NO: 746
MTFFIEDTSLIISHVLYKTALIITVLRWIFAWILRYRSRSSSSSSSQSSSSPSISSQTIKESLAVSAFRDAVERSPAAINDMCAVCLGDLEDEDEIRELRNCTHVFHRDCIDRWLDYECCGGDDDNHRTCPLCRTPLLPSFTDYSTVTQTSWAVERLLYLFGDDLLP

SEQ ID NO: 752 - DNA, 710 bp, Brassica napus
  misc_feature (1)..(710): Ceres CLONE ID no.961796
  misc_feature (1)..(710): Encodes the peptide sequence at SEQ ID NO 753
  misc_feature (292)..(292): y is t/u or c
actattaaaaacgcagctcatccttcactcttccttccccttctcttctcttctctctttctcactaagcaacaaacaaagaaacaatgagcttcttcatccaagactctggtctcatcgtcactcaacttctctaccaaatggctgttttcatcactctcttgagatggatcttttcttggatcttacgttaccgatccaaatcaagaacctcctctgctcctcccgtttcttcacaggccatcaaagagagcctctccgtgactacgttccatgacgcgttggagcgatytccggaactgatcagcgacacgtgtgcggtgtgcctcggtgatcttgaagatggagatgaggtcagggagctaagaaactgtagccacgttttccaccgcgagtgtatcgataggtggctggactacgagtgctgcggcggagatggtaacgagggagaggaagataaccaccgcacttgtcctctctgtaggactccacttcttgctgctgatacgtcgtcgtgtggggattggccggtcaagacagaacctagctgggccgttgagcggcttctctatctctttggagacgatcttctcgtttgacttttatttttatttttcaaattttatttgatttttaggcgatcaactgaaattacgttggtcaattttgtaaattgtgagattaatggatataataggaaatatgattat

SEQ ID NO: 753 - protein, 170 aa, Brassica napus
  misc_feature (1)..(170): Ceres CLONE ID no.961796
  misc_feature (1)..(170): Bit score of 346.4 for HMM based on sequences of FIGURE 23.
  misc_feature (77)..(132): Pfam Name: zf-C3HC4 Pfam Description: Zinc finger, C3HC4 type (RING finger)
  misc_feature (1)..(170): Functional Homolog Of Ceres SEEDLINE ID no. ME05493 at SEQ ID NO: 746
  misc_feature (69)..(69): Xaa is any aa, unknown or other
MSFFIQDSGLIVTQLLYQMAVFITLLRWIFSWILRYRSKSRTSSAPPVSSQAIKESLSVTTFHDALERXPELISDTCAVCLGDLEDGDEVRELRNCSHVFHRECIDRWLDYECCGGDGNEGEEDNHRTCPLCRTPLLAADTSSCGDWPVKTEPSWAVERLLYLFGDDLLV

SEQ ID NO: 754 - DNA, 782 bp, Glycine max
  misc_feature (1)..(782): Ceres CLONE ID no.706956
  misc_feature (1)..(782): Encodes the peptide sequence at SEQ ID NO 755
tttcccctttcttcttcttcttcttctctctaatttcatttccttgattatagctttcaattaatgggcttctacgctgaagatcctctctcaggcttgacaataggccaggccatatatgaggtagctctcatgattgcagttctgagatgggtcttgtgcttgatcttcagagtgatcaacgacagaagaacaacacaatccgacgagaccccaacaccagaaccatgttctcagatgacaagggacaaggacagcattcttttgctgacgactttcggagagattaaggagaggcttccagagacagaggagacgtgtgcggtgtgcctgagccagctgagcgtggaggacgaggttagggagctcatgaactgctaccacgtgttccacagagagtgcatagacagatggttggaacacgaacacgagaatcacagcgccacgtgtcctatctgcagggctcctttgctcagttcttcttgccaccacagctctgccacgtgtctgcctcctcctcagcctagttgggctgtggagagactcctctatctctttggagatgatctgcttccttgttagttacttgttttctttgtagattgtgcagaaaaaaaatagtttaggggattcattatttgttatgtttatcatctgagccttgtaattgttgcttgctgccacaaaataactaaactaagacacaaactagcttcctgtttgtgtgtgtgtatatacatatatttttcacatttgactaatattaatgttgcctttaatcc

SEQ ID NO: 755 - protein, 172 aa, Glycine max
  misc_feature (1)..(172): Ceres CLONE ID no.706956
  misc_feature (1)..(172): Bit score of 323.7 for HMM based on sequences of FIGURE 23.
  misc_feature (86)..(132): Pfam Name: zf-C3HC4 Pfam Description: Zinc finger, C3HC4 type (RING finger)
  misc_feature (1)..(172): Functional Homolog Of Ceres SEEDLINE ID no. ME05493 at SEQ ID NO: 746
MGFYAEDPLSGLTIGQAIYEVALMIAVLRWVLCLIFRVINDRRTTQSDETPTPEPCSQMTRDKDSILLLTTFGEIKERLPETEETCAVCLSQLSVEDEVRELMNCYHVFHRECIDRWLEHEHENHSATCPICRAPLLSSSCHHSSATCLPPPQPSWAVERLLYLFGDDLLPC

SEQ ID NO: 756 - DNA, 807 bp, Glycine max
  misc_feature (1)..(807): Ceres CLONE ID no.577750
  misc_feature (1)..(807): Encodes the peptide sequence at SEQ ID NO 757
  misc_feature (505)..(505): y is t/u or c
  misc_feature (507)..(507): y is t/u or c
  misc_feature (515)..(515): s is g or c
  misc_feature (530)..(530): y is t/u or c
  misc_feature (550)..(550): m is a or c
  misc_feature (591)..(591): r is g or a
  misc_feature (619)..(619): y is t/u or c
  misc_feature (648)..(648): y is t/u or c
  misc_feature (730)..(730): m is a or c
  misc_feature (732)..(732): m is a or c
  misc_feature (778)..(778): y is t/u or c
atagtagccttccactacaccaacaccatcatattttggctttataaagaaggcatagaactcattagaacttccccctttcccctttcttctctatcagttccttgattatagctttcaatgggattctacgctgaagacactctctcaggcttgacaataggccaggccatatacgaggtagctctgatgattgcggttctgagatgggtcttgtgcttgatcttcagagtgatgaacgacagaagaagaacagaatccgatgagaccccagccgcagaagcatgttgtcagaaggagtacaacaacactcttgtgctgacgacgttcggagagattaaggagaggctgccgcagacggaggagacatgtgcggtgtgcctgagccagctgagcgtggaggacgaggttagggagctgatgaactgctaccacgtgttccacagagagtgcatagagagatggttggagcacgagcatgagaatcacatccccacgtgtcctytytgcagggstcctttgctgagttyttgctgccaccacagctccmccacttgtgtccctcctcctcagcctagttgggctgtggaragacttctatatctctttggggatgatytcttgccttgttagttctttattagattytgctaggggattcattatttgttatctttatcatcctatatgtaattgttgcttgctgctacaaaataactaaactaggacmcmaactagcttccagtttgtgtgtgtatatatatatacatttaatctyttcaatttttatgattatctgtttattgt

SEQ ID NO: 757 - protein, 170 aa, Glycine max
  misc_feature (1)..(170): Ceres CLONE ID no.577750
  misc_feature (1)..(170): Bit score of 232.6 for HMM based on sequences of FIGURE 23.
  misc_feature (84)..(130): Pfam Name: zf-C3HC4 Pfam Description: Zinc finger, C3HC4 type (RING finger)
  misc_feature (1)..(170): Functional Homolog Of Ceres SEEDLINE ID no. ME05493 at SEQ ID NO: 746
  misc_feature (129)..(129): Xaa is any aa, unknown or other
  misc_feature (132)..(132): Xaa is any aa, unknown or other
  misc_feature (137)..(137): Xaa is any aa, unknown or other
  misc_feature (144)..(144): Xaa is any aa, unknown or other
  misc_feature (157)..(157): Xaa is any aa, unknown or other
  misc_feature (167)..(167): Xaa is any aa, unknown or other
MGFYAEDTLSGLTIGQAIYEVALMIAVLRWVLCLIFRVMNDRRRTESDETPAAEACCQKEYNNTLVLTTFGEIKERLPQTEETCAVCLSQLSVEDEVRELMNCYHVFHRECIERWLEHEHENHIPTCPXCRXPLLSXCCHHSSXTCVPPPQPSWAVXRLLYLFGDDXLPC

SEQ ID NO: 758 - protein, 180 aa, Medicago truncatula
  misc_feature (1)..(180): Public GI ID no.87162911
  misc_feature (1)..(180): Bit score of 343.6 for HMM based on sequences of FIGURE 23.
  misc_feature (90)..(132): Pfam Name: zf-C3HC4 Pfam Description: Zinc finger, C3HC4 type (RING finger)
  misc_feature (1)..(180): Functional Homolog Of Ceres SEEDLINE ID no. ME05493 at SEQ ID NO: 746
MGFPVGYPEVSVPNIFLYTLSLLSFLRSLTISFLSLLHLSDLLDTDFSTTTLPDSHIHRPTLSAILIRQFLPIITFNDLAEGDSSPPVGCAVCLNEFAGEEEIRCMANCRHMFHRTCVDRWIDHDQKTCPLCRTHFVPYHKMEDYNQRLWNDAASEDDIDDDVSLFSHRHDYYYIANASL

SEQ ID NO: 759 - DNA, 718 bp, Zea mays
  misc_feature (1)..(718): Ceres CLONE ID no.1061446
  misc_feature (1)..(718): Encodes the peptide sequence at SEQ ID NO 760
gattcttcattcttccttccccttctctctcactacctactcctagcaacaacaatgagcttcttcatcgaagattctggtctcatcgtcacacaacttctctaccaaatggctgtcttaatcaccctcttgagatggatctttacttggatcttacgctaccgatccagatctacctcctcctcttcttcatctactcctccgatctcgtcacaaaccatcaaagagagcctcgccgtgacgacgttccgcgacgccgcggatcggtctccggaactgatcagcgacacttgcgcggtgtgtcttggagatttggaagacggagatgaggtcagagagctcagaaactgcagccacgtgttccaccgagagtgtatcgacaggtggctggactacgagtgctgtggcggagatgataacgacggcgaggaagataaccaccgcacgtgtcctctttgtagaactccgcttcttgctgctaatacgtcgtcgtgtgcggattggccggttaagaacgaacctagctgggccgttgagcggcttctctacctcttcggagatgatcttcttgtctgactttttattttatttttctttcgatatttatttgattttagtggagattgaaatttgttggtcgagttttgtaaattgggaatttaaagggtagaatagcatttatatataatatttcaattttaaacatattttctttgtg

SEQ ID NO: 760 - protein, 173 aa, Zea mays
  misc_feature (1)..(173): Ceres CLONE ID no.1061446
  misc_feature (1)..(173): Bit score of 362.6 for HMM based on sequences of FIGURE 23.
  misc_feature (80)..(135): Pfam Name: zf-C3HC4 Pfam Description: Zinc finger, C3HC4 type (RING finger)
  misc_feature (1)..(173): Functional Homolog Of Ceres SEEDLINE ID no. ME05493 at SEQ ID NO: 746
MSFFIEDSGLIVTQLLYQMAVLITLLRWIFTWILRYRSRSTSSSSSSTPPISSQTIKESLAVTTFRDAADRSPELISDTCAVCLGDLEDGDEVRELRNCSHVFHRECIDRWLDYECCGGDDNDGEEDNHRTCPLCRTPLLAANTSSCADWPVKNEPSWAVERLLYLFGDDLLV

SEQ ID NO: 761 - protein, 212 aa, Oryza sativa subsp. indica
  misc_feature (1)..(212): Public GI ID no.125540686
  misc_feature (1)..(212): Bit score of 438.5 for HMM based on sequences of FIGURE 23.
  misc_feature (116)..(158): Pfam Name: zf-C3HC4 Pfam Description: Zinc finger, C3HC4 type (RING finger)
  misc_feature (1)..(212): Functional Homolog Of Ceres SEEDLINE ID no. ME05493 at SEQ ID NO: 746
MGFPVGYSELLLPRLLLQVLLLLGHLHRFLLWAFHAVGLGDLIDNPPGLAATEQDMMLQGRGGGMAEGWASSSALQHRRPEFRAIPPMAIEEALPVVRFDELVASAPAAVCGGGDCAVCLSGICGRDEVRRLSNCRHVFHRGCLDRWMAHEQRTCPLCRAPLIPDELLPAASGLPDPSDYDLSYYPSPLPLAPTPTLLRPHELLLNGLGGFQ

SEQ ID NO: 762 - protein, 212 aa, Oryza sativa subsp. japonica
  misc_feature (1)..(212): Public GI ID no.115447931
  misc_feature (1)..(212): Bit score of 437.1 for HMM based on sequences of FIGURE 23.
  misc_feature (116)..(158): Pfam Name: zf-C3HC4 Pfam Description: Zinc finger, C3HC4 type (RING finger)
  misc_feature (1)..(212): Functional Homolog Of Ceres SEEDLINE ID no. ME05493 at SEQ ID NO: 746
MGFPVGYSELLLPRLLLQVLLLLGHLHRFLLWAFHAVGLGDLIDNPPGLAATEQDLMLQGRGGGMAEGWASSSALQHRRPEFRAIPPMAIEEALPVVRFDELVASAPAAVCGGGDCAVCLSGICGRDEVRRLSNCRHVFHRGCLDRWMAHEQRTCPLCRAPLIPDELLPAASGLPDPSDYDLSYYPSPLPLAPTPTLLRPHELLLNGLGGFQ

SEQ ID NO: 763 - protein, 194 aa, Hordeum vulgare subsp. vulgare
  misc_feature (1)..(194): Public GI ID no.20152976
  misc_feature (1)..(194): Bit score of 354.0 for HMM based on sequences of FIGURE 23.
  misc_feature (112)..(155): Pfam Name: zf-C3HC4 Pfam Description: Zinc finger, C3HC4 type (RING finger)
  misc_feature (1)..(194): Functional Homolog Of Ceres SEEDLINE ID no. ME05493 at SEQ ID NO: 746
MMLSSAYSTPAADELGGPPPLPPPPGADVSVIVGALTGVLLGLFLFLIYAKHCRQRGRGGARGAAGGLGLGFRASSTCDRCRSGVSLSVVDALPVVRFGDMGGAAAAAQPECAVCLGTFDPAADELLRVLPKCRHAFHADCVDTWLEAHSTCPVCRRRVGKEDAFAVIPELEAADADWYPAREAEMQIVVRRPA

SEQ ID NO: 764 - DNA, 594 bp, Sorghum bicolor
  misc_feature (1)..(594): Ceres ANNOT ID no.6007280
  misc_feature (1)..(594): Encodes the peptide sequence at SEQ ID NO 765
atgtcgccgatgagcaaccctagcttcgatcacagctacgagctccctctgcggcgaaacctcctgcttctgctcgacctcctcggccgcctccgcttcatcgccgaggtgctcctggaccgcctcggcgtcgcgtcgtggcagggtgaggtgcatttgcccggacagctttggggttggggcggagagcatgccagcgatgccactttggaacacttccttgaggcgaggttgtgggagaccgggacgcggtcgccgctcacgacaacgcggtacaggcggcggcgggttgcgcttgcgcagccggcggacggcaaactggccgcagaaggcgacgccgagggcgcggcggccgtttgcgcgatttgcgtggcggggctggaatcgggggatctcgagacggtcgtggagctgtgcagctgctcgcacgcgttccacgacgcgtgcatcgatgcttgggtccgcagtggtgacgacgacgcggccacctgcccgctgtgccgcgcgccatgttgcccacggcgtgggacgacgacgggcggagagcagagtttgtctcgcgtactgaaaggggtctgtgtctctgtcccttaa

SEQ ID NO: 765 - protein, 197 aa, Sorghum bicolor
  misc_feature (1)..(197): Ceres ANNOT ID no.6007280
  misc_feature (1)..(197): Bit score of 366.0 for HMM based on sequences of FIGURE 23.
  misc_feature (120)..(167): Pfam Name: zf-C3HC4 Pfam Description: Zinc finger, C3HC4 type (RING finger)
  misc_feature (1)..(197): Functional Homolog Of Ceres SEEDLINE ID no. ME05493 at SEQ ID NO: 746
MSPMSNPSFDHSYELPLRRNLLLLLDLLGRLRFIAEVLLDRLGVASWQGEVHLPGQLWGWGGEHASDATLEHFLEARLWETGTRSPLTTTRYRRRRVALAQPADGKLAAEGDAEGAAAVCAICVAGLESGDLETVVELCSCSHAFHDACIDAWVRSGDDDAATCPLCRAPCCPRRGTTTGGEQSLSRVLKGVCVSVP

SEQ ID NO: 766 - DNA, 669 bp, Sorghum bicolor
  misc_feature (1)..(669): Ceres ANNOT ID no.6007297
  misc_feature (1)..(669): Encodes the peptide sequence at SEQ ID NO 767
atgggtttcccggtgggttactcggagctggtgctcccgaagcagctgctccacctcctcctgctcctggggtacatccgccgcttcctcctctgggcgttcgacgccgtggggctcggcgacctgctggatctcggggacgaccaccaccaggcgctgctgcagcaggaccaccaccacggcgacgcgcaggggcgggaccaccacggcgcgctggcgctgccgcatcaggcggcggcgatgctgctgcagcagcaccgacggccggagttccgggcggtgccggcgatggtcatcgaggaggtcctccccgtggtgcggttcgacgagctggaggaggcgcgcgtcggcggggactgcgccgtttgcctcagcggcatcggaggccgcgacgaggtgcgccggctcagcaactgccgccacgtcttccaccgcgcctgcctggaccgctggatggagcacgaccagcgcacctgcccgctctgccgcgcgccgctcatccccgacgagatggccggcgcgctctgggccgccgccgcgggcgtccccgacgcctccgacttcgacttctcctacttcggcgcgacgccgctgacgacgcccgtgccctccccgacgctgctgcggccgcacgagctgctgctcaccggcctgggcggataccagtga

SEQ ID NO: 767 - protein, 222 aa, Sorghum bicolor
  misc_feature (1)..(222): Ceres ANNOT ID no.6007297
  misc_feature (1)..(222): Bit score of 231.9 for HMM based on sequences of FIGURE 23.
  misc_feature (120)..(162): Pfam Name: zf-C3HC4 Pfam Description: Zinc finger, C3HC4 type (RING finger)
  misc_feature (1)..(222): Functional Homolog Of Ceres SEEDLINE ID no. ME05493 at SEQ ID NO: 746
MGFPVGYSELVLPKQLLHLLLLLGYIRRFLLWAFDAVGLGDLLDLGDDHHQALLQQDHHHGDAQGRDHHGALALPHQAAAMLLQQHRRPEFRAVPAMVIEEVLPVVRFDELEEARVGGDCAVCLSGIGGRDEVRRLSNCRHVFHRACLDRWMEHDQRTCPLCRAPLIPDEMAGALWAAAAGVPDASDFDFSYFGATPLTTPVPSPTLLRPHELLLTGLGGYQ

SEQ ID NO: 768 - DNA, 666 bp, Arabidopsis thaliana
  misc_feature (1)..(666): Ceres SEEDLINE ID no.ME05885
  misc_feature (1)..(666): Ceres CLONE ID no.32430
  misc_feature (1)..(666): Encodes the peptide sequence at SEQ ID NO. 769
ttgttttgtatataaaatccctaaattcccgttttatgtaacggacataataagccgcgtacggcgtatccggcaaatcggcccagctcgagccatcatcaatctacggaggagatccatctctctctctctctccatatcgcaacaacactgctgaagatttcgggggttgtcgacggagctggaatctagctttttcttctccagatctctaaaccgattctcaccggttaattggtattataaagccatggttcttgatgggcttgtatcttcaccgtcaaggagacaacaatgtctaaagaagcagtgggacgagttgggtagctggtcgactcttattcagaggcatcaatatctcttaacagctttggctcttttggctttcctctgtactgtttatctttactttgcagtcactttaggcgctaggcactcgtcctgctatggcttgaccgggaaagacaaggcaatgtgtcaattacaacttgttcaagctctctccaaagggaaacttaaattcttctagactgtttatctatcggtgaaagtttgaaacccccacatttattgttcttgtactaaaacattctttttcttctttattctataatgcaatttgtgtgtattattacatggtgaaataaaaccagagattcataattg

SEQ ID NO: 769 - protein, 92 aa, Arabidopsis thaliana
  misc_feature (1)..(92): Ceres SEEDLINE ID no.ME05885
  misc_feature (1)..(92): Ceres CLONE ID no.32430
  misc_feature (1)..(92): Bit score of 209.0 for HMM based on sequences of FIGURE 24.
MVLDGLVSSPSRRQQCLKKQWDELGSWSTLIQRHQYLLTALALLAFLCTVYLYFAVTLGARHSSCYGLTGKDKAMCQLQLVQALSKGKLKFF

SEQ ID NO: 770 - DNA, 526 bp, Gossypium hirsutum
  misc_feature (1)..(526): Ceres CLONE ID no.1808741
  misc_feature (1)..(526): Encodes the peptide sequence at SEQ ID NO 771
atggtaacgtcccccttccactgagaaataaaggagaagacaaatggagaagaggagttaaaaagatcgattaaatctatatactcattgtttgcttcttccctttgatcttcctaccttgattttctcatctaccacattggttgaggacttttaatcgtctttctaagaaatggttctggacggaattgtatcatctccccttcgaaggtcagcatcaacgaggaggcaatcctcgagagatgaattcggtagctggtcaacacttgttgagaggcataggttcctcttaacagcattgggattgttggcattcctctgtactatctacctttattttgctgttactttaggagccacggatacatgttctgggttgaaaggaacagagaaagcaacatgtaatctgcagcatgtaagctccactctctcccatgggaaactcaaattcctgtgacattcttcatgctatgtatgttacaagttgcttttattaattaaacttataatctgagcatcttaatat

SEQ ID NO: 771 - protein, 94 aa, Gossypium hirsutum
  misc_feature (1)..(94): Ceres CLONE ID no.1808741
  misc_feature (1)..(94): Bit score of 225.0 for HMM based on sequences of FIGURE 24.
  misc_feature (1)..(94): Functional Homolog Of Ceres SEEDLINE ID no. ME05885 at SEQ ID NO: 769
MVLDGIVSSPLRRSASTRRQSSRDEFGSWSTLVERHRFLLTALGLLAFLCTIYLYFAVTLGATDTCSGLKGTEKATCNLQHVSSTLSHGKLKFL

SEQ ID NO: 772 - DNA, 285 bp, Populus balsamifera subsp. trichocarpa
  misc_feature (1)..(285): Ceres ANNOT ID no.1437729
  misc_feature (1)..(285): Encodes the peptide sequence at SEQ ID NO 773
atggttcttgatagcatgataacttctcctcaccggagatcaccatctttccggaagccattcccacgggatgagttgggtagctggtcaacactccttcggcgacaccgtttcctcttaacagccttcgctctcttggctttcttatgcacaatctatctctacttcgctgttaccctaggggccactgaatcatgttctggactgacaggtaccaaaaagacattatgtcgtttggagctggcaaaggattctgtaggcaatggaaaactcaaatttttctag

SEQ ID NO: 773 - protein, 94 aa, Populus balsamifera subsp. trichocarpa
  misc_feature (1)..(94): Ceres ANNOT ID no.1437729
  misc_feature (1)..(94): Bit score of 223.0 for HMM based on sequences of FIGURE 24.
  misc_feature (1)..(94): Functional Homolog Of Ceres SEEDLINE ID no. ME05885 at SEQ ID NO: 769
MVLDSMITSPHRRSPSFRKPFPRDELGSWSTLLRRHRFLLTAFALLAFLCTIYLYFAVTLGATESCSGLTGTKKTLCRLELAKDSVGNGKLKFF

SEQ ID NO: 774 - DNA, 285 bp, Populus balsamifera subsp. trichocarpa
  misc_feature (1)..(285): Ceres ANNOT ID no.1501366
  misc_feature (1)..(285): Encodes the peptide sequence at SEQ ID NO 775
atggttcttgatagcatgataacttctcctcacctgagatcaccatccttccggaaacaattcccacgggatgatttgggtagctggtcaactctccttcagagacaccgtttcctcttaacagccttggttctcttgggtttcttatgcacaatctatctctacttcgctgttactctaggggccactgaatcatgttctggatttaccggaaccaaaaaggcattatgtcatgtggagctggcaaaggattctgtaggccacggaaaactcaagtttttctag

SEQ ID NO: 775 - protein, 94 aa, Populus balsamifera subsp. trichocarpa
  misc_feature (1)..(94): Ceres ANNOT ID no.1501366
  misc_feature (1)..(94): Bit score of 217.8 for HMM based on sequences of FIGURE 24.
  misc_feature (1)..(94): Functional Homolog Of Ceres SEEDLINE ID no. ME05885 at SEQ ID NO: 769
MVLDSMITSPHLRSPSFRKQFPRDDLGSWSTLLQRHRFLLTALVLLGFLCTIYLYFAVTLGATESCSGFTGTKKALCHVELAKDSVGHGKLKFF

SEQ ID NO: 776 - DNA, 601 bp, Brassica napus
  misc_feature (1)..(601): Ceres CLONE ID no.952789
  misc_feature (1)..(601): Encodes the peptide sequence at SEQ ID NO 777
aataaaccgcgtacggcaccatccggctaatcgccaccgctcgaagctacggaggagattgattcaacctctctctatctatatcggaaacgtctaacggcggactaatttacgtgtcgacggagctagaagcagcttatcttctccagatctctaaccgattctcaccgcttcctgtttcaccggttgggtgatcaaagcaatggttcttgatgggattgtatcttcaccattgaggagacaccagtctctaaagaaacagtgggaagatttgggtagctgctcaaccgttgttaaccggcatcgatatttattaacagcattgcttctcttgggctttctctgcacggtttatctttactttgctgtcactttagatgctaggcacaactcctcctgctacggcttggctgggaaagagaaggcaatgtgtcaagccatctctaaagggaaactcaaattgttttgataaattgttcttgtgccactacattcttttttgttttattgattctataatgccatttgtgtgtaattgtttcattacatggtgaaaaaccagagatttgtaacctaaacatcaaaaacattttcatttctg

SEQ ID NO: 777 - protein, 88 aa, Brassica napus
  misc_feature (1)..(88): Ceres CLONE ID no.952789
  misc_feature (1)..(88): Bit score of 186.1 for HMM based on sequences of FIGURE 24.
  misc_feature (1)..(88): Functional Homolog Of Ceres SEEDLINE ID no. ME05885 at SEQ ID NO: 769
MVLDGIVSSPLRRHQSLKKQWEDLGSCSTVVNRHRYLLTALLLLGFLCTVYLYFAVTLDARHNSSCYGLAGKEKAMCQAISKGKLKLF

SEQ ID NO: 778 - DNA, 668 bp, Glycine max
  misc_feature (1)..(668): Ceres CLONE ID no.724313
  misc_feature (1)..(668): Encodes the peptide sequence at SEQ ID NO 779
aattacaatacaaccttcagctcttgttcacgaaacacgcgctttttcacagccttcgaagtcaaagattctggctgagcagtcctaagtaagtcattgtagaagtcatggttctagagtccattttgtcgtcttcgaagtcaccatctttcaggaggcagtttgcaaagcatgaactgggcagttggtcgacactcttgaagaggcaccgcttcctcttatttgctcttgctctactaactgtcctctgtaccatttatctatattttgcagttacatttgcagccaatgactcctgctctgggttgaatggacctctgaaagattcctgtcatatggagcatgttaaggcttctgtagccaagagtaaactgaaaggtctgagacatttctgattccaattcaagttgtgctggagagtttttatcttttcctttaggagacatgaaatcgaaatatgatttttcggctcagtgttactataatatgtattatttatctatactgtttatcttagtatttgtgagccaaaatgtacaatccatgttagaaagcaatttcttgattgctcattttggggggctgctttatgatggctaatataagttcggtgagcatcctagcagcccaaatcaaatttgagtttttacaatgttgatggttaattc

SEQ ID NO: 779 - protein, 95 aa, Glycine max
  misc_feature (1)..(95): Ceres CLONE ID no.724313
  misc_feature (1)..(95): Bit score of 208.1 for HMM based on sequences of FIGURE 24.
  misc_feature (1)..(95): Functional Homolog Of Ceres SEEDLINE ID no. ME05885 at SEQ ID NO: 769
MVLESILSSSKSPSFRRQFAKHELGSWSTLLKRHRFLLFALALLTVLCTIYLYFAVTFAANDSCSGLNGPLKDSCHMEHVKASVAKSKLKGLRHF

SEQ ID NO: 780 - DNA, 673 bp, Glycine max
  misc_feature (1)..(673): Ceres CLONE ID no.651757
  misc_feature (1)..(673): Encodes the peptide sequence at SEQ ID NO 781
  misc_feature (480)..(480): m is a or c
  misc_feature (486)..(486): w is a or t/u
  misc_feature (498)..(498): y is t/u or c
  misc_feature (592)..(592): y is t/u or c
  misc_feature (639)..(639): b is g or c or t/u
  misc_feature (642)..(642): k is g or t/u
  misc_feature (647)..(647): s is g or c
  misc_feature (666)..(666): y is t/u or c
ggttacggatggttcctcttcttcctctcacatggcatgacaccagtaataataacacattccactttcccatctctggtttttacattacaatacaaccttaacgctcttgttcacgaaacacgcgctttttcacaaccttcgaagtctttttcgcaaccttcgaagtcaaaagattcaggcattctagtcccgagtaagtcattgtagaagccatggttctcgactccattttgtcgtcttctccttgtctgaagtcaccatctttcagtaggcagtttgcaaggcatgaactgggaagttggtcaacactcgtcaagagacactgcttcctcttatctgctcttgctctactaactgtcctctgtaccatttatctatattttgcagttacattcgcagccaatgactcctgctctgggttgagtggatctctgagagattcctgtcatatggagcatgttatggattctgaagccmagagtwaactgaaaggtytgagacatttatgatttccaattcaagttgtgccggagagtttttttatcttttcctttagtataatatgtactatttatccatactgtttatyttagtatttgtgagccaaaatgtacaatgtatgtagaaagcaatttbttkaatgstcatttgggggctgctttytggggtc

SEQ ID NO: 781 - protein, 98 aa, Glycine max
  misc_feature (1)..(98): Ceres CLONE ID no.651757
  misc_feature (1)..(98): Bit score of 198.0 for HMM based on sequences of FIGURE 24.
  misc_feature (1)..(98): Functional Homolog Of Ceres SEEDLINE ID no. ME05885 at SEQ ID NO: 769
  misc_feature (89)..(89): Xaa is any aa, unknown or other
  misc_feature (91)..(91): Xaa is any aa, unknown or other
  misc_feature (95)..(95): Xaa is any aa, unknown or other
MVLDSILSSSPCLKSPSFSRQFARHELGSWSTLVKRHCFLLSALALLTVLCTIYLYFAVTFAANDSCSGLSGSLRDSCHMEHVMDSEAXSXLKGXRHL

SEQ ID NO: 782 - DNA, 294 bp, Triticum aestivum
  misc_feature (1)..(294): Ceres CLONE ID no.791239
  misc_feature (1)..(294): Encodes the peptide sequence at SEQ ID NO 783
ctccaaaaacaaaaaacagagaaacaccacggtcactgcagcttctccgtgttgggcgcctcttcgtcttcgccgccggcgcctgctccgccaccggctctccacgccggagcctctgcatccgccgcgacctgcaccgccaaccccactccgtgccttccctctctcgtccccaatctcggggtgggatttgtagtgcgcggtgaagaagaaggggagatccaggctcggagaggaggaggaagatcaagtggtccaggacacgaactcatcagcggtgaccccccccccccc

SEQ ID NO: 783 - protein, 98 aa, Triticum aestivum
  misc_feature (1)..(98): Ceres CLONE ID no.791239
  misc_feature (1)..(98): Bit score of 207.7 for HMM based on sequences of FIGURE 24.
  misc_feature (1)..(98): Functional Homolog Of Ceres SEEDLINE ID no. ME05885 at SEQ ID NO: 769
MVLDSILSSSPCLKSPSFSRQFARHELGSWSTLVKRHCFLLSALALLTVLCTIYLYFAVTFAANDSCSGLSGSLRDSCHMEHVMDSEAKSKLKGLRHL

SEQ ID NO: 784 - DNA, 726 bp, Zea mays
  misc_feature (1)..(726): Ceres CLONE ID no.208975
  misc_feature (1)..(726): Encodes the peptide sequence at SEQ ID NO 785
ctcttctctccctttccaagggccgccgcatccactccgccccccgcctcgcagtgcctccccaccgccctccgcgcccggcaggcgacgtcccgttccagatccaggattcaaacaaaccagtacattaccaccatggttcttgattcattatcatcacctcacaggaggtcccaaaacacattcttcgtgtcatctgcaaaaaagcctcagtcatctcgtgacgacagttggtctgcactggttgagcgacaccggtttctcctgacgacactccttgttcttgccttcctgtgcactgtctatctgtactttgcagtaaccttgggggcatcagatgcttgcactggattgacaggagcagagaggattgagtgccaggcaagatcagtgctgcaacatggaaagttgaaattccgatgactttggagactcattgatgaagaccaaattattgagttttatatgcactcgggtcacatgacaaattcttgataccatgtatctgtatatggtggggtggctgatgttattggaccacaaaatttgctgtactggtagaggcaaatctaatagttagggttgagcttgtggaaacgggtatactggggtaggcccatattgttcttttaccttggtgtgcgaaaaacatcatggcgtctgtaattcttccaggagatattggtattgtctcccttgagacatactcacagttaatttgaaacc

SEQ ID NO: 785 - protein, 95 aa, Zea mays
  misc_feature (1)..(95): Ceres CLONE ID no.208975
  misc_feature (1)..(95): Bit score of 212.8 for HMM based on sequences of FIGURE 24.
  misc_feature (1)..(95): Functional Homolog Of Ceres SEEDLINE ID no. ME05885 at SEQ ID NO: 769
MVLDSLSSPHRRSQNTFFVSSAKKPQSSRDDSWSALVERHRFLLTTLLVLAFLCTVYLYFAVTLGASDACTGLTGAERIECQARSVLQHGKLKFR

SEQ ID NO: 786 - DNA, 770 bp, Zea mays
  misc_feature (1)..(770): Ceres CLONE ID no.392748
  misc_feature (1)..(770): Encodes the peptide sequence at SEQ ID NO 787
cggatttccccctcctcgaccgtcgtcaatatcgcacggttcaccggccacgctctctcgctttccaaggaccgccgggtccgctccgtcccccgtctggcagtggcctcctcgccgccctcggcgccgcctggccacgccttatccagatccaggattcaaagaaaccattacttcaccaccatggttcttgattcattgtcatctccgcacaggaggtcccaaaacatattcttcgtgtcatcatcaaaaaagcctcagtcatctcgtgatgacagttggtctgcactggttgagcggcaccggttcctcctgacaacacttcttgtgcttgccttcctatgcagtatctatctgtactttgcagtgaccttgggggcatcagatgcatgcagtggtttgacaggaggggcacagaagatcgagtgccaggcaagatcagtgctgcaacatggaaagttgaaattccgctgacttcggagtctcattgatgaagaccaaattattgagtttatttgcactctggtcacaggtcttattcttcataccatgaatctgtatattattggtggtggctggtttgtattcatgctgatgttattgggccacaacatttattgtactggtagagataaatctaatagtgatagcgttgagtttgtggaaagtggaaactggtataagggtaggtctatattgttcttttaacaatcatggtgcctataattcgtccaggagaccttggtattgtctcccgtgtgacatgtgac

SEQ ID NO: 787 - protein, 96 aa, Zea mays
  misc_feature (1)..(96): Ceres CLONE ID no.392748
  misc_feature (1)..(96): Bit score of 198.7 for HMM based on sequences of FIGURE 24.
  misc_feature (1)..(96): Functional Homolog Of Ceres SEEDLINE ID no. ME05885 at SEQ ID NO: 769
MVLDSLSSPHRRSQNIFFVSSSKKPQSSRDDSWSALVERHRFLLTTLLVLAFLCSIYLYFAVTLGASDACSGLTGGAQKIECQARSVLQHGKLKFR

SEQ ID NO: 788 - DNA, 685 bp, Musa acuminata
  misc_feature (1)..(685): Ceres CLONE ID no.1727075
  misc_feature (1)..(685): Encodes the peptide sequence at SEQ ID NO 789
gtaacccctcgttggatttctgatcgtttcttcgttggtcgcaccggcacaaaattttcaatcacactcagtattcttaagattgcaatatcaatgaatttcttaccactaaaggtttttgaagcaaagtttgattcaagatgggtctcacacatggaactttgaagcaaccgtgtaggactttaggcagcttagaccatcttgacagatggttcttgattcactatcatctcctcataggagatcacagaacacagttttcctggcatccccgtccaagaaacagcagtcgggcttcaatgagcctggtagttggtccactatttatgagcggcacaggtttctcttgacgatgctagctctattggcattcctatgcaccatctatttgtactttgcagttactttgggagccacaggctcatgctcaggaatgtcaggagctgagaaagctctttgccaggccaaatcttcattgcacaagggaaaattgaaattcttttgaccagcaagtgatctcgagcatctagaaaagcaatgcctctgggattaatgatcaattcataacaattcataaacactatatgatatgggggcattgcatgtttggtttcctgcagcaaattataagatttgtgggttgtggtttaccgatgataaatgtgtatttgatttgatgtgttag

SEQ ID NO: 789 - protein, 98 aa, Musa acuminata
  misc_feature (1)..(98): Ceres CLONE ID no.1727075
  misc_feature (1)..(98): Bit score of 227.8 for HMM based on sequences of FIGURE 24.
  misc_feature (1)..(98): Functional Homolog Of Ceres SEEDLINE ID no. ME05885 at SEQ ID NO: 769
MVLDSLSSPHRRSQNTVFLASPSKKQQSGFNEPGSWSTIYERHRFLLTMLALLAFLCTIYLYFAVTLGATGSCSGMSGAEKALCQAKSSLHKGKLKFF

SEQ ID NO: 790 - protein, 97 aa, Oryza sativa subsp. japonica
  misc_feature (1)..(97): Public GI ID no.115475611
  misc_feature (1)..(97): Bit score of 228.1 for HMM based on sequences of FIGURE 24.
  misc_feature (1)..(97): Functional Homolog Of Ceres SEEDLINE ID no. ME05885 at SEQ ID NO: 769
MVLDSLSSPHRRSQNTFFLSSPKKLQSSKDDVGSWSALVERHRFLLTTLVVLVFLCTIYLYFAVTLGAPDACSGLAGTEKAVCRAKSALRHGKLKFF

SEQ ID NO: 791 - DNA, 1536 bp, Arabidopsis thaliana
  misc_feature (1)..(1536): Ceres SEEDLINE ID no.ME07344
  misc_feature (1)..(1536): Ceres CLONE ID no.101255
  misc_feature (1)..(1536): Inplanta Sequence
  misc_feature (1)..(1536): Encodes the peptide sequence at SEQ ID NO. 792
aaaaagctttgccggagatttagcaaacacaaacacaaaaaacaaaaccaactcagacgaatgtgattttttcttcttgagtgaattgttgtaaaaaaatgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtgatttgaaccggattcgtaaaccggagtgtctgaaatttcgttgataaagattaattaaaggattattatcggcatgggaggttttttaatggatctcttcttaggaaaagaggagatttctctgcaagtttttttttttgtatatttattatttcctaatttcgtataatctctgttccataatcgatgattcgagggagattcctcagtgtataggagttgcttaggatttttcattatgatggattcactaatattgatattgttggttattgtttttttatatattatgatgtaagatgcaagtcgcaatgtaattattaaatatcttatgaatgaaatgagaatgtaaattattt

SEQ ID NO: 792 - protein, 359 aa, Arabidopsis thaliana
  misc_feature (1)..(359): Ceres SEEDLINE ID no.ME07344
  misc_feature (1)..(359): Ceres CLONE ID no.101255
  misc_feature (1)..(359): Bit score of 856.7 for HMM based on sequences of FIGURE 25.
  misc_feature (119)..(144): Pfam Name: zf-CCCH Pfam Description: Zinc finger C-x8-C-x5-C-x3-H type (and similar)
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 793 - DNA, 1310 bp, Gossypium hirsutum
  misc_feature (1)..(1310): Ceres CLONE ID no.1843695
  misc_feature (1)..(1310): Encodes the peptide sequence at SEQ ID NO 794
tatacaaatcttacaagccaaaaaagaaaaaatgatgcttggagaaactcatcgtccaaatccaaccgtccacgtaccaccttggcctgatcttgacgatgatcagacggatgtagtttactctcctatccattacaatgcaaccgacaacaacttgagcagtaacggcaacccgttttacctccatgaagcgttatcagctttacaacgttatttgccatcgaacggcccggatgttgagttggattccgagtttccgggtttggatagtccggattcaccggtcgatgcttattcctgtgaccatttcaggatgtacgagttcaaaatccggaggtgtgctcgtgggcggtctcatgactggaccgagtgtccgtacgcccatcccggtgaaaaagctcgtcggagggatccgaggaagtatcattattcgggtactgcatgcccggattttcgtaaagggaactgccggaaaggagattcatgtgagttcgctcatggggtttttgagtgttggcttcacccggctcgttaccggactcaaccgtgtaaagatgggtcgggttgtcgtcgtcgggtttgtttctttgctcatactcctgaccagctccgtctcgtaagctctactgatacttacgacggttcaccgtgtggtaaaacgctgacgttttggtcttcacctggttctagctcacctccggttagtccccgtgccgagtcttgctcttcccctccggtctcgccgatggctcagtcgctaagccgttctctcggttcggcttccattaacgagatggtgacctctttaaggaacttacagctaggaaaaggcaagtcctggaagacccaagttggctgttgctccccttcgtcaccttccagtttcggatcccccagagcagcaatgatccgacccggtttctgcagcttacccagtactccgacccgaaacttaacccgtccaggtatcagctacccggattcatgggataaagcgtgtgaagaagaaccggtaatggaacgggtcgaatcgggacgtgatttacgtgcaaagatgttcgagaaactgagtaaagaaaattcattggagcgggtgaacccggatcaatcttccggaggtccggatttgaattgggtttcggacttgggtaagcaagcaatggggattattgtaatggttgatattgtgctttttattaagtatttttaattatgattatccaagttgctaatcttttttatttgtactaaaaaaatagtgtaattaaatattgtaaaattttagagcttatgtatgctcttttatggtc

SEQ ID NO: 794 - protein, 392 aa, Gossypium hirsutum
  misc_feature (1)..(392): Ceres CLONE ID no.1843695
  misc_feature (1)..(392): Bit score of 882.1 for HMM based on sequences of FIGURE 25.
  misc_feature (133)..(158): Pfam Name: zf-CCCH Pfam Description: Zinc finger C-x8-C-x5-C-x3-H type (and similar)
  misc_feature (1)..(392): Functional Homolog Of Ceres SEEDLINE ID no. ME07344 at SEQ ID NO: 792
MMLGETHRPNPTVHVPPWPDLDDDQTDVVYSPIHYNATDNNLSSNGNPFYLHEALSALQRYLPSNGPDVELDSEFPGLDSPDSPVDAYSCDHFRMYEFKIRRCARGRSHDWTECPYAHPGEKARRRDPRKYHYSGTACPDFRKGNCRKGDSCEFAHGVFECWLHPARYRTQPCKDGSGCRRRVCFFAHTPDQLRLVSSTDTYDGSPCGKTLTFWSSPGSSSPPVSPRAESCSSPPVSPMAQSLSRSLGSASINEMVTSLRNLQLGKGKSWKTQVGCCSPSSPSSFGSPRAAMIRPGFCSLPSTPTRNLTRPGISYPDSWDKACEEEPVMERVESGRDLRAKMFEKLSKENSLERVNPDQSSGGPDLNWVSDLGKQAMGIIVMVDIVLFIKYF

SEQ ID NO: 795 - DNA, 1606 bp, Gossypium hirsutum
  misc_feature (1)..(1606): Ceres CLONE ID no.1930463
  misc_feature (1)..(1606): Encodes the peptide sequence at SEQ ID NO 796
aaaacttaaccatggttaactcaaacaactacgggttaaaaatgcagtttataatgggagagaaccgatcgttcattttaggaaccaaagaacgatgtacaaaaatgatgatcggagaaccaacacgaccaaatcccaccgttaaaatcccggcgtgggacccactcaatgatccgacgtctaattattcttccgttaattataactgcaatgcgccgtccagtccttgtcccgtcgattacctctcatcgctccaccgttacctcccgtcaaacgatttcgagtcgtccgactctctgagtgaggattcggattttcctgttgacgcgttctcgtgtgaccatttccgtatgtatgagttcaaagtgaggaggtgtgctcgtggcaggtcacatgactggactgagtgtccgtacgctcaccccggggagaaagcccggaggagagacccgaggaagtttcattactcgggtacagcttgccctgatttccgtaaaggaatctgcaaaaaaggcgattcgtgtgagttcgctcatggtgttttcgagtgttggctgcacccagcacggtaccggactcagccgtgtaaggatggtaccagttgtaaaaggagggtctgttttttcgctcacacaccagaacagctccggttgttaccacaacagagtccgagaggaaacgggtcgagttcgggagatttggattacgttgggtccccaatacgtcaccgtttcgacatagtttcttcgccgacttccattttagcttcacctccgttatccccaccttccgattcaccgcctttatccccaagcggctcgttttactcggtgagtgaactcgctgcttccatgcgtagcatgcagctcggtaagtccaaaatgaacggcgccggcgcttgttcatggggtatgcaaatgggatcgggttacggttcccttcggggctccacgcttcgacccgggttttgcaggtctccttcaaccccgacccgttctgggttaggccagttcgatctctgggaatgcaacaacggtttcgaagaagaaccagcaatggaaagggttgaatccggtagagatttaagggccagaatgtacgcgaagcttagtaaagaaaattccctcgacggactcgatccaaccgaaccggatctggatctcgattgggtctccgagttagtgaagtgaactcgatactggcaactcacccaactcagctttctgttatgatttatttcgggaattctttttatatattaaaaaaaacaaatcggtggctataatctgactttttgtgaatattaatggggttttttttttataatctgattttcgatcatcatttgcactgtgtaaatagacgacggtggaaaagagagatggcggagaaaagtctctattttgtggtgcgactgcgttttcgtttttaaaattttctttccgagaaaaccaataagaaaaaaaaattgcagacgtttgtaaagaaaagcaagtatttctaattatcggagatggtaatttgtttcttcattttgttcttgggattatctctgtaatttcttttgtcatggttaatcaatgtaatatatgtcatttttctttcg

SEQ ID NO: 796 - protein, 361 aa, Gossypium hirsutum
  misc_feature (1)..(361): Ceres CLONE ID no.1930463
  misc_feature (1)..(361): Bit score of 714.6 for HMM based on sequences of FIGURE 25.
  misc_feature (121)..(146): Pfam Name: zf-CCCH Pfam Description: Zinc finger C-x8-C-x5-C-x3-H type (and similar)
  misc_feature (1)..(361): Functional Homolog Of Ceres SEEDLINE ID no. ME07344 at SEQ ID NO: 792
MMIGEPTRPNPTVKIPAWDPLNDPTSNYSSVNYNCNAPSSPCPVDYLSSLHRYLPSNDFESSDSLSEDSDFPVDAFSCDHFRMYEFKVRRCARGRSHDWTECPYAHPGEKARRRDPRKFHYSGTACPDFRKGICKKGDSCEFAHGVFECWLHPARYRTQPCKDGTSCKRRVCFFAHTPEQLRLLPQQSPRGNGSSSGDLDYVGSPIRHRFDIVSSPTSILASPPLSPPSDSPPLSPSGSFYSVSELAASMRSMQLGKSKMNGAGACSWGMQMGSGYGSLRGSTLRPGFCRSPSTPTRSGLGQFDLWECNNGFEEEPAMERVESGRDLRARMYAKLSKENSLDGLDPTEPDLDLDWVSELVK

SEQ ID NO: 797 - DNA, 1339 bp, Gossypium hirsutum
  misc_feature (1)..(1339): Ceres CLONE ID no.1922789
  misc_feature (1)..(1339): Encodes the peptide sequence at SEQ ID NO 798
aagttagaatagcagaacgaaggatgtccaaaatatgatgatcagaaaacccattacacgacccttccccaccgtcaatatccccgactgggaaccgttaaatgattcggcggataactttctggctgtcggctttaactgcaatgcaccctgcagcccttgtcccgtagaataccttacggcgctccgccgttacctcccctcgaacgatctcgagcccgacacccttagtgacgactccgacgtacacatcatcgatgcattctcgtgcgatcatttccgtatgtacgagttcaaggtgaggaggtgtgctcgtggcaggtcacatgactggaccgagtgtccgtacgcccaccctggggagaaggctcggcggagggatccgaggaagttccattactctggatccgcttgcccggatttccgcaaaggaaactgtaaaaaaggcgattcgtgtgagttcgctcatggcgtgtttgagtgttggctccacccaactcgttaccggactcagccatgcaaggacggtacttgttgtaaacggagggtttgtttttttgctcacacgccggagcaactacgggtcttaccgcagcagagtccaagagggaatgggtccgggtccgggtcaagtgatatggattacttcggctcgcctatccgctatcgtttagactatgtttcttcaccaacttccattttggcttcgcctccaatatccccaccttctgactcaccacctacgtcgccgagcggctcatttaactcggtaagtgaactcacctcttccgtacgtaatctacagattggtaaagctaaaatgggaactacttgttctcggggatcatgttttgtttctccaaggagctccatgctccgacctggctctcctctcactccaactcgtacaccgactcggtccgtactcagtaagtttgagctctgggaaagtaataatgcgtttgaggaacctgcaatggagagagtggaatccgggagagacttgaggacaaggatgtacgctaagctgagtgaggaaaattctcttgacctacttgatcctaccgggtcgggtcctgatgttgggtgggtatcggagttggttggatattgatggtgattttgatttgggtaatttgcattgtaaatagaagacggcgaaaaagtgatcggaaaaaaaaagttttattttgcggtggtggtgccaccgttttttctttgttaattttctggggaaaacaaaaatggaaaatcgcaactctttgtatagagatttgtttgtcattttgtctggtatattatctctgtactttctttaatcaatgtaatatatttcttc

SEQ ID NO: 798 - protein, 359 aa, Gossypium hirsutum
  misc_feature (1)..(359): Ceres CLONE ID no.1922789
  misc_feature (1)..(359): Bit score of 645.6 for HMM based on sequences of FIGURE 25.
  misc_feature (122)..(147): Pfam Name: zf-CCCH Pfam Description: Zinc finger C-x8-C-x5-C-x3-H type (and similar)
  misc_feature (1)..(359): Functional Homolog Of Ceres SEEDLINE ID no. ME07344 at SEQ ID NO: 792
MMIRKPITRPFPTVNIPDWEPLNDSADNFLAVGFNCNAPCSPCPVEYLTALRRYLPSNDLEPDTLSDDSDVHIIDAFSCDHFRMYEFKVRRCARGRSHDWTECPYAHPGEKARRRDPRKFHYSGSACPDFRKGNCKKGDSCEFAHGVFECWLHPTRYRTQPCKDGTCCKRRVCFFAHTPEQLRVLPQQSPRGNGSGSGSSDMDYFGSPIRYRLDYVSSPTSILASPPISPPSDSPPTSPSGSFNSVSELTSSVRNLQIGKAKMGTTCSRGSCFVSPRSSMLRPGSPLTPTRTPTRSVLSKFELWESNNAFEEPAMERVESGRDLRTRMYAKLSEENSLDLLDPTGSGPDVGWVSELVGY

SEQ ID NO: 799 - protein, 307 aa, Cucumis sativus
  misc_feature (1)..(307): Public GI ID no.56605376
  misc_feature (1)..(307): Bit score of 649.5 for HMM based on sequences of FIGURE 25.
  misc_feature (111)..(136): Pfam Name: zf-CCCH Pfam Description: Zinc finger C-x8-C-x5-C-x3-H type (and similar)
  misc_feature (1)..(307): Functional Homolog Of Ceres SEEDLINE ID no. ME07344 at SEQ ID NO: 792
MIAESMLLNPTSHISTWDSLDDPSPAISSYFSTAHVSPLDSPTAALMDFDSSLWEDPDLPAPVDAYSCDQFRMYEFKVRSCARGRSHDWTKCPYAHTGEKARRRDPRKFNYSGAECPDLRHGCCKKGDACEYAHGTFEIWLHPDRYRTQPCRDGTGCRRRVCFFAHTSEQLRIPGKQSVRSPRAREMAIPAVSSPTSILLSPSSDSPPLSPISPVISGGESLSRLVALMHSLRLDELKTNPGVSSFSPNLRRSSGAAFDLWDRGNEEEPAMERVESGRNLRAQMYAKLMRENSVDRVRPMISAGSLN

SEQ ID NO: 800 - DNA, 1170 bp, Populus balsamifera subsp. trichocarpa
  misc_feature (1)..(1170): Ceres ANNOT ID no.1508502
  misc_feature (1)..(1170): Encodes the peptide sequence at SEQ ID NO 801
atgatgatcggagaactctctcatcaccgttcgaatcccaccgttcaaatccctcaatgggacccatacgaagagcaaacaacgacgtctccctcgctgtccccaatcccgacttctccattcaccaacttcaacgccctcgattctctaacgtctctccaccgttaccttccgtcaaacgagccagaccctacttttgaagacgaactagatttaccagtggacgcgttctcatgcgatcacttccgtatgtacgagttcaaagtgaaaaggtgtgcacgtggccggtcacatgactggactgagtgtccgtatgcacatcctggcgagaaagcgcggcgcagggacccacgaaggtatcattactctggaacggcctgcccggagtttcggaaaggtggctgcaagaaaggcgatgcatgtgagtttgctcacggtgtctttgagtgctggctccatccggcccgttaccgcactcagccgtgtaaggatggacctgcttgtcgccgcagggtttgtttttttgctcacactccggaacagctcagactccttcctcagcagagtcctaagggaaatggatccgggtctggactcgggtcgggggaatatgattttgggtccccggttatacatccttttgactcctacatgactaaagctgggatttttgtttcatctccgacttcgattttgacttcaccgccagtttctccaccatctgactcgccaccaatgtctccaggcagtccacaggtgataggcggctctggacccggatccttaaattccatgagtgcgcttcttgcttcgatgcggggactgcaggttgggaaggcgaaaatgggatctcctgttggttcctggggagtccaatccggatttagattcgggtctccgcgtgggtcatcactacgacccggtttctgtagcctgccttcaactcctactagaacaatggcaagtcggtctggacttagtcagttggatatctggggcgatggggtcacttgtgaggaagagcctgcaatggagagggtggagtctgggagagatttaagggcaaagatatatgccaagctaagtaaagagaactcggtggaccgtgaccgaggtgactcgggtgtttcgggtccagatgttgggtgggtttctgagctggtgaagtga

SEQ ID NO: 801 - protein, 389 aa, Populus balsamifera subsp. trichocarpa
  misc_feature (1)..(389): Ceres ANNOT ID no.1508502
  misc_feature (1)..(389): Bit score of 950.6 for HMM based on sequences of FIGURE 25.
  misc_feature (122)..(147): Pfam Name: zf-CCCH Pfam Description: Zinc finger C-x8-C-x5-C-x3-H type (and similar)
  misc_feature (1)..(389): Functional Homolog Of Ceres SEEDLINE ID no. ME07344 at SEQ ID NO: 792
MMIGELSHHRSNPTVQIPQWDPYEEQTTTSPSLSPIPTSPFTNFNALDSLTSLHRYLPSNEPDPTFEDELDLPVDAFSCDHFRMYEFKVKRCARGRSHDWTECPYAHPGEKARRRDPRRYHYSGTACPEFRKGGCKKGDACEFAHGVFECWLHPARYRTQPCKDGPACRRRVCFFAHTPEQLRLLPQQSPKGNGSGSGLGSGEYDFGSPVIHPFDSYMTKAGIFVSSPTSILTSPPVSPPSDSPPMSPGSPQVIGGSGPGSLNSMSALLASMRGLQVGKAKMGSPVGSWGVQSGFRFGSPRGSSLRPGFCSLPSTPTRTMASRSGLSQLDIWGDGVTCEEEPAMERVESGRDLRAKIYAKLSKENSVDRDRGDSGVSGPDVGWVSELVK

SEQ ID NO: 802 - DNA, 1083 bp, Populus balsamifera subsp. trichocarpa
  misc_feature (1)..(1083): Ceres ANNOT ID no.1530660
  misc_feature (1)..(1083): Encodes the peptide sequence at SEQ ID NO 803
atgatgatcggagaacatcctcatcaccatccaaatcccaccgtccaaatccctcaatgggacccatacgatgaccaaacaacatcaccatcaccgtcaacaatcccctcttctccattcaccaacttcaatgcgctcgactccctgacggcacttcaccgttaccttccgtcaaacgagccagacccatcctttgaagacgagctagacttaccagtggatgcgttctcatgcgatcacttccgtatgtacgtgttcaaagtgagaaggtgtggacgtggtcggtcgcatgactggactgaatgtccgtacgcgcatcctggagagaaagctcggcgaagggacccacaaaggtatcattactctggaacggcctgccctgaatttcggaaaggcggttgcaagaaaggagattcttgtgagtttgctcacggtgtctttgagtgctggctccatcctgcccgttacaggactcagccgtgtaaggatggacctgcttgtcgccgcagggtctgcttttttgctcacactcccgaacagcttaggctccttcctcagcatagtcctaaaggaaacggatccgggtcgtgggaacttgattttgggtccctggttatgcatcctctcgactcttacctgacaaaagctgggtcttttgtttcatctccaacctcgattttgacttctccgccagtttctccaccatctgattcgccaccgatgtcaccagtcagtccacagcttgggaagatgaaaatagggtctcctgttggttcttggggggtccaatccgggtctagatttgggtcgccacgtgggtcatcgctgcgacccgggttctgcagcctgccttctactcctactagaacaatggcaactcggtctggacttggccagctggatatctggggagatagtagtacttgcgaggaggagcctgcaatggagagggtggagtctgggagagatttgagggcgaagatatatgcaaagctgagtaaagagaactcactggaccctgatcgagttgagtcggctgtttccgggccagatgttgggtgggtttccgagttggtgaagtga

SEQ ID NO: 803 - protein, 360 aa, Populus balsamifera subsp. trichocarpa
  misc_feature (1)..(360): Ceres ANNOT ID no.1530660
  misc_feature (1)..(360): Bit score of 795.0 for HMM based on sequences of FIGURE 25.
  misc_feature (121)..(146): Pfam Name: zf-CCCH Pfam Description: Zinc finger C-x8-C-x5-C-x3-H type (and similar)
  misc_feature (1)..(360): Functional Homolog Of Ceres SEEDLINE ID no. ME07344 at SEQ ID NO: 792
MMIGEHPHHHPNPTVQIPQWDPYDDQTTSPSPSTIPSSPFTNFNALDSLTALHRYLPSNEPDPSFEDELDLPVDAFSCDHFRMYVFKVRRCGRGRSHDWTECPYAHPGEKARRRDPQRYHYSGTACPEFRKGGCKKGDSCEFAHGVFECWLHPARYRTQPCKDGPACRRRVCFFAHTPEQLRLLPQHSPKGNGSGSWELDFGSLVMHPLDSYLTKAGSFVSSPTSILTSPPVSPPSDSPPMSPVSPQLGKMKIGSPVGSWGVQSGSRFGSPRGSSLRPGFCSLPSTPTRTMATRSGLGQLDIWGDSSTCEEEPAMERVESGRDLRAKIYAKLSKENSLDPDRVESAVSGPDVGWVSELVK

SEQ ID NO: 804 - DNA, 1512 bp, Glycine max
  misc_feature (1)..(1512): Ceres CLONE ID no.1239229
  misc_feature (1)..(1512): Encodes the peptide sequence at SEQ ID NO 805
gtaaacatccatcgaatccaaataataccaaaaaacaccatgatgcttggggagacccaccgcccaaatccaaccgtacacgtgccaccgtgggcgccggagatcttctcaccatacaccggcaatgccgattactctccgtactccatgcaagaagcacttagtgcacttcagcactacgaatccaccgatgctgagtcagactcggaggttccgtctcgggaaccggaagtcccggtggacgcttactcctgcgaccatttccgcatgttcgagttcaaggttcggagatgcgcacgttgcaggtcgcatgactggaccgactgtccgtacgcccaccccggcgagaaggcacgccgccgtgatccccggaagtaccattactccggcacggcttgccccgatttccgcaaggggagttgcaagaagggtgacgcgtgcgagtacgcgcacggggttttcgagtgctggctccaccccgcgcgctaccgcactcagccttgcaaggatggcaccagttgtcgccgccgcgtgtgtttcttcgcgcacacgccggatcaacttagggttttgccacagcagagtccgcgcagtgctgattcctacgacgggtctcctttgaggcacgcgattgagtcgtcgtgtgcaaagtcgcatccgtttgtggcttctcccggttcggcctcgtcgccggtggagtctccgccgatgtcgccgatgactgtgagtgttaatgagatggtggcttcgctaaggaacttgcaactggggaaggtgaagtccttgccttcttcgtggaatgttatggggtcttccgggttcgggtctcctagaggacccatgatccgacccggatttttcagccttccgacaacgccgacccaggctccgactcgcggtggggtcaactactttgaccagtgggatcagagttgttgcgaggaggagcctgttatggagagggtggaatctggacgaagcataagggcgaggatgtttgaaaaactgagcaaagagaatcatctggacgggtcgggttccggatcgagtcaaatcggggttcccgatgttgggtgggtttcggagcttgtcagtcgctgatttcattttgttgcacttccctcggtgtgtatagaatgcgggggagaagaaaagtaagatttattttggaagaaggagcatcaactcaacttgtggtttctgtaaatagcttattctcaaggtaaggtatggtatgggtgaagaagttaattaagagaaagagtagaatctttttttggggttattttcttggtcgatcaagaagtgatttgcaagaatcaggatcgtaagcttttgtataggtagctgcggatgatgaaattatattattcccacgtgttaattactgtgtttattatcactaatctcatctcattcatgtataaattttaaatattttctcatatgttatccagaaatttccgacttctgtcgtttactaatccttaaattgtatgtttccttaatgct

SEQ ID NO: 805 - protein, 353 aa, Glycine max
  misc_feature (1)..(353): Ceres CLONE ID no.1239229
  misc_feature (1)..(353): Bit score of 897.6 for HMM based on sequences of FIGURE 25.
  misc_feature (115)..(140): Pfam Name: zf-CCCH Pfam Description: Zinc finger C-x8-C-x5-C-x3-H type (and similar)
  misc_feature (1)..(353): Functional Homolog Of Ceres SEEDLINE ID no. ME07344 at SEQ ID NO: 792
MMLGETHRPNPTVHVPPWAPEIFSPYTGNADYSPYSMQEALSALQHYESTDAESDSEVPSREPEVPVDAYSCDHFRMFEFKVRRCARCRSHDWTDCPYAHPGEKARRRDPRKYHYSGTACPDFRKGSCKKGDACEYAHGVFECWLHPARYRTQPCKDGTSCRRRVCFFAHTPDQLRVLPQQSPRSADSYDGSPLRHAIESSCAKSHPFVASPGSASSPVESPPMSPMTVSVNEMVASLRNLQLGKVKSLPSSWNVMGSSGFGSPRGPMIRPGFFSLPTTPTQAPTRGGVNYFDQWDQSCCEEEPVMERVESGRSIRARMFEKLSKENHLDGSGSGSSQIGVPDVGWVSELVSR

SEQ ID NO: 806 - DNA, 1348 bp, Glycine max
  misc_feature (1)..(1348): Ceres CLONE ID no.673872
  misc_feature (1)..(1348): Encodes the peptide sequence at SEQ ID NO 807
aaaacaaaaaccatcagcaacataaaaaaaaaaaatagaaagaaaaatgatgctcggagaacaccatcgcgggaatccgacggtcctcgtgccaccgtggccagcccacgacgatccgacggctgagatgtactccgcgttcttaacaaacgacgtcaatgctggtgagtactctccgtaccatcttcaagaagcactaacggcgctgcagcgttttctgccgtcaaacgaaacggacgcagactcggactcctcggaggcggctcagcccgacgcggcggtggacgcgtacacgtgcgaccatttccgcatgtacgagttcaaggtccgtcgatgcgcacgtggcaggtcacacgactggacggagtgtccgtacgcgcatcccggcgagaaggcccgccgccgtgacccgcggaggttccactactctggcgtggcgtgcccggagttccgcaagggaaactgcaggaaaggcgacgcgtgcgagttcgcgcacggcgttttcgagtgctggctccatccggcgcgctaccggactcagccatgcaaggacggcacgagctgccggcggcgcgtgtgcttcttcgcgcacacgccggagcagctgcgcgtcctgccgatgcagagtccgcgtagcgtggcaaactcatcggagtcctacgacgggtctccgatgaggcaggtttcgttgtcgtcggcggcggcggcggcgttcatgtcttctccggcggcttctctctctccgccagagtcgccgccatcggtgaacgagatggtggcttctctgcgtaatttgcagcttgggaaaatgaaatcgatgcctcataatagaaacgtgtcggtcgggtcgccgaggggatcggtactccgaccgggttttttaagccttccaacaacgccaactcagcaaccggttcggtctggggtgaagtgttttgatgtttgggatgagagttttgaggaggaaccggttatggagagggtggagtcagggaggggaataagggctaagatgtttgagaagctcagcaaggagaattcactcgacgcctcggcttcgcctccggatcttgggtgggtctcggagcttgttaagtgagaagccagtccttgtaaatatggcatggctgaagagaagaagacaagaagacaagaatctcttttttgtatagttagcttactattattattatcatcatcatggttttaaacagcattcctcaacgcaatcaaggtatttggattcactgtaatacacaatctgtaattgaggctgcgtcagtcgcaattacctaccatttatataaaggttttcacccttgtgcgagtccgatcgcaatcctaattt

SEQ ID NO: 807 - protein, 350 aa, Glycine max
  misc_feature (1)..(350): Ceres CLONE ID no.673872
  misc_feature (1)..(350): Bit score of 743.7 for HMM based on sequences of FIGURE 25.
  misc_feature (127)..(152): Pfam Name: zf-CCCH Pfam Description: Zinc finger C-x8-C-x5-C-x3-H type (and similar)
  misc_feature (1)..(350): Functional Homolog Of Ceres SEEDLINE ID no. ME07344 at SEQ ID NO: 792
MMLGEHHRGNPTVLVPPWPAHDDPTAEMYSAFLTNDVNAGEYSPYHLQEALTALQRFLPSNETDADSDSSEAAQPDAAVDAYTCDHFRMYEFKVRRCARGRSHDWTECPYAHPGEKARRRDPRRFHYSGVACPEFRKGNCRKGDACEFAHGVFECWLHPARYRTQPCKDGTSCRRRVCFFAHTPEQLRVLPMQSPRSVANSSESYDGSPMRQVSLSSAAAAAFMSSPAASLSPPESPPSVNEMVASLRNLQLGKMKSMPHNRNVSVGSPRGSVLRPGFLSLPTTPTQQPVRSGVKCFDVWDESFEEEPVMERVESGRGIRAKMFEKLSKENSLDASASPPDLGWVSELVK

SEQ ID NO: 808 - protein, 381 aa, Medicago truncatula
  misc_feature (1)..(381): Public GI ID no.92893962
  misc_feature (1)..(381): Bit score of 929.2 for HMM based on sequences of FIGURE 25.
  misc_feature (122)..(147): Pfam Name: zf-CCCH Pfam Description: Zinc finger C-x8-C-x5-C-x3-H type (and similar)
  misc_feature (1)..(381): Functional Homolog Of Ceres SEEDLINE ID no. ME07344 at SEQ ID NO: 792
MMLGEPPHRTNPTVHVPPWPTLNNPTAEIFSPLTSNDDYSQFYMQEALSAFQHYVNENNDSDSDSEIFPTHESVDSYSNDHFRMFEFKIRRCARGRSHDWTECPFSHPGEKARRRDPRKYNYSGTSCPDFRKGSCKKGDSCEFAHGVFECWLHPSRYRTQPCKDGTSCRRPVCFFAHTTEQLRAPTQQSPRSVPSVDSYDGSPLRLAFESSCVKTLQFMSSPGSVSPPVESPPMSPMTRSLGRSVGSSSVNEMVASLRNLQLGTMKSLPSSWNVQMGSPRFGSPRGPVIRPGFCSLPSTPTQVPSRGRVNHFDLWDQSCEEEPVMERVESGRDIRVKMFEKLSKENSFNGSGMGSGSGLGEVVEDPDVGWVSELVSPFLGD

SEQ ID NO: 809 - DNA, 1452 bp, Zea mays
  misc_feature (1)..(1452): Ceres CLONE ID no.327364
  misc_feature (1)..(1452): Encodes the peptide sequence at SEQ ID NO 810
gtccacgcccacgcctccacggccaagcgcctcgaaggcaaagcttccactagccacaggccaacgaaatcgcaacgcgaagctacggccaccgaccgacgttccaagaagcgaaacgaaacgaaaatgatgatgatgatgggagagagagcgcacgcgccgccgtggcagcactcgccggcggccagcggcgtcacggacgcggacgacgcgtctccgtacgccctcctagcggcgctgcagcattacctgccgtcgaacgaggtggcggcgttcgacgaagacgacgaggaggcggccctggcggcggcgaccgccgccgtcgacgcgtacgcctgcgacgagttccggatgtacgagttcaaggtgcggcggtgctcgcgagggcggaaccacgactggacggcctgcccctacgcgcacccgggggagaaggcccggcggcgcgaccccaggcggtaccactactccggcgccgcgtgcccggacttccgcaagggcgggtgcaagcgcggcgacgcgtgcgagctcgcgcacggggtgttcgagtgctggctccacccgtcgcgctaccggacgcagccctgcaaggacggcaccggctgccgccgccgcgtctgcttcttcgcgcacacgccggaccagctccgcgtgcctccgccgcggcagtccagccctaggggcgcggcggcggcgtcgccgctggccgagtcgtacgacggctcgccgctccgccgccaggcgttcgagagctacctcaccaagagcggcatcgtgtcgtcgccgccgaccagcacgctcgtctcgccgccgaggtcgccgccgtcggagtccccgccaatgtcgccagacgccgccgccgcgctccgccgcggctcgtggccgggcgtagggtcgcccgtcaacgaggtcctcgcgtcgatgcgccagctgcggctcggcggcggctcgccgaggtcagcgccttccggcgggtcgttcttgggcggaggctacccgttcgggtccccaaagtcaccggccgggctgtacagcctcccgtccacgccaaccaggccgtccccggtgacggtgaccaccgcctccggcgccaccgtcctcaccgtggaacgcctcaacctcggactcatcggggacgaggagccggtgatggagagggtcgagtccgggagagccctccgcgagaaggtgttcgagcggctcagcaaagaagccaccgtgcccagcgacaccgccgcatccgccaacgttgagggagcggcccccgccccggatgttggatgggtctccgacctcatcaactgagggaactcgtggaactaccagctcagaagttcagggggggaataacaaaaaaaaagtaggaagatttttaatttttttagttctttacaaataatttcctggtccttgtacagatgttcctgctttgtgaatagtcttggatgtgtg

SEQ ID NO: 810 - protein, 391 aa, Zea mays
  misc_feature (1)..(391): Ceres CLONE ID no.327364
  misc_feature (1)..(391): Bit score of 922.6 for HMM based on sequences of FIGURE 25.
  misc_feature (113)..(138): Pfam Name: zf-CCCH Pfam Description: Zinc finger C-x8-C-x5-C-x3-H type (and similar)
  misc_feature (1)..(391): Functional Homolog Of Ceres SEEDLINE ID no. ME07344 at SEQ ID NO: 792
MMMMGERAHAPPWQHSPAASGVTDADDASPYALLAALQHYLPSNEVAAFDEDDEEAALAAATAAVDAYACDEFRMYEFKVRRCSRGRNHDWTACPYAHPGEKARRRDPRRYHYSGAACPDFRKGGCKRGDACELAHGVFECWLHPSRYRTQPCKDGTGCRRRVCFFAHTPDQLRVPPPRQSSPRGAAAASPLAESYDGSPLRRQAFESYLTKSGIVSSPPTSTLVSPPRSPPSESPPMSPDAAAALRRGSWPGVGSPVNEVLASMRQLRLGGGSPRSAPSGGSFLGGGYPFGSPKSPAGLYSLPSTPTRPSPVTVTTASGATVLTVERLNLGLIGDEEPVMERVESGRALREKVFERLSKEATVPSDTAASANVEGAAPAPDVGWVSDLIN

SEQ ID NO: 811 - DNA, 1704 bp, Zea mays
  misc_feature (1)..(1704): Ceres CLONE ID no.1061417
  misc_feature (1)..(1704): Encodes the peptide sequence at SEQ ID NO 812
gtccccagcccgcgcactgcccccggtctctctctctcaacacaccgataagcccagtccaccggatctcccgtagtccagagactgagttgaaggaaggaagccatgatgatgatgggcgaaggcgtgagcatgccgccgtggtcccaccacgtccctgtgagcggcgtcgacgaaggcgacgagatgacgccgtacctgctcgcggcgctgcgccagtacctgccgtgcaacgacgccggcgccgaggccgaggaggatgaggcggcggcggcggccgccgccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgcctcagcagcagtccagccccaggggcgccgcctgctcttccccgctcgccgagtcctacgacggctccccgctccggcgccaggcgttcgagagctacctcaccaagagcatcatgtgctcgtcgccgaccagcaccctcctgtcgccgcccaagtcgcccccgtcggagtccccgccattgtcgcccgacttccgccgtgggtgctggccgggcgccgggtcccccgtcaacgacgtgctcgcctcgctccgccagctccgcctcagcagggccaactcgtccccgtcgggcggctggtgcggctaccctgcatccgcggtcgcgtacggatcgcctacggggggcgcgctctacggcctgtcctccaccccgagggccaccgccgcatcctgctacatggccaacctggaccctctcgacgtcagcttcggcggcgacgacgagcccgtggagagggtggagtccggccgcgccctccgcgcgaaggtgttcgagcggcttagcagggagggcgctgtttccggcgacgccggtggccccgacgtcggttgggtctccgacctcatcaactgagcgcggcggcggcagtggcaataacaatgggcacggagaaaggtgatggtgagccgtaacggagaaggatggtacggagtatccaaaaaaaaaatatttccctatatttaatttcgttcctcagttaattccgataatccccgtgtacatatctatcaccctgtgaatattctcagttggtaagagggaggatgctaggtggtggaagtggaaggaggggtggatttgttttggggttcttgagggtagtagaaaatatccaagaaaaatagaaaaaaaaagtgtacagcagatgcagtagcgcggtggcggtggttgtgtccctcttctgtgcatagggttagggtgttggtggcgaagcatggcgggggctgatgtgacgacgaaggcgggccggatttccaccacggcttggtatttctgtgattccggaacatggtagtttgatgttgttttttttaagttagtggactagttggcgattgc

SEQ ID NO: 812 - protein, 370 aa, Zea mays
  misc_feature (1)..(370): Ceres CLONE ID no.1061417
  misc_feature (1)..(370): Bit score of 735.6 for HMM based on sequences of FIGURE 25.
  misc_feature (113)..(138): Pfam Name: zf-CCCH Pfam Description: Zinc finger C-x8-C-x5-C-x3-H type (and similar)
  misc_feature (1)..(370): Functional Homolog Of Ceres SEEDLINE ID no. ME07344 at SEQ ID NO: 792
MMMMGEGVSMPPWSHHVPVSGVDEGDEMTPYLLAALRQYLPCNDAGAEAEEDEAAAAAAAMAAGVDGYGCDEFRMYEFKVRRCARARSHDWTECPFAHPGEKARRRDPRKYHYSGAACPDFRKGGCKRGDGCDMAHGVFECWLHPARYRTQPCKDGTACRRRVCFFAHTADQLRVLPPTPQQQSSPRGAACSSPLAESYDGSPLRRQAFESYLTKSIMCSSPTSTLLSPPKSPPSESPPLSPDFRRGCWPGAGSPVNDVLASLRQLRLSRANSSPSGGWCGYPASAVAYGSPTGGALYGLSSTPRATAASCYMANLDPLDVSFGGDDEPVERVESGRALRAKVFERLSREGAVSGDAGGPDVGWVSDLIN

SEQ ID NO: 813 - DNA, 1385 bp, Zea mays
  misc_feature (1)..(1385): Ceres CLONE ID no.287298
  misc_feature (1)..(1385): Encodes the peptide sequence at SEQ ID NO 814
  misc_feature (601)..(601): m is a or c
gaaggaaggaagccatgatgatgatgggcgaaggcgtgagcatgccgccgtggtcccaccacgtccctgtgagcggcgtcgacgaaggcgacgagatgacgccgtacctgctcgcggcgctgcgccagtacctgccgtgcaacgacgccggcgccgaggccgaggaggatgaggcggccgccgccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccacctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgccgcagcagcagtccagccccagggggcgccgcctgctcttcccccgctcgccgagtcmtacgacggctccccgctccggcgccaggcgttcgagagctacctcaccaagagcatcatgtgctcgtcgccgaccagcaccctcctatcgccgcccaagtcgcccccgtcggagtccccgccattgtcgcccgacttccgccgtgggtgctggccgggcgccgggtcccccgtcaacgacgtgctcgcctcgctccgtcagctccgcctcagcagggccaactcgtccccgtcgggcggctggtgcagctaccctgcatccgcggtcgcgtacggatcgcctacggggggcgcgctctacggcctgtcctccaccccgagggccaccgccggctccggctacatggccaacctggaccctctcgacgtcaccttcggcggcgacgaggagcccgtggagagggtggagtccggccgcgcactccgcgcgaaggtgttcgagcggcttagcagggagggcgctgtttccggcgacgccggtggccccgacgtcgggtgggtctccgacctcatcaactgaggcggcggcgggtccctggcatggcagtggcaatggcaatgggcatgggcatggagaaaggtgatggtgagccgtatcggagaaggatggcatccaaaaaaatatttccctgcatttgatttcgttcctcagttaattccgctaatccccgtgtacatatctatcaccctgtgaatattctcggttggtaagagggaggatgatgctaggcggtggatggatgggtggatttgttttggggttcttgaggtagcggaaaatatcc

SEQ ID NO: 814 - protein, 389 aa, Zea mays
  misc_feature (1)..(389): Ceres CLONE ID no.287298
  misc_feature (1)..(389): Bit score of 309.9 for HMM based on sequences of FIGURE 25.
  misc_feature (110)..(135): Pfam Name: zf-CCCH Pfam Description: Zinc finger C-x8-C-x5-C-x3-H type (and similar)
  misc_feature (1)..(389): Functional Homolog Of Ceres SEEDLINE ID no. ME07344 at SEQ ID NO: 792
  misc_feature (196)..(196): Xaa is any aa, unknown or other
MMMMGEGVSMPPWSHHVPVSGVDEGDEMTPYLLAALRQYLPCNDAGAEAEEDEAAAAMAAGVDGYGCDEFRMYEFKVRRCARARSHDWTECPFAHPGEKARRRDPRKYHYSGATCPDFRKGGCKRGDGCDMAHGVFECWLHPARYRTQPCKDGTACRRRVCFFAHTADQLRVLPPTPQQQSSPRGRRLLFPRSPSXTTAPRSGARRSRATSPRASCARRRPAPSYRRPSRPRRSPRHCRPTSAVGAGRAPGPPSTTCSPRSVSSASAGPTRPRRAAGAATLHPRSRTDRLRGARSTACPPPRGPPPAPATWPTWTLSTSPSAATRSPWRGWSPAAHSARRCSSGLAGRALFPATPVAPTSGGSPTSSTEAAAGPWHGSGNGNGHGHGER

SEQ ID NO: 815 - DNA, 1437 bp, Panicum virgatum
  misc_feature (1)..(1437): Ceres CLONE ID no.1820378
  misc_feature (1)..(1437): Encodes the peptide sequence at SEQ ID NO 816
  misc_feature (640)..(640): m is a or c
ccgtccacggccgagccaaagcaagcaacctcctgcctcctcaaagagagttcgagatcgcagctgcctccagaccaccagcaaagcaaccgccaccgacgttccaagaagcgtaaccgaccatgatgatgatgggagagggagcgcacgcgccgccgtggcagcagcagcagcagcagccggcggccagcgccggcatggtggacggggacgacgcgtcgccgtacagcctcctggtggcgctgcggcatttcctgccatcgaacgaggccgcggcggcggcgtacgacgaggacgacgaggaggccctggccgcggtggacgcctacgcctgcgacgagttccggatgtacgagttcaaggtgcgccggtgctcgcgcgggcggagccacgactggacggactgcccgtacgcgcacccgggggagaaggcccgccgccgcgaccccaggcggtaccactactccggcaccgcctgcccggactatcgcaagggcggctgcaagcgcggcgacgcctgcgagtttgcgcacggggtgttcgagtgctggctccacccgtcgcgctaccggacgcagccctgcaaggacggcaccgcctgccgccgccgcgtctgcttcttcgcgcacacgccggaccmgctccgcgtcctgccgccgcagcagtccagcgccagccccaggggcgccggcgccgcgccgtcgccgctcgccgagtcgtacgacggctcgccgctccgccgccaggccttcgagagctacctcaccaagaccggcatcatgtcctcgtccccgaccagcacgctcgtctcgccgccgaggtcgccgccctccgagtccccgccaatgtcgccggacgccgccgccggcgcgctccgccgcggctcctggccgggtgtcggctcgcccgtcaacgaggtcgtcgcctcgctgcgccagctccgcctcggcggcggcggctcgccgaggtcggcgccgtccggcggctcgttcttggtcggctacccgttcgggtcccccaagtccccggccgcgctgtacagcctcccgtccaccccgaccaggccggccgcggtgacggtgaccaccccctccggcgccaccgtcatgaccgtggagcgcctcaaccttgggctcatcggtgacgaggagccggtgatggagcgggtggagtccgggagagccctccgcgagatggtgttcgagcggctcagcaaagaagccaccgtgcccaacgacgccgccgcctccgccaacgctgagggcgctgccccagccgccgccccggacgtcggctgggtctccgacctcataaactgatgagggagctcgagaagccagcaccatccgtggctcctctgaacattgtccatctatggtaagtgggggaagaacctgagaggcagcactgcacaacaggagaagaaaatccaaaagc

SEQ ID NO: 816 - protein, 398 aa, Panicum virgatum
  misc_feature (1)..(398): Ceres CLONE ID no.1820378
  misc_feature (1)..(398): Bit score of 923.4 for HMM based on sequences of FIGURE 25.
  misc_feature (114)..(139): Pfam Name: zf-CCCH Pfam Description: Zinc finger C-x8-C-x5-C-x3-H type (and similar)
  misc_feature (1)..(398): Functional Homolog Of Ceres SEEDLINE ID no. ME07344 at SEQ ID NO: 792
  misc_feature (173)..(173): Xaa is any aa, unknown or other
MMMMGEGAHAPPWQQQQQQPAASAGMVDGDDASPYSLLVALRHFLPSNEAAAAAYDEDDEEALAAVDAYACDEFRMYEFKVRRCSRGRSHDWTDCPYAHPGEKARRRDPRRYHYSGTACPDYRKGGCKRGDACEFAHGVFECWLHPSRYRTQPCKDGTACRRRVCFFAHTPDXLRVLPPQQSSASPRGAGAAPSPLAESYDGSPLRRQAFESYLTKTGIMSSSPTSTLVSPPRSPPSESPPMSPDAAAGALRRGSWPGVGSPVNEVVASLRQLRLGGGGSPRSAPSGGSFLVGYPFGSPKSPAALYSLPSTPTRPAAVTVTTPSGATVMTVERLNLGLIGDEEPVMERVESGRALREMVFERLSKEATVPNDAAASANAEGAAPAAAPDVGWVSDLIN

SEQ ID NO: 817 - DNA, 1965 bp, Panicum virgatum
  misc_feature (1)..(1965): Ceres CLONE ID no.1858754
  misc_feature (1)..(1965): Encodes the peptide sequence at SEQ ID NO 818
ccccgtccccaacccacgcactgtcccagtagcgataagccgagtccacgagatccccgtagaccaccggagcggaggagaaagcagccagccatgatgatgatgggcgaaggcgtgagcgtcccgccgtggtcgcaccacctcccggtgagcggcgtcgacgtcggaggcggcaccaccggcggcgacgagatgacgccgtacctgctgtcggcgctgcatcagtacctgccgtgcaacgacgccggcgcaggcgccgacgacgacgaggcggcggccgcggcggcgatggcggccggcgtcgacgggtacggctccgacgagttccgcatgtacgagttcaaggtccggcggtgcgcgcgcgcccgcagccacgactggaccgagtgccccttcgcgcacccgggggagaaggcgcgccgccgggacccgcgcaagtaccactactccggcaccgcctgcccggacttccgcaagggcgggtgcaagcgcggggacgcctgcgagttcgcgcacggcgtcttcgagtgctggctccacccggcgcgctaccgcacccagccctgcaaggacggcactgcctgccgccgccgcgtctgcttcttcgcccacaccccggaccagctgcgcgtgctcccggcgcagcagtccagccccaggggcgccgccgccgcggcctcgccgctcgccgagtcctacgacggctccccgctgcggcgccaggcgttcgagagctacctcaccaagagcatcatgtcgtcctcgcccaccagcaccctcatgtcgccgcccaagtcgcccccgtcggagtccccgccattgtcgccggacggcgccgccgccgccttccgccgcggctcctggccgggcgtcgggtccccggtaaacgaggtgctcgcctcgctgcgccagctccgcctcagcaaggccaactcgtcccctgccggcgggtggtccggctacccgtcctccgccgtcgcgtacggatcgcccacggcgaccgggctctacagcctgccctcgaccccgacgaccatgggcggctacatggccaacctggagccgcttgatgtctccttcggcggcggcgaggaggagcccgtgcagagggtggagtctgggcgagctctccgcgctaaggtgttcgagaggctgagcagggagggcgccgtctccggcgacgccacggccgcaatcggaggccccgacgtggggtgggtgtccgatctcatcaactgaggcggctggtcagtggtttctgacgtcttttgtgagtagcaaagtggcacggcgacggcaatggcttgggagaaaggtggtggtaagccgtgatggagaagaatggcatccaaaaatttcggtcttcttttgttgcttccagtttctttcgctaattccccctgtacatatctatcgccttgtgaatattctcggctggtagaggaaggatgcaaggtggtggaaggaggggtggatttgttttggggttcttgaggtagttgaaaatctctagaaaaaaaatagtcgagaaaaaaataagtagagatgtatttggtggtggtctgtgtcctctgttgtgcatagggtgtggaggcaagcatggcgggcagctgatggtggccatgaagacggacggaagacggccggatttcaagcgggcacggcggcggccggccgccggctctagctgcttaatttctatgattccggagtatgctagtttgatgatgtttaaagttcatcgtttgtgcattatcatgcatcggctagtttgatcgatttcaaccttgttgattattactacccacattttgttgatgtaatctctgtttattaagaccctcattccctacagcatattttgtattaccttttgtttagtagctgaaatctcattcacccgctattagaggtgaatttcctttgtaatattttgctcaagtaaatgaccaatccatgtttatc

SEQ ID NO: 818 - protein, 381 aa, Panicum virgatum
  misc_feature (1)..(381): Ceres CLONE ID no.1858754
  misc_feature (1)..(381): Bit score of 813.8 for HMM based on sequences of FIGURE 25.
  misc_feature (118)..(143): Pfam Name: zf-CCCH Pfam Description: Zinc finger C-x8-C-x5-C-x3-H type (and similar)
  misc_feature (1)..(381): Functional Homolog Of Ceres SEEDLINE ID no. ME07344 at SEQ ID NO: 792
MMMMGEGVSVPPWSHHLPVSGVDVGGGTTGGDEMTPYLLSALHQYLPCNDAGAGADDDEAAAAAAMAAGVDGYGSDEFRMYEFKVRRCARARSHDWTECPFAHPGEKARRRDPRKYHYSGTACPDFRKGGCKRGDACEFAHGVFECWLHPARYRTQPCKDGTACRRRVCFFAHTPDQLRVLPAQQSSPRGAAAAASPLAESYDGSPLRRQAFESYLTKSIMSSSPTSTLMSPPKSPPSESPPLSPDGAAAAFRRGSWPGVGSPVNEVLASLRQLRLSKANSSPAGGWSGYPSSAVAYGSPTATGLYSLPSTPTTMGGYMANLEPLDVSFGGGEEEPVQRVESGRALRAKVFERLSREGAVSGDATAAIGGPDVGWVSDLIN

SEQ ID NO: 819 - protein, 386 aa, Oryza sativa subsp. indica
  misc_feature (1)..(386): Public GI ID no.125524748
  misc_feature (1)..(386): Bit score of 935.1 for HMM based on sequences of FIGURE 25.
  misc_feature (117)..(142): Pfam Name: zf-CCCH Pfam Description: Zinc finger C-x8-C-x5-C-x3-H type (and similar)
  misc_feature (1)..(386): Functional Homolog Of Ceres SEEDLINE ID no. ME07344 at SEQ ID NO: 792
MMMMGEGVSSVPPWSHLPVSGVDVLGGGGGGGDEMTPYVIAALRDYLPANDVGVGADEEEEAAAMAAAVDAYACDEFRMYEFKVRRCARGRSHDWTECPFAHPGEKARRRDPRKYHYSGTACPDFRKGGCKRGDACEYAHGVFECWLHPARYRTQPCKDGTACRRRVCFFAHTPDQLRVLPAQQSSPRSVASSPLAESYDGSPLRRQAFESYLTKTIMSSSPTSTLMSPPKSPPSESPPLSPDGAAAIRRGSWPGVGSPVNDVLASFRQLRLNKVKSSPSGGWSYPSSSAVYGSPKAATGLYSLPTTPLASTATVTTASSFMPNLEPLDLGLIGDEEPVQRVESGRALREKVFERLSRDGAIYGDATAFATAGVGLDVDWVSDLIN

SEQ ID NO: 820 - protein, 404 aa, Oryza sativa subsp. indica
  misc_feature (1)..(404): Public GI ID no.125551145
  misc_feature (1)..(404): Bit score of 818.9 for HMM based on sequences of FIGURE 25.
  misc_feature (118)..(143): Pfam Name: zf-CCCH Pfam Description: Zinc finger C-x8-C-x5-C-x3-H type (and similar)
  misc_feature (1)..(404): Functional Homolog Of Ceres SEEDLINE ID no. ME07344 at SEQ ID NO: 792
MMMMGEGAHAPPWQQHVASPVSGVEGGGGRESEVVAAPYHLLDALRHYLPSNEAAAAEDEEEAAAVAAAVDAYACDEFRMYEFKVRRCARGRSHDWTECPFAHPGEKARRRDPRRYCYSGTACPDFRKGGCKRGDACEFAHGVFECWLHPARYRTQPCKDGTACRRRVCFFAHTPDQLRVLPPSQQQGSNSPRGCGGGGAGAAASPLAESYDGSPLRRQAFESYLTKSIMSSSPTSTLVSPPRSPPSESPPLSPDAAGALRRGAWAGVGSPVNDVLVSLRQLRLGSPRSAPSCASFLPAGYQYGSPKSPAAAAAAAAALYSLPSTPTRPSPVTVTTASGATVTVEPLDLGLIEEEQPMERVESGRALREKVFERLSKEATVSTDAAAAAAGVAPDVGWVSDLIN

SEQ ID NO: 821 - protein, 386 aa, Oryza sativa subsp. japonica
  misc_feature (1)..(386): Public GI ID no.115435036
  misc_feature (1)..(386): Bit score of 934.6 for HMM based on sequences of FIGURE 25.
  misc_feature (117)..(142): Pfam Name: zf-CCCH Pfam Description: Zinc finger C-x8-C-x5-C-x3-H type (and similar)
  misc_feature (1)..(386): Functional Homolog Of Ceres SEEDLINE ID no. ME07344 at SEQ ID NO: 792
MMMMGEGVSSVPPWSHLPVSGVDVLGGGGGGGDEMTPYVIAALRDYLPANDVGVGADEEEEAAAMAAAVDAYACDEFRMYEFKVRRCARGRSHDWTECPFAHPGEKARRRDPRKYHYSGTACPDFRKGGCKRGDACEYAHGVFECWLHPARYRTQPCKDGTACRRRVCFFAHTPDQLRVLPAQQSSPRSVASSPLAESYDGSPLRRQAFESYLTKTIMSSSPTSTLMSPPKSPPSESPPLSPDGAAAIRRGSWPGVGSPVNDVLASFRQLRLNKVKSSPSGGWSYPSSSAVYGSPKAATGLYSLPTTPLASTATVTTASSFMPNLEPLDLGLIGDEEPVQRVESGRALREKVFERLSRDGAISGDATAFATAGVGLDVDWVSDLIN

SEQ ID NO: 822 - protein, 402 aa, Oryza sativa subsp. japonica
  misc_feature (1)..(402): Public GI ID no.115462523
  misc_feature (1)..(402): Bit score of 811.1 for HMM based on sequences of FIGURE 25.
  misc_feature (118)..(143): Pfam Name: zf-CCCH Pfam Description: Zinc finger C-x8-C-x5-C-x3-H type (and similar)
  misc_feature (1)..(402): Functional Homolog Of Ceres SEEDLINE ID no. ME07344 at SEQ ID NO: 792
MMMMGEGAHAPPWQQHVASPVSGVEGGGGRESEVVAAPYHLLDTLRHYLPSNEAAAAEDEEEAAAVAAAVDAYACDEFRMYEFKVRRCARGRSHDWTECPFAHPGEKARRRDPRRYCYSGTACPDFRKGGCKRGDACEFAHGVFECWLHPARYRTQPCKDGTACRRRVCFFAHTPDQLRVLPPSQQQGSNSPRGCGGGGAGAAASPLAESYDGSPLRRQAFESYLTKSIMSSSPTSTLVSPPRSPPSESPPLSPDAAGALRRGAWAGVGSPVNDVHVSLRQLRLGSPRSAPSCASFLPAGYQYGSPKSPAAAAAAALYSLPSTPTRLSPVTVTTASGATVTVEPLDLGLIEEEQPMERVESGRALREKVFERLSKEATVSTDAAAAAAGVAPDVGWVSDLIN

SEQ ID NO: 823 - DNA, 713 bp, Zea mays
  misc_feature (1)..(713): Ceres SEEDLINE ID no.ME07859
  misc_feature (1)..(713): Ceres CLONE ID no.276809
  misc_feature (1)..(713): Inplanta Sequence
  misc_feature (1)..(713): Encodes the peptide sequence at SEQ ID NO. 824
atccctcaaggccggccgcccccagaaccagagtcggagtgaatccatggctcctccgcccctctcctcctggccatgggcaagcctcggccagtacaagtacgtgctgctggggcctcttgtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactggaaaaaaattctctggataccgcctccaaacaaccaaccgtggagcccctcagacaccggcaacgcgcaggcccacctagcaggaatcggaagacttttcttcttgcggctcgtcccggcgtttggctagctgctccgtctcaaatatcaaacaaatcatcggctaagccgatagacttccaaatttacttgccccatcgctaaaaatagaagacatgaaccaggagactcaggcatacataatttggcacatacagaaatcccttgatgtgcaggttcagcaacatataaaatttggcgcagcagtatgcaaccaattgtatattgtacgatacacaatgtattgaatttatttgagtaaaagaaaaatgctactacatggttgtatc

SEQ ID NO: 824 - protein, 135 aa, Zea mays
  misc_feature (1)..(135): Ceres SEEDLINE ID no.ME07859
  misc_feature (1)..(135): Ceres CLONE ID no.276809
  misc_feature (1)..(135): Bit score of 349.4 for HMM based on sequences of FIGURE 26.
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWKKILWIPPPNNQPWSPSDTGNAQAHLAGIGRLFFLRLVPAFG

SEQ ID NO: 825 - DNA, 1893 bp, Sorghum bicolor
  misc_feature (1)..(1893): Ceres ANNOT ID no.6007357
  misc_feature (1)..(1893): Encodes the peptide sequence at SEQ ID NO 826
atggctgctcccctctcttcctggccatggacaagcctcggcgattacaagtacgcgctgctggggcctctggcgtggaaggtggtgcaagaatggcgggagcagggccaaggggcgctgccgctggtgctgggctcgtggtggctgcacctcctcttgctgttcgtggtgcgggggctcacctaccagttctggttcacctacggcaacatgctcttcttcacccgccgccgccgagtcgtcgccgacggcgtcgacttccggcagatcgacgccgagtgggactgggacaactttctcgtgctgcaaacgctgattggggccacggtggtcaacagcccactgctcccgggcctgcggcagctctgcctgtgggacgcccgtgggtgggccgtcgccctgctgctgcatgtgggcttctcagagccggtcttctacctggcccaccgggccctccaccgggacccgctcttcgcccggcaccacgccgcgcaccactcctcgggagtcacccagtcgttgacagccgggttcgggacgccgctggaggccctgctgctgacgctggtgatgggggtcccactggcaggggccttcttggtcggggccgggtccataggcctggtctacgtgcacgccctcgccttcgactacctgcgcgccatggggtacagcaacgtcgaggtcgtgtcgcccagggtgtttgaagcgttcccgctgctcagatacatcctctacacaccttcgtacctgagcctgcaccaccgcgagcgtcgcggcaacttctgcctgttcatgccggcgctggactggctgggcgggacgctggactcgcgcgcgtggccgctgcagcgcgccgcctacgacggcgcggcgggcggcggcgcgctgggcacgccggggttcgtgttcctggcgcacgtggtggacatcatgtcgtcgatgcacgtgccgttcacgctccggtcgctgggcgccaccccgttcgccaaccacttctacctgctcccgttctggccgctggccttcttcttcatgctcctcatgtggtgctgctccaagaccttcgtcgtcagcttctactgcctccgcggccagctccaccagacctggtccgtgcctcgctacggcttccagtacttcctgccggcggcgaagaagggcatcaacaagcagatcgagctggccatccttcgggccgacaggatgggcgtcaaggtgctcagcctcgccgcgctaaacaagaacgaggcgttgaacggaggcggcaccctgttcgtgaacaagcacccggacctgcgtgtgagggtggtgcacggcaacacgctgacggcggccgtgatcctgaacgagatccccagcaacgtcaaggaggtgttcatgaccggcgccacctccaagctcggcagggccatcgcactctacctctgcaggaagaagatcagagtcctgatgttcacgatgtcgtcggagaggttcgtgaagatccagagggaggcgccgccggagttccagcagtacctcgtgcaggtgaccaaataccaggccgcacagaactgcaagacgtggatcgtgggcaagtggctgtcgccgcgcgagcagcggtgggcgccgtcggggacgcacttccaccagttcgtggtgccgcccatcatcggcttccggcgagactgcacctacggcaagctcgccgccatgaggctccccaaggacgtgcagggcctgggctcctgcgagtacacgatggagcgcggggtggtgcacgcgtgccacgccggcggcgtcgtgcacttcctcgaaggatgggaccaccacgaggtgggcgccatcgacgtcgaccggatcgacgtcgtctggaacgccgcgctcaagcacggcctcgcgccggtgtga

SEQ ID NO: 826 - protein, 150 aa, Sorghum bicolor
  misc_feature (1)..(150): Ceres ANNOT ID no.6007357
  misc_feature (1)..(150): Bit score of 402.0 for HMM based on sequences of FIGURE 26.
  misc_feature (1)..(150): Functional Homolog Of Ceres SEEDLINE ID no. ME07859 at SEQ ID NO: 824
MAAPLSSWPWTSLGDYKYALLGPLAWKVVQEWREQGQGALPLVLGSWWLHLLLLFVVRGLTYQFWFTYGNMLFFTRRRRVVADGVDFRQIDAEWDWDNFLVLQTLIGATVVNSPLLPGLRQLCLWDARGWAVALLLHVGFSEPVFYLAHR

SEQ ID NO: 827 - DNA, 1887 bp, Zea mays
  misc_feature (1)..(1887): Ceres SEEDLINE ID no.ME08464
  misc_feature (1)..(1887): Ceres CLONE ID no.424522
  misc_feature (1)..(1887): Inplanta Sequence
  misc_feature (1)..(1887): Encodes the peptide sequence at SEQ ID NO. 828
gccgcggacacaccttcctcctcctcccgtcgccatggacgtctgctcctccacgatctagcctgtggctattggttagcacgccggcgccggcgccggcgaccctaaagggagcgttaacgttgtatcccgagattttatgctctaagctttcgagccgcgtcatgggaaggaagcctgacgcggtagccaaatcgtatcattccggtggcggcggcgctgccgcctcctcgccgagggcagcgaggaaggcgtcgccttctccggtgttcctgggaaccgcgctgttcgttctagggtttgtgtccctctttacgggacacgtggtcaccgacgctgactgggcgcggatccgcagtcgatggcgacccaaacagcatagaaactacgaacctatcgatatttgggaatccaagtattccagcatgtactacggatgcagcgagagaagcgcgagtttcagatctgctgtgccagagaacagttccactggttacttgttgattgctactagtgggggcctgaatcagcagcgcatagggataacagatgctgttgtagttgcctggattttgaatgccacacttgttgtacctgagttagaccaccactcgttctggaaagacgacagtgacttctctgacatttttgacgtggagtggttcatttcccacctatcgaaggatgtaactattgtcaaaaggatcccttatgaagtaatgttgtcaatggataaactaccatggactatgcgcgcacctaggaaatcggtgcctgagttttatattgatgaagttctgccaatactcatgcgaaggcgagctttgcaattaacaaagtttgattataggctcactagcgatcttgatgaagatttgcaaaagttacgttgccgagtaaattttcatgctttaaaatttacgagttctattcacgccatgggtcagaaacttgttcaaaagctgagactaatgaacacacgatatgtcgccattcatttgaggtttgaacctgacatgcttgcattttctggctgttactacggtggcggtgaaaaagaaagaaaggaattgggtgaaattaggaaacgatgggatacattacctgagttgagtgctgaagatgaacgcagcagaggaaaatgtccactgactcctcatgaagtcgggttaatgctccgagctcttggttttggcaacgatacacttctgtatgttgcttctggagaaatatatggtggagatagtactctccaacctcttaggggactcttcccaaatttctatactaaggagaagcttgctggggatgatttaaatcccttccttcctttttcttcacggttggctgcaattgacttcattgtttgtgatgagagtgatgtctttgttacgaataataatgggaacatggccaaagttttagctggacggaggcgatacatgggccacaagagaactattcgcccaaatgcaaagaaactcaatgtactatttcaaacacggaatcaattgagctgggataccttttcacggaaggtacagagagttcagaggggtcttatgggggagccggacgatatcagaccaaaacaggatgacttccatgaatttccatcatcttgcatctgctcaagaaaacctgggaacatatcggccacaacatgaaaaccaaccggacagggcaaatgcagcgaggatgctgctagttgggcacttactttgacagtagggaaacatatgcttacgttgaaagaaacacggtagaattaacagggcaaggagggagtgcatatatgtcatggctcggtaagatgccacgtcaaggagagttgccaactggtgatgtcatgcctgtaaattattgttcgtacatgattaattcttt

SEQ ID NO: 828 - protein, 500 aa, Zea mays
  misc_feature (1)..(500): Ceres SEEDLINE ID no.ME08464
  misc_feature (1)..(500): Ceres CLONE ID no.424522
  misc_feature (1)..(500): Bit score of 1271.7 for HMM based on sequences of FIGURE 27.
  misc_feature (113)..(455): Pfam Name: DUF246 Pfam Description: Plant protein family
MGRKPDAVAKSYHSGGGGAAASSPRAARKASPSPVFLGTALFVLGFVSLFTGHVVTDADWARIRSRWRPKQHRNYEPIDIWESKYSSMYYGCSERSASFRSAVPENSSTGYLLIATSGGLNQQRIGITDAVVVAWILNATLVVPELDHHSFWKDDSDFSDIFDVEWFISHLSKDVTIVKRIPYEVMLSMDKLPWTMRAPRKSVPEFYIDEVLPILMRRRALQLTKFDYRLTSDLDEDLQKLRCRVNFHALKFTSSIHAMGQKLVQKLRLMNTRYVAIHLRFEPDMLAFSGCYYGGGEKERKELGEIRKRWDTLPELSAEDERSRGKCPLTPHEVGLMLRALGFGNDTLLYVASGEIYGGDSTLQPLRGLFPNFYTKEKLAGDDLNPFLPFSSRLAAIDFIVCDESDVFVTNNNGNMAKVLAGRRRYMGHKRTIRPNAKKLNVLFQTRNQLSWDTFSRKVQRVQRGLMGEPDDIRPKQDDFHEFPSSCICSRKPGNISATT

SEQ ID NO: 829 - DNA, 2396 bp, Gossypium hirsutum
  misc_feature (1)..(2396): Ceres CLONE ID no.1920179
  misc_feature (1)..(2396): Encodes the peptide sequence at SEQ ID NO 830
attagcatataaaaccgttgttatcaatcattcctatacaatggagtgaagtgaagccaagcagctctcctctgtctctaaaatcttaatcttcaattttgcattttttataataatttattccttttaatatttaaaacaaaagcttaacctttctctctcttcaatctttactttttttttcttgtgtgaacaaaaaaaagggaacatccaaagtctgccgcgtttcagaaagctttgagagtgtggatcgctagaaaggaagaagaaaagccctaattattctttgaattttagcttctgcattcgcaatttttacagttataccttccgtcggttttgtactcttttgatggtggtaaaatcattgggagtggcatttggcgtaaataagtgatgaagttaaagggggagtcgcggcggttgcttttgttgttgttgagtccgtgatgggcgtagctaaggcgtggagtttagcgtgatgtcggacaaactggcgctgttacagcatccaggcggcagccttttaagccacaagcatgagtgttgtaagtggcgatcgtctgcggcgcagccgaggaagccgatctcatggtcgctcatctgcggcttgatgcttttctgcttaggcatgatctcgctcttcaccggacatgtggcatctgatctcgagtggtactcccagcgacttatgaaacgaagatcctatttcaaattggagggaattaataaaggaccgattgatatatggcaatctgattatgcaaaatacttctatggatgcagcaaaagaagtcgtaattttcctcttgctatacgtgcgcgatcatcaaatggttatttgcttattgcagcaagtggaggattgaatcaacagagaacaggaatatcagatgctgtagttgttgcacggattctgaatgcaaccttagtcatacctgaattggatcatcgttcgtattggaaggatgatagtgactttgctaacattttcgatgtcaactggttcatttcttaccttgcaaaagatgttactattgtcagaagagttcctgataaattcatgcgatcaatggataaacctccttacacaatgcgtgtcccgaggaaatcccctccagaatattatctagatcaagttctgccaatacttcaaagaagatctgtcctacaactgacaaagtttgattacagactggccaacaacatcgacgatgacctacaaaagttgcgttgccgggctaattatcatgctttaagatttacaaaacctattcaagaacttgggcagaaacttgtaacgagaatgcgtgcaatggcaaaccgttttattgcagtccatttgagatttgaaccggatatgcttgcattttctggttgttactttggtggcggtgacaaggagaggaatgagcttggagagatacgaaagagatgggaaacattgacagatgtagatgctgatgaaaagaggaggcgaggtagatgtccacttactcctcatgaagtaggattgatgctgagggcacttggttttgcaaatgactcgtacatctatgttgcatctggagaaatatatggtggagaagagacgcttcgaccactaagagatctctttcccaacttttatacgaaagagatgcttgctaatgaagacctaaaaccttttcttccattctcttctcgccttgctgccattgactacattgtttgtgatgaaagtgatgttttcgtcaccaataataatggaagtatggccaagattcttgcaggtcgaaggaggtacatggggcacaagaggactataagaccaaatgcgaagaggtttggtcctttgatgatggaaagggatgagatggattgggataccttcgccagaaaggtgaaggcatttcaaaaaggattcatgggagagccagatgagatgagacctggacgtggtgaatttcatgaatatccatattcttgtatctgtgagaggccactaagtgatgttgtagacaacaaaaggggagatcctcggtcagaacaaggaaatcaaggattgagggagagaagcaaggaagaagagccagctttgggagccaaggagaatgaagcctaaggggaaaggaagacgctaatgctacaggctgatttaatgaccagaacaggattttttttctattgattgacaaagatccatctaacctagtgatgcatctgccctgccgacttaaatgtcatctcttgttaagcctgcagaaaacttgatagaacttgatgtttgagccgaaagctcggtaagggaagcttcttttgtttcttctcatttctgtttgaatccatgaagaaaaaacaaatttgtacagagaaagggaagattttacgaaaatgcaacttttgatttatatatg

SEQ ID NO: 830 - protein, 540 aa, Gossypium hirsutum
  misc_feature (1)..(540): Ceres CLONE ID no.1920179
  misc_feature (1)..(540): Bit score of 1385.9 for HMM based on sequences of FIGURE 27.
  misc_feature (122)..(464): Pfam Name: DUF246 Pfam Description: Plant protein family
  misc_feature (1)..(540): Functional Homolog Of Ceres SEEDLINE ID no. ME08464 at SEQ ID NO: 828
MSDKLALLQHPGGSLLSHKHECCKWRSSAAQPRKPISWSLICGLMLFCLGMISLFTGHVASDLEWYSQRLMKRRSYFKLEGINKGPIDIWQSDYAKYFYGCSKRSRNFPLAIRARSSNGYLLIAASGGLNQQRTGISDAVVVARILNATLVIPELDHRSYWKDDSDFANIFDVNWFISYLAKDVTIVRRVPDKFMRSMDKPPYTMRVPRKSPPEYYLDQVLPILQRRSVLQLTKFDYRLANNIDDDLQKLRCRANYHALRFTKPIQELGQKLVTRMRAMANRFIAVHLRFEPDMLAFSGCYFGGGDKERNELGEIRKRWETLTDVDADEKRRRGRCPLTPHEVGLMLRALGFANDSYIYVASGEIYGGEETLRPLRDLFPNFYTKEMLANEDLKPFLPFSSRLAAIDYIVCDESDVFVTNNNGSMAKILAGRRRYMGHKRTIRPNAKRFGPLMMERDEMDWDTFARKVKAFQKGFMGEPDEMRPGRGEFHEYPYSCICERPLSDVVDNKRGDPRSEQGNQGLRERSKEEEPALGAKENEA

SEQ ID NO: 831 - DNA, 1902 bp, Populus balsamifera subsp. trichocarpa
  misc_feature (1)..(1902): Ceres ANNOT ID no.1499777
  misc_feature (1)..(1902): Encodes the peptide sequence at SEQ ID NO 832
atgggagtggctaacaaggcttggatgcttagcttgttatcggaaaaaccgaacctggcgctttataaccaatcaaacggaaaacattatcaatatcatcaaaatatttataatgactggcggtggtggagatcttcggcgacccagcagcaccggaggaaggtgccgtggtcgcttgtttgcggtttgatgctgtttggtttgggattggtttctctcttcactggacacgtggcttctgatcttgagtggtactctcaacgattagtcaagcgcagcctcttctactctaggctggagggaaggcgacgtgaagcaattgatatttggaaatcaaaatactcgaatctcttctatggatgtagcgaaagagggcgtaattttcctcctgccgtacgtgagcgggcatcaaatggctatttgcttattgctgcaagcggagggttgaaccaacaaagaactggaataacagatgctgtggttgttgcacggattcttaatgctacattagttgtgcctgagctagatcatcactcctattggaaggatgatagtgactttgtcaacatttttgacgttgattggttcatttcttaccttgcaaaagatgtcaccattgtgaaaagagttcctgacaaagtcatgaggtcaatggaaaaacccccatataccatgcgtgtcccaagaaaatccccccctgagtattatctggatcaagttctgccaatattattaaggagacgtgttgtgcagttgacgaagtttgactataggcttgcaagtaaccttgacgaagagctgcaaaagttgcgctgccgggctaattatcatgctttaagatttacaaaacccatacaagaaattggagagagactcgtgacaaaaatgcgaaagatggcaaaacgttacattgcaattcacttgaggtttgaacctgatatgcttgcgttttctgggtgttactttggtgggggtgaaaaggagagatttgagcttggtgaaataagaaaaagatgggcaacattacctgatttaagccctgatggagagcgtgagagaggaaaatgtccactcactcctcatgaagtaggattaatgctgcgtgcccttggttttgctaacgacacatacctctatgttgcatctggagaaatatatggcggggaagagactttgagaccccttagagaactcttcccaaacttctatacgaaggagatgcttgcaatcgaagagctgaaatctttttttccattttcctctcgcatggcagccattgactacattgtctgtgatgagagtgatgtctttgtcacaaataacaatggaaacatggccaagattcttgctggtcgaaggagatatgctgggcataagaggaccatcagaccgaatgcaaagaagctcagtgcattgttcaaggcaagggatcggatggactgggatacatttgccaaaaaggtgaaagcaagccagagaggatttatgggagaacccgatgaggtgaggcctggacgaggtgactttcatgaatatccatcttgtatctgtgagaagccatttacggatgatgaaaacagaaagggcgaagatctactgtcagatagaattcatatgaacttgaaggaaaatgttgattccaagtatgttggggagaatcaaggtgacaaaagcctccagagattgaagaagagaagcatagaagaaccaatatctttaagagagaacaaggacgtaacggtgattggatcagcgaatgaactgggtttatgtacaggagacaggtatgtcaaagtcaatggaacttgtttggttgcatctaccaagtctgacttattgtgtcatcatgttcttagtttctccacaccctttttagatgaaactggcagtgggatgctgtga

SEQ ID NO: 832 - protein, 625 aa, Populus balsamifera subsp. trichocarpa
  misc_feature (1)..(625): Ceres ANNOT ID no.1499777
  misc_feature (1)..(625): Bit score of 1444.3 for HMM based on sequences of FIGURE 27.
  misc_feature (134)..(476): Pfam Name: DUF246 Pfam Description: Plant protein family
  misc_feature (1)..(625): Functional Homolog Of Ceres SEEDLINE ID no. ME08464 at SEQ ID NO: 828
MLSLLSEKPNLALYNQSNGKHYQYHQNIYNDWRWWRSSATQQHRRKVPWSLVCGLMLFGLGLVSLFTGHVASDLEWYSQRLVKRSLFYSRLEGRRREAIDIWKSKYSNLFYGCSERGRNFPPAVRERASNGYLLIAASGGLNQQRTGITDAVVVARILNATLVVPELDHHSYWKDDSDFVNIFDVDWFISYLAKDVTIVKRVPDKVMRSMEKPPYTMRVPRKSPPEYYLDQVLPILLRRRVVQLTKFDYRLASNLDEELQKLRCRANYHALRFTKPIQEIGERLVTKMRKMAKRYIAIHLRFEPDMLAFSGCYFGGGEKERFELGEIRKRWATLPDLSPDGERERGKCPLTPHEVGLMLRALGFANDTYLYVASGEIYGGEETLRPLRELFPNFYTKEMLAIEELKSFFPFSSRMAAIDYIVCDESDVFVTNNNGNMAKILAGRRRYAGHKRTIRPNAKKLSALFKARDRMDWDTFAKKVKASQRGFMGEPDEVRPGRGDFHEYPSCICEKPFTDDENRKGEDLLSDRIHMNLKENVDSKYVGENQGDKSLQRLKKRSIEEPISLRENKDVTVIGSANELGLCTGDRYVKVNGTCLVASTKSDLLCHHVLSFSTPFLDETGSGML

SEQ ID NO: 833 - DNA, 1602 bp, Populus balsamifera subsp. trichocarpa
  misc_feature (1)..(1602): Ceres ANNOT ID no.1485288
  misc_feature (1)..(1602): Encodes the peptide sequence at SEQ ID NO 834
atggaaagcgagtggccgcagctgcaacagcagcggaggaaggtaccgcggtcgctagtttgtggtttcatgctgtttggtttgggattgatttctctcttcactggacacgtggcatctgatcttgagtggtactctcaacgactagtcaagcgcagcttcttctactctaggctggaggggaggcgacgcgaaggcattgatatttggaaatcgaagtactcgaatttgttctatggatgtagcgaaagagggcgtaattttccttctgccatacgtgagcgggcttctaatggctatttgcttattgctgcaagtggagggttgaaccaacaaagaactggaataacagatgctgtggttgttgcacggattcttaatgctacattagttgtacccgatgactttgtcaacatttttgacattgatcggttcatttcttaccttgcaaaagatgtcaccattgtgaaaagggttcctgataaagtcatgcggtcaatggaaaaacccccatataccatgcgtgtcccaagaaaatcccctcctgaatattatctggatcaagttctgccaatattattgaggagacgtgttgtgcagctgacgaagtttgactataggcttgcaagtaaccttgacgaagagctgcaaaagttgcgctgccgggttaattatcatgctttaagatttacaaaacccatacaagaaattggcgagagacttgtgacaaaaatgcgaaagatggcaaaacgttatattgcagttcacttgaggtttgaacctgatatgcttgcattttctgggtgttactttggcgggggtgaaaaggagagatttgagctcggggaaataagaaaaagatgggaaacattacctgatttaagccccgatggagagcgagagagaggaaaatgtccactcactcctcatgaagtaggattaatgctgcgtgcccttggttttgctaacaacacatacctctatgttgcatctggagaaatatatggtggagaagagactctaaggccccttagagaactcttcccaaacttctatacaaaggagatgctagcagttgaagatctaaaaccttttcttccattttcttcccgcctggcggccatcgactacattgcctgtgatgagagtgatgtctttgtcacaaataataatggaaacatggccaagattcttgctggtcgaaggaggtacgctgggcataagaggaccatcagaccaaatgcaaagaagcttagtgcattgttcatggcaagggatcagatgggctgggatacattttccaaaaaggtgaaagcaagccagagaggatttatgggagagccagatgaggtgaggcctggacgaggtgactttcatgaatatccatcttgtatctgtgagaggccattcactgatgatgaaaacagcaagggtgaagatcgaccgtcagccaggattcctgtgaacttgaaggaaaaagttcactccaagtatgttggagagaaccaaggtgacaaaagcctccagagattgaagaaaagcatgggagaagaaccgatatctttaagagagaatgagggtgatgaaattttccctgactga

SEQ ID NO: 834 - protein, 533 aa, Populus balsamifera subsp. trichocarpa
  misc_feature (1)..(533): Ceres ANNOT ID no.1485288
  misc_feature (1)..(533): Bit score of 1245.2 for HMM based on sequences of FIGURE 27.
  misc_feature (102)..(433): Pfam Name: DUF246 Pfam Description: Plant protein family
  misc_feature (1)..(533): Functional Homolog Of Ceres SEEDLINE ID no. ME08464 at SEQ ID NO: 828
MESEWPQLQQQRRKVPRSLVCGFMLFGLGLISLFTGHVASDLEWYSQRLVKRSFFYSRLEGRRREGIDIWKSKYSNLFYGCSERGRNFPSAIRERASNGYLLIAASGGLNQQRTGITDAVVVARILNATLVVPDDFVNIFDIDRFISYLAKDVTIVKRVPDKVMRSMEKPPYTMRVPRKSPPEYYLDQVLPILLRRRVVQLTKFDYRLASNLDEELQKLRCRVNYHALRFTKPIQEIGERLVTKMRKMAKRYIAVHLRFEPDMLAFSGCYFGGGEKERFELGEIRKRWETLPDLSPDGERERGKCPLTPHEVGLMLRALGFANNTYLYVASGEIYGGEETLRPLRELFPNFYTKEMLAVEDLKPFLPFSSRLAAIDYIACDESDVFVTNNNGNMAKILAGRRRYAGHKRTIRPNAKKLSALFMARDQMGWDTFSKKVKASQRGFMGEPDEVRPGRGDFHEYPSCICERPFTDDENSKGEDRPSARIPVNLKEKVHSKYVGENQGDKSLQRLKKSMGEEPISLRENEGDEIFPD

SEQ ID NO: 835 - DNA, 1923 bp, Populus balsamifera subsp. trichocarpa
  misc_feature (1)..(1923): Ceres ANNOT ID no.1446782
  misc_feature (1)..(1923): Encodes the peptide sequence at SEQ ID NO 836
atgggagtggctaacaaggcttggatgcttagcttgttatcggaaaaaccgaacctggcgctttataaccaatcaaacggaaaacattatcaatatcatcaaaatatttataatgactggcggtggtggagatcttcggcgacccagcagcaccggaggaaggtgccgtggtcgcttgtttgcggtttgatgctgtttggtttgggattggtttctctcttcactggacacgtggcttctgatcttgagtggagggaaggcgacgtgaagcaattgatatttggaaatcaaaatactcgaatctcttctatggatgtagcgaaagagggcgtaattttcctctctgaacaagatgctgagacattctacttgagttcaaactttctaacaaagctaagtctatgtgtagctgccgtacgtgagcgggcatcaaatggctatttgcttattgctgcaagcggagggttgaaccaacaaagaactggaataacagatgctgtggttgttgcacggattcttaatgctacattagttgtgcctgagctagatcatcactcctattggaaggatgatagtgactttgtcaacatttttgacgttgattggttcatttcttaccttgcaaaagatgtcaccattgtgaaaagagttcctgacaaagtcatgaggtcaatggaaaaacccccatataccatgcgtgtcccaagaaaatccccccctgagtattatctggatcaagttctgccaatattattaaggagacgtgttgtgcagttgacgaagtttgactataggcttgcaagtaaccttgacgaagagctgcaaaagttgcgctgccgggctaattatcatgctttaagatttacaaaacccatacaagaaattggagagagactcgtgacaaaaatgcgaaagatggcaaaacgttacattgcaattcacttgaggtttgaacctgatatgcttgcgttttctgggtgttactttggtgggggtgaaaaggagagatttgagcttggtgaaataagaaaaagatgggcaacattacctgatttaagccctgatggagagcgtgagagaggaaaatgtccactcactcctcatgaagtaggattaatgctgcgtgcccttggttttgctaacgacacatacctctatgttgcatctggagaaatatatggcggggaagagactttgagaccccttagagaactcttcccaaacttctatacgaaggagatgcttgcaatcgaagagctgaaatctttttttccattttcctctcgcatggcagccattgactacattgtctgtgatgagagtgatgtctttgtcacaaataacaatggaaacatggccaagattcttgctggtcgaaggagatatgctgggcataagaggaccatcagaccgaatgcaaagaagctcagtgcattgttcaaggcaagggatcggatggactgggatacatttgccaaaaaggtgaaagcaagccagagaggatttatgggagaacccgatgaggtgaggcctggacgaggtgactttcatgaatatccatcttgtatctgtgagaagccatttacggatgatgaaaacagaaagggcgaagatctactgtcagatagaattcatatgaacttgaaggaaaatgttgattccaagtatgttggggagaatcaaggtgacaaaagcctccagagattgaagaagagaagcatagaagaaccaatatctttaagagagaacaaggacgtaacggtgattggatcagcgaatgaactgggtttatgtacaggagacaggtatgtcaaagtcaatggaacttgtttggttgcatctaccaagtctgacttattgtgtcatcatgttcttagtttctccacaccctttttagatgaaactggcagtgggatgctgtga

SEQ ID NO: 836 - protein, 632 aa, Populus balsamifera subsp. trichocarpa
  misc_feature (1)..(632): Ceres ANNOT ID no.1446782
  misc_feature (1)..(632): Bit score of 1318.3 for HMM based on sequences of FIGURE 27.
  misc_feature (141)..(483): Pfam Name: DUF246 Pfam Description: Plant protein family
  misc_feature (1)..(632): Functional Homolog Of Ceres SEEDLINE ID no. ME08464 at SEQ ID NO: 828
MLSLLSEKPNLALYNQSNGKHYQYHQNIYNDWRWWRSSATQQHRRKVPWSLVCGLMLFGLGLVSLFTGHVASDLEWREGDVKQLIFGNQNTRISSMDVAKEGVIFLSEQDAETFYLSSNFLTKLSLCVAAVRERASNGYLLIAASGGLNQQRTGITDAVVVARILNATLVVPELDHHSYWKDDSDFVNIFDVDWFISYLAKDVTIVKRVPDKVMRSMEKPPYTMRVPRKSPPEYYLDQVLPILLRRRVVQLTKFDYRLASNLDEELQKLRCRANYHALRFTKPIQEIGERLVTKMRKMAKRYIAIHLRFEPDMLAFSGCYFGGGEKERFELGEIRKRWATLPDLSPDGERERGKCPLTPHEVGLMLRALGFANDTYLYVASGEIYGGEETLRPLRELFPNFYTKEMLAIEELKSFFPFSSRMAAIDYIVCDESDVFVTNNNGNMAKILAGRRRYAGHKRTIRPNAKKLSALFKARDRMDWDTFAKKVKASQRGFMGEPDEVRPGRGDFHEYPSCICEKPFTDDENRKGEDLLSDRIHMNLKENVDSKYVGENQGDKSLQRLKKRSIEEPISLRENKDVTVIGSANELGLCTGDRYVKVNGTCLVASTKSDLLCHHVLSFSTPFLDETGSGML

SEQ ID NO: 837 - protein, 549 aa, Arabidopsis thaliana
  misc_feature (1)..(549): Public GI ID no.22328730
  misc_feature (1)..(549): Bit score of 1376.9 for HMM based on sequences of FIGURE 27.
  misc_feature (127)..(469): Pfam Name: DUF246 Pfam Description: Plant protein family
  misc_feature (1)..(549): Functional Homolog Of Ceres SEEDLINE ID no. ME08464 at SEQ ID NO: 828
MGVVAEVWRSSVRLLTNSPQLNGGSHKSALWKWRFFSAQPKRTVMWTWVCGFMLFSLGVISLFTGHVVSHLEWYSQQLSKRSLLDMSRREPIDVWKSKYSKFFYGCSERGRNFLPAVQEQSSNGYLLIAASGGLNQQRTGITDAVVVARILNATLVVPELDHHSYWKDDSDFSDIFDVNWFISSLAKDVTIVKRVPDRVMRAMEKPPYTTRVPRKSTLEYYLDQVLPILTRRHVLQLTKFDYRLANDLDEDMQKLRCRVNYHALRFTKRIQSVGMKVVKRMRKMAKRFIAVHLRFEPDMLAFSGCDFGGGEKERAELAEIRKRWDTLPDLDPLEERKRGKCPLTPHEVGLMLRALGFTNDTYIYVASGEIYGGEKTLKPLRELFPNFYTKEMLANDELKPLLPYSSRLAAIDYIVSDESDVFITNNNGNMAKILAGRRRYMGHKRTIRPNAKKLSALFMDREKMEWQTFAKKVKSCQRGFMGDPDEFKPGRGEFHEYPQSCICQRPFSYDKTSTDDEEEDMSEENHNSTSPGHVHLSSADNERDEVFPD

SEQ ID NO: 838 - protein, 465 aa, Arabidopsis thaliana
  misc_feature (1)..(465): Public GI ID no.4335769
  misc_feature (1)..(465): Bit score of 638.8 for HMM based on sequences of FIGURE 27.
  misc_feature (75)..(424): Pfam Name: DUF246 Pfam Description: Plant protein family
  misc_feature (1)..(465): Functional Homolog Of Ceres SEEDLINE ID no. ME08464 at SEQ ID NO: 828
MSVVVGDRSESTLMRSDYKAPPSQAIPKARLQLFWHSQIFTGLTNHISRFSLPVQSVPLPPPLPPRNYTSNGILLVSCNGGLNQMRAAVRICDMVTVARLLNLTLVVPELDKKSFWADTSDFEDIFDIKHFIDSLRDEVRIIRRLPKRYSKKYGFKLFEMPPVSWSNDKYYLQQVLPRFSKRKVIHFVRSDTRLANNGLSLDLQRLRCRVNFQGLRFTPRIEALGSKLVRILQQRGSFVALHLRYEMDMLAFSGCTHGCTDEEAEELKKMRYAYPWWREKEIVSEERRVQGLCPLTPEEAVLVLKALGFQKDTQIYIAAGEIFGGAKRLALLKESFPRIVKKEMLLDPTELQQFQNHSSQMAALDFIVSVASNTFIPTYYGNMAKVVEGHRRYLGFKKTILLDRKRLVELLDLHNNKTLSWDQFAVAVKDAHQGRRMGEPTHRKVISVRPKEEDYFYANPQECIS

SEQ ID NO: 839 - protein, 527 aa, Medicago truncatula
  misc_feature (1)..(527): Public GI ID no.92886131
  misc_feature (1)..(527): Bit score of 1203.6 for HMM based on sequences of FIGURE 27.
  misc_feature (128)..(472): Pfam Name: DUF246 Pfam Description: Plant protein family
  misc_feature (1)..(527): Functional Homolog Of Ceres SEEDLINE ID no. ME08464 at SEQ ID NO: 828
MFMAPRRGLLDGGEDRYGLMSFGTKDIFTMRRKIRYWQKQFKQRHLFGGLMVLLLMCVITKFILMNMFSDQLDLDTAIPSNVVQDEPSPNNWPTLEIWKHPNSDNYFNCMGRAKKDIRQGNNTNGYLLVHANGGLNQMKTGISDMVAIAKIMNATLVFPTLDHNSFWTDPSDFKEIFNWKNFVEVLNEDVQVVESLPPELAAIKPALKAPVSWSKASYYRTDMLQLLKKHKVIKFTHTDSRLVNNGLASSIQRVRCRAMYEALRFAVPIEELGKKLVNRLRENNTPYIALHLRYEKDMLAFTGCSHNLTKEETQELKKMRYSVKHWKEKEIDSKSKRLKGSCPMTPREVAVFLEALGYPVDTKIYVAAGVIYGSEGMKPLQKKFPNLLWHSSLATKEELQPFEGHLNQLAALDYYITVESDVFVYSYDGNMAKAARGHRKFDGFKKTISPDKQRFVRLIDQLDNGLISWNDFSTKVKSIHAKKKGAPQARKIHRHPKFEETFYANPFPGCICQKPTHLMAETNHESL

SEQ ID NO: 840 - protein, 569 aa, Nicotiana tabacum
  misc_feature (1)..(569): Public GI ID no.559921
  misc_feature (1)..(569): Bit score of 1394.0 for HMM based on sequences of FIGURE 27.
  misc_feature (131)..(472): Pfam Name: DUF246 Pfam Description: Plant protein family
  misc_feature (1)..(569): Functional Homolog Of Ceres SEEDLINE ID no. ME08464 at SEQ ID NO: 828
MKRRKQRSHEKLFLVLQIILHTLIFKRRRRIHHLLPLLAALTGGILFFFVLFSPPITSQHHHLINPIWFNNGTELQMNLQKEHVFRVPMGGGSLSGDIWTSKQSILYHGCSNSSYKFPSADVNTHPNRYLMIATSGGLNQQRTGIVDAVVAAHILNAVLVVPKLDQKSYWKDSSNFSEIFDVDRFISHLSKDVKIIRDIPRIGDKVITPYTTRVPRKCNAKCYQTRILPILKKKHAVQLTKFDYRLSNRLDIDMQKLRCRVNFHALKFTDPIIEMGRKLVERIRMKSKHFVALHLRFEPDMLAFSGCYYGGGDKETKELGKIRKRWKTLHATNPDKERRHGKCPLTPEEIGLMLRALGFGNDVHIYVASGEIYGGEETLAPLKALFPNFYSKETIASKEELAPFSSFSSRMAALDFMVCDESDVFVSNNNGNMARMLAGRRRYFGHKPTIRPNAKKLYKLFLSRNNMTWEEFASQVRTSQIGFMGEPMEVKPGRGEFHENPSACICADSDANDREDASLFGTHSIISEIDTGSSTNSARRDMVEVTDGQASEEEQEWSDTEYMETELEI

SEQ ID NO: 841 - DNA, 2176 bp, Triticum aestivum
  misc_feature (1)..(2176): Ceres CLONE ID no.910787
  misc_feature (1)..(2176): Encodes the peptide sequence at SEQ ID NO 842
acactactgatccgtagggctcccatgtcgccgctgtctcggcgactacttctccgccgccgtcgccgcggcgctctctccctgccctgagatctccggtcgccggacccgatatggtcctgccgcgccggcgcggcggccacaaccaccacccgtgcccgcgccgcgccgttctgccggcggcggcgctactgctgctcttcctcctcgccgccgtcacgctgctctacgtctctccgccgcctctgtccgaccacccggccctcgcctactcccgccgccgctccccgcatgctctgctgaacagctctggcggcggcagcctagtggagcccgggcgccgcgagatttcccgcgttccaaaaggtggttggagtgcgacagatggcctctggggttcgaagctcgctagcaaattctatgggtgcagcaactcaagcagcaagtttcttgattcaggtgttatgacacatccagaccgttatttgatgattgttacaagtggaggcctcaatcaacagagaacagggataattgatgctgttgttgctgcacgtattttaaatgcaacactcgttgttcccaaattggaccaaacctccttctggaaagatgcaagtgactttgctgaaatttttaacgccgactggttcatctcatttctatcaaaggatgtaaggattgtgaaagagcttccaaagataggaggtaaactgtgggctcctcatagaatgcgtgtgccccgcaaatgcactcagcgatgttacttgaaccgtgtgttgcctgcacttgttaagaaacatgttgttcgactaacaaaatttgattataggctagcaaacaggttggattctgatctgcaaaagctgaggtgcagagttaactaccatgcattgagatttactgacccaatacaagaaatgggtgaaaagataatacagagagtgcgggagaggagcacatattttattgctcttcatttaagatttgaaccggatatgcttgccttttctgggtgctactacggtggtggagaaaaggagaagagagaacttggtgtgatacggaagagatggaaaaccttgcatgctagcaatccagagaaagaaagaaggcacggtaggtgcccactaactcctgaagaggtggggttgatgttgagggcactgggctacagaaagaatgttcatatttatgttgcctctggagatatatatggtggggcaaagacgttagcacccctgaaagcgctattccccaatcttcataccaaagaaacagtaacaagcaaagacgagctggctccgttctcaaagtactcatctcgcatggccgcacttgatttcattgtctgtgatggaagtgatgcttttgtgactaacaacaatggtaatatggccaaaattttggctgggcgaaggagatatcttgggcataagagaacgatccgaccaaatgcgagaaagctctactcgttattcttgagcagaggaaacatgtcctgggatgcattctcctccaaagtgcacatggcccagaaaggatttatgggggagcccaaagagctgaggccaggaaggggggagttccacgagaaccccacgacatgtatatgtgaaaacactgatcccaaaacaccgaccaaacctaaccctcgaagcgagcaaggattgattaatggcaccgagggtaggaaagccattaccgagcccacagttgctaatcataccaacgaggagttggtaggatccagtgcggaagaagacgacgctagcgtggagaaagaagacgacactagtgcggagaaagaagatgacactagtgaagagaaagaggagatagctgacccggaagcggaggatgatgcgttggtgagaccagatgatcctgagctggaggaggttctttcagattagacaagttacccaggccgtaggtagatgttaaccagccggcagagttttggtgagcagctgatggattttgcccctttaaatgtacatattttgcgtgctgtgtaaaataacccaccccctttctactctagttagcttgtagtgtatcctcggctttcgttagtccggtatcatagcggctgtgcgctgatctcgtcgagtttgtaatgtgtgtggtatgttgtagcatgcgcttgtttgtgttttattcacttatctgc

SEQ ID NO: 842 - protein, 600 aa, Triticum aestivum
  misc_feature (1)..(600): Ceres CLONE ID no.910787
  misc_feature (1)..(600): Bit score of 1430.5 for HMM based on sequences of FIGURE 27.
  misc_feature (126)..(467): Pfam Name: DUF246 Pfam Description: Plant protein family
  misc_feature (1)..(600): Functional Homolog Of Ceres SEEDLINE ID no. ME08464 at SEQ ID NO: 828
MVLPRRRGGHNHHPCPRRAVLPAAALLLLFLLAAVTLLYVSPPPLSDHPALAYSRRRSPHALLNSSGGGSLVEPGRREISRVPKGGWSATDGLWGSKLASKFYGCSNSSSKFLDSGVMTHPDRYLMIVTSGGLNQQRTGIIDAVVAARILNATLVVPKLDQTSFWKDASDFAEIFNADWFISFLSKDVRIVKELPKIGGKLWAPHRMRVPRKCTQRCYLNRVLPALVKKHVVRLTKFDYRLANRLDSDLQKLRCRVNYHALRFTDPIQEMGEKIIQRVRERSTYFIALHLRFEPDMLAFSGCYYGGGEKEKRELGVIRKRWKTLHASNPEKERRHGRCPLTPEEVGLMLRALGYRKNVHIYVASGDIYGGAKTLAPLKALFPNLHTKETVTSKDELAPFSKYSSRMAALDFIVCDGSDAFVTNNNGNMAKILAGRRRYLGHKRTIRPNARKLYSLFLSRGNMSWDAFSSKVHMAQKGFMGEPKELRPGRGEFHENPTTCICENTDPKTPTKPNPRSEQGLINGTEGRKAITEPTVANHTNEELVGSSAEEDDASVEKEDDTSAEKEDDTSEEKEEIADPEAEDDALVRPDDPELEEVLSD

SEQ ID NO: 843 - DNA, 2697 bp, Panicum virgatum
  misc_feature (1)..(2697): Ceres CLONE ID no.1797432
  misc_feature (1)..(2697): Encodes the peptide sequence at SEQ ID NO 844
gaaaaattaaaaaacggttgctagcatgcggagattcccctgatatttctcgctattttttttccttttggtttatttacctgctgtgccatttcttgttgcgccccgccccctgaaacctcgcgttttgtcagttgcacccctctggatcgccgcctcctgctcttctcgttcacttgcttcccgttccgagtgccgcccgccacccgggcacccggcgaaagcttcgtcagcatccaccgccgcttcgcgtcccctccccgcgggcgcgaggtgcacgctcgcttcgtaggaagcgcgcggaggaggccggccgagaaggagccgcggcgcggggagcagaggcggcgtacgcgcgcgcgcacggtgtgcgtgtgcgccgtacgcgtacgtgcgtgagagcagcagcaggaggaggagcgcatggggtcgaggcggcggcggcaccaccaccaccacggcccgtggctggtgcccgcagtggcgccggccgccgcggcgttcgcggcggcggggctgctgctcgtcgtcgtcgcgttccactgcttcctgtcgccgccgctcggcgacggtggcggcggcgcgcgtgtcgtccggcgcccgaacccgccgttcctgttgaagaagccggcggaggttgccaggagtgtaatcggcgccgtggatttcactgttcctagcggcgggagcaagcacgggcaggagctctgggagtcgaaggcgacgggcaacttcttcggctgcagcaacgcgaccaagcatttcgccgatgccaaggctgtgacgaaattggaccgttacctgatgatcgcgacgagcggcggactgaatcagcagcgaacagggatcatagatgctgttgttgcagcccgcatactgaatgcaacacttgtcattccaaagctggatgaagaatccttctggaatgacgcgagtgacttcgcacagatatttgatgtggattccttcatatactcactctcaaacgatgtaaaggtcatacgacaattacctgatatgaatgggaaaaagctttcaccatataagatgcgtattcctaggaagtgtactccaaaatgctatgagaacagagtgctacctgctcttctgaaaaaacatgttgttcaattaacaaaatttgactatcgagtgtccaataggctagagactgatcttcaaaaacttaggtgtagagtcaattatcatgcactacagttcacagatccaatcctaagaatgggcgaattgcttgtccaaagaatgaaggagaaaagtggacgcttcattgctcttcacctgagatttgagcctgacatgctcgcgttctctggttgctattatgggggtggagacatcgagagaagagaactcggtgagattcgtaagaggtggaaaaccctgcatgcaagcaaccctgacagagaacggcggcacggtaagtgccctctgacaccagaggaagtcggcctcatgcttagggcactgggatttgggaaggacgtacacctatatgttgcatccggagatgtatatggaggcgaggaaacattggcacctctcaaagcactctttccaaactttcactcaaaggagactctagcaagcaaggaggagttggcacctttcttaccatattcatctcgcatggctgctcttgattttattgtgtgtgataggagcgatgttttcgtgacaaacaacaatggcaacatggccagaatgttggctggtcgaaggagatattttgggcacaggaggaccataaggcccaatgctaagaaactatactcattatttctgaatcgaaccagtatgagttgggacacatttgcatccaaagttctgacattccaaaagggattcatgggggagcccaatgagattaaaccaggaagaggcgaattccatgagcatcctatggattgcatttgtgcaaaagccaacggtaaaattgggcagagcaggcatcatcaaattaaacgtgctggaaaaggtgcggagaaccattctagtgatggagacctcgactggagggatttggactatggagagcatacaccattgggcagggattcatctaatgaatctgaatcagatgatattcgtgttggtggatcagacattcctgaattggaggacatgatgtcggactagatacttaaaaatagatatttctgtataggtttgtttttcttttcaaagggcttggtgataaactattgtgtttatagaagctgttgcataggttatcatttctcctgtttatttcttggagacttatagaagagaataagagtttttaactggcccggcaaagaagatagggcaggaagagcttcctgcagaaaaagcagagaggccttcagctcactatgagctaaacaactgtacagtgtttgattggtcctcaagtaatgccgattggtcattataaaaaaaagtaatgctgattggtaaactagaagacgtttttccttcacggtttttctttcatatagtttgtacggtaaatagatgctacaaaagacccttctttaagcttttacagagtagtgttataattagaatttgctgggggtttagtatttattcttggtttccttttcttttacaataagagtatgttaccgattttgcgccgccatcgaaatttgtatatataacttgaagcatgagaatgaaagagattttgtaccg

SEQ ID NO: 844 - protein, 576 aa, Panicum virgatum
  misc_feature (1)..(576): Ceres CLONE ID no.1797432
  misc_feature (1)..(576): Bit score of 1423.6 for HMM based on sequences of FIGURE 27.
  misc_feature (128)..(469): Pfam Name: DUF246 Pfam Description: Plant protein family
  misc_feature (1)..(576): Functional Homolog Of Ceres SEEDLINE ID no. ME08464 at SEQ ID NO: 828
MGSRRRRHHHHHGPWLVPAVAPAAAAFAAAGLLLVVVAFHCFLSPPLGDGGGGARVVRRPNPPFLLKKPAEVARSVIGAVDFTVPSGGSKHGQELWESKATGNFFGCSNATKHFADAKAVTKLDRYLMIATSGGLNQQRTGIIDAVVAARILNATLVIPKLDEESFWNDASDFAQIFDVDSFIYSLSNDVKVIRQLPDMNGKKLSPYKMRIPRKCTPKCYENRVLPALLKKHVVQLTKFDYRVSNRLETDLQKLRCRVNYHALQFTDPILRMGELLVQRMKEKSGRFIALHLRFEPDMLAFSGCYYGGGDIERRELGEIRKRWKTLHASNPDRERRHGKCPLTPEEVGLMLRALGFGKDVHLYVASGDVYGGEETLAPLKALFPNFHSKETLASKEELAPFLPYSSRMAALDFIVCDRSDVFVTNNNGNMARMLAGRRRYFGHRRTIRPNAKKLYSLFLNRTSMSWDTFASKVLTFQKGFMGEPNEIKPGRGEFHEHPMDCICAKANGKIGQSRHHQIKRAGKGAENHSSDGDLDWRDLDYGEHTPLGRDSSNESESDDIRVGGSDIPELEDMMSD

SEQ ID NO: 845 - protein, 499 aa, Oryza sativa subsp. indica
  misc_feature (1)..(499): Public GI ID no.116310135
  misc_feature (1)..(499): Bit score of 1284.1 for HMM based on sequences of FIGURE 27.
  misc_feature (107)..(449): Pfam Name: DUF246 Pfam Description: Plant protein family
  misc_feature (1)..(499): Functional Homolog Of Ceres SEEDLINE ID no. ME08464 at SEQ ID NO: 828
MGRKPDPSKPHYGGGASPRAARRTQPSPVFLGTALFVLGFVSLFTGHIVTDADWSRIRSRWRSKQVRNNEPINIWKSRYSNLYYGCSRRSVNFRSAVPENSSTGYLLIGTSGGLNQQRIGITDAVVVARILNATLVVPELDHHSFWKDDSDFSDIFDVDWFISYLSKDVTIVKRIPYEVMMSMDKLPWTMRAPRKSMPDFYIDEVLPILMRRRALQLTKFDYRLTNELDEELQKLRCRVNFHALRFTNSIQTLGEKLVRKLRSMSSRYVAVHLRFEPDMLAFSGCYYGGGDKERRELGEIRKRWDTLPELSAEDERSRGKCPLTPQEIGLMLRALGFSNDTYLYVASGEIYGGEETLQPLRDLFPNYYTKEMLAGNDLKLFLPFSSRLAAIDFIVCDGSDVFVTNNNGNMAKVLAGRRRYMGHKRTIRPNAKKLNLLFKRRKQMGWDIFSQKVKKVQRGLMGEPDDIRPGRDDFNEFPSSCICQRIPVNRSVTARAENL

SEQ ID NO: 846 - protein, 432 aa, Oryza sativa subsp. indica
  misc_feature (1)..(432): Public GI ID no.125549266
  misc_feature (1)..(432): Bit score of 909.2 for HMM based on sequences of FIGURE 27.
  misc_feature (75)..(428): Pfam Name: DUF246 Pfam Description: Plant protein family
  misc_feature (99)..(428): Pfam Name: DUF246 Pfam Description: Plant protein family
  misc_feature (1)..(432): Functional Homolog Of Ceres SEEDLINE ID no. ME08464 at SEQ ID NO: 828
MGRKPDPSKPHYGGGASPRAARRTQPSPVFLGTALFVLGFVSLFTGHIVTDADWSRIRSRWRSKQHVLCLNSWSMLPYNVGNVQVRNNEPINIWKSSFQITDAVVVARILNATLVVPELDHHSFWKDDSDFSDIFDVDWFISYLSKDVTIVKRIPYEVMMSMDKLPWTMRAPRKSMPDFYIDEVLPILMRRRALQLTKFDYRLTNELDEELQKLRCRVNFHALRFTNSIQTLGEKLVRKLRSMSSRYVAVHLRFEPDMLAFSGCYYGGGDKERRELGEIRKRWDTLPELSAEDERSRGKCPLTPQEIGLMLRALGFSNDTYLYVASGEIYGGEETLQPLRDLFPNYYTKEMLAGNDLKLFLPFSSRLAAIDFIVCDGSDVFVTNNNGNMAKVLAGRRRYMGHKRTIRPNAKKLNLLFKRRKQMGWDIFSQKY

SEQ ID NO: 847 - protein, 499 aa, Oryza sativa subsp. japonica
  misc_feature (1)..(499): Public GI ID no.38345464
  misc_feature (1)..(499): Bit score of 1288.5 for HMM based on sequences of FIGURE 27.
  misc_feature (107)..(449): Pfam Name: DUF246 Pfam Description: Plant protein family
  misc_feature (1)..(499): Functional Homolog Of Ceres SEEDLINE ID no. ME08464 at SEQ ID NO: 828
MGRKPDPSKPHYGGGASPRAARRTQPSPVFLGTALFVLGFVSLFTGHIVTDADWSRIRSRWRSKQVRNNEPINIWKSRYSNLYYGCSRRSVNFRSAVPENSSTGYLLIGTSGGLNQQRIGITDAVVVARILNATLVVPELDHHSFWKDDSDFSDIFDVDWFISYLSKDVTIVKRIPYEVMMSMDKLPWTMRAPRKSMPDFYIDEVLPILMRRRALQLTKFDYRLTNELDEELQKLRCRVNFHALRFTNSIQTLGEKLVRKLRSMSSRYVAVHLRFEPDMLAFSGCYYGGGDKERRELGEIRKRWDTLPELSAEDERSRGKCPLTPQEIGLMLRALGFSNDTYLYVASGEIYGGEETLQPLRDLFPNYYTKEMLAGNDLKPFLPFSSRLAAIDFIVCDGSDVFVTNNNGNMAKVLAGRRRYMGHKRTIRPNAKKLNLLFKRRKQMGWDIFSQKVKKVQRGLMGEPDDIRPGRDDFNEFPSSCICQRIPVNRSVTARAENL

SEQ ID NO: 848 - protein, 432 aa, Oryza sativa subsp. japonica
  misc_feature (1)..(432): Public GI ID no.38605861
  misc_feature (1)..(432): Bit score of 912.9 for HMM based on sequences of FIGURE 27.
  misc_feature (75)..(428): Pfam Name: DUF246 Pfam Description: Plant protein family
  misc_feature (99)..(428): Pfam Name: DUF246 Pfam Description: Plant protein family
  misc_feature (1)..(432): Functional Homolog Of Ceres SEEDLINE ID no. ME08464 at SEQ ID NO: 828
MGRKPDPSKPHYGGGASPRAARRTQPSPVFLGTALFVLGFVSLFTGHIVTDADWSRIRSRWRSKQHVICLSSWSMLPYNVGNVQVRNNEPINIWKSSFQITDAVVVARILNATLVVPELDHHSFWKDDSDFSDIFDVDWFISYLSKDVTIVKRIPYEVMMSMDKLPWTMRAPRKSMPDFYIDEVLPILMRRRALQLTKFDYRLTNELDEELQKLRCRVNFHALRFTNSIQTLGEKLVRKLRSMSSRYVAVHLRFEPDMLAFSGCYYGGGDKERRELGEIRKRWDTLPELSAEDERSRGKCPLTPQEIGLMLRALGFSNDTYLYVASGEIYGGEETLQPLRDLFPNYYTKEMLAGNDLKPFLPFSSRLAAIDFIVCDGSDVFVTNNNGNMAKVLAGRRRYMGHKRTIRPNAKKLNLLFKRRKQMGWDIFSQKY

SEQ ID NO: 849 - protein, 451 aa, Oryza sativa subsp. japonica
  misc_feature (1)..(451): Public GI ID no.125591208
  misc_feature (1)..(451): Bit score of 842.1 for HMM based on sequences of FIGURE 27.
  misc_feature (192)..(447): Pfam Name: DUF246 Pfam Description: Plant protein family
  misc_feature (75)..(447): Pfam Name: DUF246 Pfam Description: Plant protein family
  misc_feature (1)..(451): Functional Homolog Of Ceres SEEDLINE ID no. ME08464 at SEQ ID NO: 828
MGRKPDPSKPHYGGGASPRAARRTQPSPVFLGTALFVLGFVSLFTGHIVTDADWSRIRSRWRSKQHVICLSSWSMLPYNVGNVQVRNNEPINIWKSSFQITDAVVVARILNATLVVPELDHHSFWKDDSDFSDIFDVDWFISYLSKDVTIVKRIPYEVMIFQITDAVVVARILNATLVVPELDHHSFWKDDRKSMPDFYIDEVLPILMRRRALQLTKFDYRLTNELDEELQKLRCRVNFHALRFTNSIQTLGEKLVRKLRSMSSRYVAVHLRFEPDMLAFSGCYYGGGDKERRELGEIRKRWDTLPELSAEDERSRGKCPLTPQEIGLMLRALGFSNDTYLYVASGEIYGGEETLQPLRDLFPNYYTKEMLAGNDLKPFLPFSSRLAAIDFIVCDGSDVFVTNNNGNMAKVLAGRRRYMGHKRTIRPNAKKLNLLFKRRKQMGWDIFSQKY

SEQ ID NO: 850 - protein, 514 aa, Cleome spinosa
  misc_feature (1)..(514): Public GI ID no.90657544
  misc_feature (1)..(514): Bit score of 1180.2 for HMM based on sequences of FIGURE 27.
  misc_feature (111)..(459): Pfam Name: DUF246 Pfam Description: Plant protein family
  misc_feature (1)..(514): Functional Homolog Of Ceres SEEDLINE ID no. ME08464 at SEQ ID NO: 828
MSEAEKFIYHRKLWEVKGISVGESKAEKLRSYLVSRSRMKLWMIRAVTILLLWSCVVHLMALGEFWGPRLLKGWPSCFNHHDLPVAAETASLPMKIALPPKRVYKNNGYLMVSCNGGLNQMRAAICDMVTIARYMNVTLIVPELDKTSFWSDPSEFQDIFDVDHFITSLRDEVRILKELPPRLKRRFELGMYYSFPPISWSDISYYSNQILPLVKKYKVVHLNKTDTRLANNGLSLDIQKLRCRVNFNALRFTPQIEELGRRVVRILREKGPFLVLHLRYEMDMLAFSGCSHGCNPDEEEELTRMRYAYPWWKEKVINSELKRKDGLCPLTPEETALALNALGIDRNVQIYIAAGEIYGGERRMKALAEAFPNVVRKETLLEPSDLKFFQNHSSQMAALDYLVSLESDIFVPTYDGNMAKVVEGHRRFLGFKKTILLDRKLLVNLIDQYTEGLLSWDEFSSTVKEVHEDRMGSPKKRLVIPDKPKEEDYFYANPHECLQLLDEPLRTTRLSMFL

SEQ ID NO: 851 - protein, 509 aa, Cleome spinosa
  misc_feature (1)..(509): Public GI ID no.90657636
  misc_feature (1)..(509): Bit score of 1067.6 for HMM based on sequences of FIGURE 27.
  misc_feature (112)..(460): Pfam Name: DUF246 Pfam Description: Plant protein family
  misc_feature (1)..(509): Functional Homolog Of Ceres SEEDLINE ID no. ME08464 at SEQ ID NO: 828
MSEAEKFLYHRKLWEMKDRFLGGESKAEKLRNSLVSRSRMRLWMIRAVTILLLWSCVVHLMALGDFWGPRLLKGWPSCFNHHDLPLALEMASLPTKIALPPKRVYKNNGYLMVSCNGGLNQMRAAICDMVTIARYMNVTLIVPELDKTSFWNDPSEFQDIFDVDHFISSLRDEVRILKELPPRLKRRVELGMYYSLPPISWSDFSYYQNQILPLVKKYKVVHLNKTDSRLANNGLPLEIQKLRCRVNFNALRFTPQIEELGRQAVRILREKGPFLVLHLRYEMDMLAFSGCTHGCNRDEEEELTRMRYAYPWWKEKVINSELKRKDGLCPLTPEETALALTALGIDQNVQIYIAAGEIYGGERRMKALTEAFPNVVRKETLLEPSDLKFFQNHSSQMAALDYLVSLESDIFVPTYDGNMAKVVEGHRRFLGFKKTIILDRKLLVNLIDQYKEGLLSWDEFSSTVKEVHEDRMGSPKKRLVITDKPKEEDYFYSNPHECLQLLDGPLRNT

SEQ ID NO: 852 - DNA, 551 bp, Zea mays
  misc_feature (1)..(551): Ceres SEEDLINE ID no.ME09939
  misc_feature (1)..(551): Ceres CLONE ID no.324216
  misc_feature (1)..(551): Inplanta Sequence
  misc_feature (1)..(551): Encodes the peptide sequence at SEQ ID NO. 853
ctatttaggtatacatttttggtaggagcttttatacagcaacaagtacaaggtgaatgtggtcatcccctttcttcttctggttgctactggctgcagtcttaatcttgcagatgttcattacgaagagggtcttgaggacattcaagcacacgagattcctagttaggtgaaattccttggtagggatagtagctaggctctgacaagtagtgtttggtgcgtaatttctgcctttgctctttttccctttgtcagcgtcgaattttggtggtcggttgtaaagcttgtgttgagggggcttttgcggcttgatttttgtcctggattcgagttttgacaccagaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttggatggagttaaattgacattatcgg

SEQ ID NO: 853 - protein, 38 aa, Zea mays
  misc_feature (1)..(38): Ceres SEEDLINE ID no.ME09939
  misc_feature (1)..(38): Ceres CLONE ID no.324216
MWSSPFFFWLLLAAVLILQMFITKRVLRTFKHTRFLVR

SEQ ID NO: 854 - DNA, 294 bp, Arabidopsis thaliana
  misc_feature (1)..(294): Ceres SEEDLINE ID no.ME11735
  misc_feature (1)..(294): Ceres ANNOT ID no.573161
  misc_feature (1)..(294): Inplanta Sequence
  misc_feature (1)..(294): Encodes the peptide sequence at SEQ ID NO. 855
atgagtccgatcgtcataacccagttagctacaggaatcagcgttttagccggtgcggtctttatcaaatcagtcatggaccaaaagcctatggctggtcaattccctcgttgtccgacttgtaacggtactggacgagtcacgtgtttctgttctcgatggtccgatggtgacgttggatgtcgtaggtgttctggttcaggtcgtgcggcttgtagcaattgtggtggttctggaactggtagacctttaccggctcagattacggttcagccaccgaatcgtccttattga

SEQ ID NO: 855 - protein, 97 aa, Arabidopsis thaliana
  misc_feature (1)..(97): Ceres SEEDLINE ID no.ME11735
  misc_feature (1)..(97): Ceres ANNOT ID no.573161
  misc_feature (1)..(97): Bit score of 227.4 for HMM based on sequences of FIGURE 28.
MSPIVITQLATGISVLAGAVFIKSVMDQKPMAGQFPRCPTCNGTGRVTCFCSRWSDGDVGCRRCSGSGRAACSNCGGSGTGRPLPAQITVQPPNRPY

SEQ ID NO: 856 - protein, 98 aa, Gossypium barbadense
  misc_feature (1)..(98): Public GI ID no.35187445
  misc_feature (1)..(98): Bit score of 231.0 for HMM based on sequences of FIGURE 28.
  misc_feature (1)..(98): Functional Homolog Of Ceres SEEDLINE ID no. ME11735 at SEQ ID NO: 855
MFPAVLTQVATGLSVLAGAVLVKSVMDQKPMAGPFQRCPTCNGTGRITCICTRWSDGDIGCRTCAGSGRMACSSCGGSGTGRPIPVQISVRQPTNRNS

SEQ ID NO: 857 - DNA, 766 bp, Gossypium hirsutum
  misc_feature (1)..(766): Ceres CLONE ID no.1798230
  misc_feature (1)..(766): Encodes the peptide sequence at SEQ ID NO 858
aagaactcaaaccctcaaagcatcgaatacgtgtataatttccacaccacttctttcctttatactcttcccaccaagaaaaagatctcacaatttcctctttccttttatctcttccttccctcccctactatccatctttagacgttatggttcccatcgtgttgacccagatggctaccggtttgggtgtattggccggggccgtttttgtcaaatcggtcatggaccagaaacccatggccggaccgttccagagatgccccacttgcaacggcacagggcgtgtctcgtgtatttgttcccgctggtcggatggcgatgtcggttgtcggacttgctcggggtcgggtcgcagggcttgtagcagttgcggcggatcaggtacgggccgccccattccggtccaactcattgtgcgtcaaccaaccaatcgaagcttctaattatcgagattttgctgtccttgaatcacgacagtcgtaagaactcttagcttactataaattgatctatatatatatatttttaggaattttattgtgaaatatatatatgagagtggaagagagagataggggaggttagcatcttaaaatcttgtattgcaatcactctattcagattcttatcaaacttcaaactgaatttatagcttgcttacctgtatggtatttcttgatgattttaactacgcttaagctaactagttttttaatgcaaaattatagtgcttttttttttcggaaattagagaattatttgt

SEQ ID NO: 858 - protein, 98 aa, Gossypium hirsutum
  misc_feature (1)..(98): Ceres CLONE ID no.1798230
  misc_feature (1)..(98): Bit score of 234.2 for HMM based on sequences of FIGURE 28.
  misc_feature (1)..(98): Functional Homolog Of Ceres SEEDLINE ID no. ME11735 at SEQ ID NO: 855
MVPIVLTQMATGLGVLAGAVFVKSVMDQKPMAGPFQRCPTCNGTGRVSCICSRWSDGDVGCRTCSGSGRRACSSCGGSGTGRPIPVQLIVRQPTNRSF

SEQ ID NO: 859 - DNA, 627 bp, Gossypium hirsutum
  misc_feature (1)..(627): Ceres CLONE ID no.1798035
  misc_feature (1)..(627): Encodes the peptide sequence at SEQ ID NO 860
ctcttcactgctccataacgctcattaaattccaaaaaggaaaacttccgatcccgtctccggcgacatgttgccggccgttttgactcaggtggccaccggcttaagcgttttagctggtgccgtcttagtcaaatccgtcatggatcaaaaacccatggccggtccgtttcaaagatgcccgacttgtaacggcacgggtcgcatcacgtgcatttgcaatcgttggtccgatggagattccggttgtcggacttgcgccgggtccggtcggatggcgtgtagcagttgtggtgggtctggtaccggtagaccgattccggttcagatttctgtacgtcaaccgacgaatcggaactcttaattttccgggtttggactctttaaactcttatatatttttatagttttttttttgaaatttaattaatgtaatataacagtgacagtaaaattaatagttgcttaattgtaatctctacaacgaaactgttttcagattcttatagcttaattgttgttttgtttttgttaagaatttgaagaaattgttgtaaaagattaacaattcatgggtaaaaatttgcatgaattatatattaaattccaagtaaactctttctcttc

SEQ ID NO: 860 - protein, 98 aa, Gossypium hirsutum
  misc_feature (1)..(98): Ceres CLONE ID no.1798035
  misc_feature (1)..(98): Bit score of 231.2 for HMM based on sequences of FIGURE 28.
  misc_feature (1)..(98): Functional Homolog Of Ceres SEEDLINE ID no. ME11735 at SEQ ID NO: 855
MLPAVLTQVATGLSVLAGAVLVKSVMDQKPMAGPFQRCPTCNGTGRITCICNRWSDGDSGCRTCAGSGRMACSSCGGSGTGRPIPVQISVRQPTNRNS

SEQ ID NO: 861 - DNA, 291 bp, Populus balsamifera subsp. trichocarpa
  misc_feature (1)..(291): Ceres ANNOT ID no.1500963
  misc_feature (1)..(291): Encodes the peptide sequence at SEQ ID NO 862
atgggaccgatcgttctgacccagttggccacgggtcttagtgtgctagccggggctgttctggtcaaatcggttatggaccagaagcccatggccggcccgttgtgcccatcttgcaacgggacgggtcgggtcgcttgtctttgttcccgttggtccgatggagatgctggttgccgggcttgttccggttcgggtcgcatggcgtgtagtagctgcggagggactggtaccggtcggcctattccggttcaaatctctatgcggtcaccgaaccgtcctccatcttga

SEQ ID NO: 862 - protein, 96 aa, Populus balsamifera subsp. trichocarpa
  misc_feature (1)..(96): Ceres ANNOT ID no.1500963
  misc_feature (1)..(96): Bit score of 214.2 for HMM based on sequences of FIGURE 28.
  misc_feature (1)..(96): Functional Homolog Of Ceres SEEDLINE ID no. ME11735 at SEQ ID NO: 855
MGPIVLTQLATGLSVLAGAVLVKSVMDQKPMAGPLCPSCNGTGRVACLCSRWSDGDAGCRACSGSGRMACSSCGGTGTGRPIPVQISMRSPNRPPS

SEQ ID NO: 863 - DNA, 288 bp, Populus balsamifera subsp. trichocarpa
  misc_feature (1)..(288): Ceres ANNOT ID no.1490944
  misc_feature (1)..(288): Encodes the peptide sequence at SEQ ID NO 864
atggaaccgatcgttttgacccagttggcaacgggtcttagtgtactagccggggcggttctggtcaagtcggttatgggccagaagcccatggctggtccgacgtgcccatcttgcaacggcacgcgtcgagtcgcttgtctttgttcccgttggtcagaccgagatgtgggttgccggacttgttctggttccggtcgcatggcgtgtagtagctgcggagggacaggtactggtcggcctattccggttcaaatctctatgaggtcaccaaaccgcccatcttga

SEQ ID NO: 864 - protein, 95 aa, Populus balsamifera subsp. trichocarpa
  misc_feature (1)..(95): Ceres ANNOT ID no.1490944
  misc_feature (1)..(95): Bit score of 197.9 for HMM based on sequences of FIGURE 28.
  misc_feature (1)..(95): Functional Homolog Of Ceres SEEDLINE ID no. ME11735 at SEQ ID NO: 855
MEPIVLTQLATGLSVLAGAVLVKSVMGQKPMAGPTCPSCNGTRRVACLCSRWSDRDVGCRTCSGSGRMACSSCGGTGTGRPIPVQISMRSPNRPS

SEQ ID NO: 865 - DNA, 464 bp, Arabidopsis thaliana
  misc_feature (1)..(464): Ceres CLONE ID no.34019
  misc_feature (1)..(464): Encodes the peptide sequence at SEQ ID NO 866
aaaaattggcaaccaaaaccaaacctctctctcttattgaaaccaacaatgagtccgatcgtcataacccagttagctacaggactcagcgttttagccggtgcggtgtttatcaaatcggtcatggaccaaaagcctatggctggtcaattccctcgttgtccaacttgtaatggtacgggacgagtcacgtgtttctgttctcgatggtctgatggtgacgttggatgtcgtaggtgttctggttcaggtcgtgcggcttgtagcaattgtggtggttctggaactggtagacctttaccggctcagattacggttcagccaccgaatcgtccttattgatgattctcaagaaatttgtatactttgtaaacgattcttctctcttgaactctctcactctctgtcttgtaagttgattatatatatacacatagatgagaacagatttgatagcttctgtc

SEQ ID NO: 866 - protein, 97 aa, Arabidopsis thaliana
  misc_feature (1)..(97): Ceres CLONE ID no.34019
  misc_feature (1)..(97): Bit score of 229.0 for HMM based on sequences of FIGURE 28.
  misc_feature (1)..(97): Functional Homolog Of Ceres SEEDLINE ID no. ME11735 at SEQ ID NO: 855
MSPIVITQLATGLSVLAGAVFIKSVMDQKPMAGQFPRCPTCNGTGRVTCFCSRWSDGDVGCRRCSGSGRAACSNCGGSGTGRPLPAQITVQPPNRPY

SEQ ID NO: 867 - DNA, 792 bp, Triticum aestivum
  misc_feature (1)..(792): Ceres CLONE ID no.567542
  misc_feature (1)..(792): Encodes the peptide sequence at SEQ ID NO 868
agattgccacaaccccccgtccacacacacccatcgaaacctcttcttcttccaactcctaccagcaccagcaaagccaagaagtacagctcctcctcccctcccctgtagctgcttcgccgtttccgggaggttcttggattggtttttcggcagagatggtttcgcccgtcgtgatcgcgtcggcggggctcgggatgctggcgggcgtggcgttggcgagccgggggacgggcgacgggctgccggcgtcgtccagatgggacgcgcggccccgttgctccacgtgcagcggcaccggccgggaggagtgcctctgcagccgctggtccgacggcgacgtcggctgcgggacgtgctctgggtccggccgcaagcggtgccgcagctgcggaggctctggcaccggccggccgctcccggcgcgactcatcgtccaggagcagaagctgccgaccgcgccagggcgacgcggagactacaactgatattcatcggtttccccgaggaaatcgtaagtgtaattaagcacaacatagcacaccagtatatgcaacgtgtccattcctgtgtatgttatacgctgtctccttccaatactccctccgtaaactaatataaaaatatttagatcattactttaatgatttaaacgtttttatattagtttacagagggagtacgtactagttaagtagctatggcaagtccttgagaccgtagacttggatgtaataatggcaaaatcatgcatcaaacagtttcgtggttcctttgattcaaaggaatttt

SEQ ID NO: 868 - protein, 109 aa, Triticum aestivum
  misc_feature (1)..(109): Ceres CLONE ID no.567542
  misc_feature (1)..(109): Bit score of 225.5 for HMM based on sequences of FIGURE 28.
  misc_feature (1)..(109): Functional Homolog Of Ceres SEEDLINE ID no. ME11735 at SEQ ID NO: 855
MVSPVVIASAGLGMLAGVALASRGTGDGLPASSRWDARPRCSTCSGTGREECLCSRWSDGDVGCGTCSGSGRKRCRSCGGSGTGRPLPARLIVQEQKLPTAPGRRGDYN

SEQ ID NO: 869 - DNA, 1083 bp, Zea mays
  misc_feature (1)..(1083): Ceres CLONE ID no.702251
  misc_feature (1)..(1083): Encodes the peptide sequence at SEQ ID NO 870
gtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggtcggggaggatgccctgccgcagctgcggcggctccggcacgggccgaccgctccctgcacggctcaccgtccagcaccagaagccgccgccgccgccgccgcccggctacaactgatcgatggtggatgattaggtatccgtatccgtggattatatacttctcgcgggcgatttgcgatgcgacccatacaagaaagaaatcagttaaactgcgatatgatgcgctctagctagttaatcatatatacatatatacacgtccgatccattcgtgtggatgacatccatgttgcatatgtacaagtacatgtctcttcttcaagagtcaagactagctgtaattgagctgagcatacttggtgttgctgttgttcagttaatttgcaaaaacgcacaacacaagaaagaaggaaaaaaaaaacagagtggaaatgtttttttttaagatctggagaacaacatgattgagaagggagggaaggtgattctgagcacagttttgttggaaaggctgtagttaattctggtggatgtaatatattatatgtatgtatatgcttagattcgttaatatatatgcatatatatgcacccacatgaatatgatttacag

SEQ ID NO: 870 - protein, 107 aa, Zea mays
  misc_feature (1)..(107): Ceres CLONE ID no.702251
  misc_feature (1)..(107): Bit score of 238.5 for HMM based on sequences of FIGURE 28.
  misc_feature (1)..(107): Functional Homolog Of Ceres SEEDLINE ID no. ME11735 at SEQ ID NO: 855
MVAPVVIASAGLGMLAGVAMANRSLGNGLPAASRWDARPRCATCGGSGRVECICNRWSDGDSGCRTCAGSGRMPCRSCGGSGTGRPLPARLTVQHQKPPPPPPPGYN

SEQ ID NO: 871 - DNA, 837 bp, Zea mays
  misc_feature (1)..(837): Ceres CLONE ID no.1491731
  misc_feature (1)..(837): Encodes the peptide sequence at SEQ ID NO 872
gtagctcctccagtccttctgctacacagaaacgccatcgcctccgcccaaaaaacagcctccacacacgacctaaatcttttcctgcccacgggcgactcccaaacccaacagcagcaagaaagccaaggaaaacactcatttccttcttccttccttctctaccatatagccaagaaccgaaggtagcttgcgacttggcaagctacaagttgggcgattcaagcagcaggatggtggcgccggtggtgatcgcgtcggcggggctgggcatgctggccggcgtggcgatggccaaccggtcccttggggacgggctcccggcggcctacaggtgtgacgcgcgcccgcgctgcgccacgtgcggcggctccggccgagtcgagtgcttgtgcaaccgctggtccgatggcgactcaggctgccggacctgcgcggggtcggggaggatgccctgccgcagctgcggcggctccggcaccggcaggccgctcccggcgcggctcaccgtccagcaccagaagccgccgccgccggccggctacaactgatggaataattaggtatccatatccgtggattgtataattcacgcgggaatatatatatggtgcaacccatccaggaaatcagttcaactgcgagatgattatgcatgtacatgcctcttcttcaagaccggttgtaatatattgtgctgaggacactcggtgtcgctgttgttcagttaatatgcaaattgcacagcacaagaaaaaagaagaaaaactgtgttgaaatggtttttttctttagagatctaaggaaaatatatgatgagaagggagagctgtccgt

SEQ ID NO: 872 - protein, 105 aa, Zea mays
  misc_feature (1)..(105): Ceres CLONE ID no.1491731
  misc_feature (1)..(105): Bit score of 233.1 for HMM based on sequences of FIGURE 28.
  misc_feature (1)..(105): Functional Homolog Of Ceres SEEDLINE ID no. ME11735 at SEQ ID NO: 855
MVAPVVIASAGLGMLAGVAMANRSLGDGLPAAYRCDARPRCATCGGSGRVECLCNRWSDGDSGCRTCAGSGRMPCRSCGGSGTGRPLPARLTVQHQKPPPPAGYN

SEQ ID NO: 873 - DNA, 653 bp, Zea mays
  misc_feature (1)..(653): Ceres CLONE ID no.1615195
  misc_feature (1)..(653): Encodes the peptide sequence at SEQ ID NO 874
agcatactgcatacatacagccatacgcatatcctaggtcgaagctgaacgtcgatcgagctccgactaaagatctttggatcggagcaccaagcagagtcgtagcagccagtttgtacgccgtcagattcttgggagatggtcgggctcgggcccatcgtgctcgcggcatccgcggggctcggcgcgctcgtcggccaagcagcggccgacggcgggtggtgctcggcgtggaggccgccgccgccgccgctggccggcgccggcgccggcgcgcgggggtcgtactgcgcggcgtgcggtggcacagggaaggttgcgtgcccctgcgcccggtggtcggacggcgacgtcgggtgcaggacgtgcgctggatccggtcgcgcggcgtgccggagctgccgtggctccggcacccgcagacgcgccgccgtccgggtagccgtgcgcgcgcagagggctctggtggccgttacgaaagacagatgacggggtttgtgtgtgtgaagaagctttggggctggatgctgtaatcagaaataccttgtgtactgtgtagtagactagcatcatggattcatggccacgggtgactagtatgtacagtacatccttttctatctattatattaaagccggttagaaacaatgcc

SEQ ID NO: 874 - protein, 116 aa, Zea mays
  misc_feature (1)..(116): Ceres CLONE ID no.1615195
  misc_feature (1)..(116): Bit score of 99.6 for HMM based on sequences of FIGURE 28.
  misc_feature (1)..(116): Functional Homolog Of Ceres SEEDLINE ID no. ME11735 at SEQ ID NO: 855
MVGLGPIVLAASAGLGALVGQAAADGGWCSAWRPPPPPLAGAGAGARGSYCAACGGTGKVACPCARWSDGDVGCRTCAGSGRAACRSCRGSGTRRRAAVRVAVRAQRALVAVTKDR

SEQ ID NO: 875 - DNA, 429 bp, Parthenium argentatum
  misc_feature (1)..(429): Ceres CLONE ID no.1606777
  misc_feature (1)..(429): Encodes the peptide sequence at SEQ ID NO 876
aaagactcagttccctgtttcttgaatatctgagatgggtccggttgtactgactcagttagcaacgggtctgagcatgttggctggtgcagccctggtgaagtcagtgatggaccagaacaccatgatgggtccagggtccgatcggtttccaaggtgttctcgttgcaacggcactggcagagtcagttgcctttgtaaccggtggtccgatggcgaccgtggctgccggacctgtgcaggttcaggccggatggtgtgcagtagctgtggtggtaccggcactggccgtcctctcccagttcagatctctgttcgccctccaaaccaatcctactaacctggtaaccagttagctccatataattgtaatcttttcaatatatattttcagtaaaacattgcggatatagaatactccacttatgt

SEQ ID NO: 876 - protein, 101 aa, Parthenium argentatum
  misc_feature (1)..(101): Ceres CLONE ID no.1606777
  misc_feature (1)..(101): Bit score of 231.7 for HMM based on sequences of FIGURE 28.
  misc_feature (1)..(101): Functional Homolog Of Ceres SEEDLINE ID no. ME11735 at SEQ ID NO: 855
MGPVVLTQLATGLSMLAGAALVKSVMDQNTMMGPGSDRFPRCSRCNGTGRVSCLCNRWSDGDRGCRTCAGSGRMVCSSCGGTGTGRPLPVQISVRPPNQSY

SEQ ID NO: 877 - DNA, 835 bp, Panicum virgatum
  misc_feature (1)..(835): Ceres CLONE ID no.1789146
  misc_feature (1)..(835): Encodes the peptide sequence at SEQ ID NO 878
aaacaaccgccgccacacacggcctccaaatcttttcctctccacaggccggaatgaagctatagctcgtcaagtcgtcgccggccgctataccaaaggaagccaaggaaaaacactcctctttctctccctcccttcccttccgttccattcgatcccatatccaagaaccaaagctgagatccgctcgaggaggatggtggcgccggtggtgatcacgtcggcggggctgggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggcaggccgctccccgcgcggctcaccgtccagcaccacaagccgccgccgccggccggctacaactgacgctcgccgatcgattgattagacatgatgatgccggtcggctgacgacatggatgatgagcatgggcgggggcggcagggagcagcaagtatgggctggataggcttggccagagatcttgtggtcgagaggagctcagcatcagatccacaggcttgcaagaaaaagatcccgtagggtagcgtagccacaccaggcactagctttggaccaatgggtagtacggtatggggtccaccaatgtgccatatactacacattatcagagaaaaaagtgacatacacgtgcactaggagcctttggaagcaagttccgtctg

SEQ ID NO: 878 - protein, 105 aa, Panicum virgatum
  misc_feature (1)..(105): Ceres CLONE ID no.1789146
  misc_feature (1)..(105): Bit score of 243.6 for HMM based on sequences of FIGURE 28.
  misc_feature (1)..(105): Functional Homolog Of Ceres SEEDLINE ID no. ME11735 at SEQ ID NO: 855
MVAPVVITSAGLGMLAGLAMANRSLGDGLPAASRWDARPRCATCGGSGRVECLCNRWSDGDSGCRTCAGSGRMPCRSCGGSGTGRPLPARLTVQHHKPPPPAGYN

SEQ ID NO: 879 - DNA, 760 bp, Panicum virgatum
  misc_feature (1)..(760): Ceres CLONE ID no.1766830
  misc_feature (1)..(760): Encodes the peptide sequence at SEQ ID NO 880
tcgtagcccccttctcctacacagaatcgccgccgcctccggccaaacaaccgccgccacacacggcccccaaatcttttcctctccacaagctggcagctatagcgcgtcgcgtcgtcgtctataccgaaaggaagccaaggagaacactcctcttcctctccctcccttcttccatagttccattccattccatcccatcccaaatccaagcagaaccgaagctccggacagtttgagattcaatcgaggatggtggcgccggtggtgatcgcgtcggcggggctcggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggaaggccgctccccgcgcggctcaccgtccagcaccagaagccgccgccgccggccggctacaactgacggtcggtcgatcgattgattaggtatatgtccatatccatggatcgatgattatagctcgttctttgcgctcgaggcgcaagcgaaaaactccgctagctagtatggaaatatacgtccattcgatcgtgtggatgagatgttgtatgtatatgtctctctgcttcatcaagacttgtagtaattgagc

SEQ ID NO: 880 - protein, 105 aa, Panicum virgatum
  misc_feature (1)..(105): Ceres CLONE ID no.1766830
  misc_feature (1)..(105): Bit score of 241.5 for HMM based on sequences of FIGURE 28.
  misc_feature (1)..(105): Functional Homolog Of Ceres SEEDLINE ID no. ME11735 at SEQ ID NO: 855
MVAPVVIASAGLGMLAGLAMANRSLGDGLPAASRWDARPRCATCGGSGRVECLCNRWSDGDSGCRTCAGSGRMPCRSCGGSGTGRPLPARLTVQHQKPPPPAGYN

SEQ ID NO: 881 - DNA, 867 bp, Panicum virgatum
  misc_feature (1)..(867): Ceres CLONE ID no.1719641
  misc_feature (1)..(867): Encodes the peptide sequence at SEQ ID NO 882
ataccaaaggaagccaaggaaaaacactcctctttctctccctcccttcccttcccttccgttccattcgatcccatatccaagaaccaaagctgagatccgctcgaggaggatggtggcgccggtggtgatcgcgtcggcggggctgggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggcaggccgctccccgcgcggctcaccgtccagcaccacaagccgccgccgccggccggctacaactgacgctcgtcgatcgattgattaggtatacatgtccatatccatggatcgatgattatagctcgctcgttctttgcgctcgaggcgcgcgcaagcgagaaactcccctagctagtatggaaatatacgtccattcgatcgtgtggatgagatgttgtatatgtgtcgtctctgcttcatcaagacttgtagtgattgagcctacttgtgttggtgttgttcgtaatttccaaactgcgcaacacaagaagctaaggaagaagaaaggaaaaaaaaagtttggagatctacccgagaacgaacatgcatgattgagagtagacagaaagcaagagatgaagaacacagttttgctggcaagttgtagttacggtggtggatgtaatatgtatatgcttggatcattcgttaatatatgcgcgcacatacacatgatttac

SEQ ID NO: 882 - protein, 105 aa, Panicum virgatum
  misc_feature (1)..(105): Ceres CLONE ID no.1719641
  misc_feature (1)..(105): Bit score of 242.4 for HMM based on sequences of FIGURE 28.
  misc_feature (1)..(105): Functional Homolog Of Ceres SEEDLINE ID no. ME11735 at SEQ ID NO: 855
MVAPVVIASAGLGMLAGLAMANRSLGDGLPAASRWDARPRCATCGGSGRVECLCNRWSDGDSGCRTCAGSGRMPCRSCGGSGTGRPLPARLTVQHHKPPPPAGYN

SEQ ID NO: 883 - DNA, 805 bp, Panicum virgatum
  misc_feature (1)..(805): Ceres CLONE ID no.1759608
  misc_feature (1)..(805): Encodes the peptide sequence at SEQ ID NO 884
aggagctgacctgaccaccaccacctccaccgcagctagcagccgaaggccaattaagaagggcgcgcgctcgatcctctttgtcgtcctccatcccggcgggctctctccgatcagcagcgcgagacggcggcggagatggtggcggcgatcgcggtggcctcggcggggctggggatgctggcgggcgtcgcgatggccagccgggcgccgccctcgtcctcggagggacccgcgccgtggacgtggaggcccggggctcccccggccgcgctgcggtggggcggcggcggcgcgccgcgctgcgaggcgtgcggcgggtccggcaaggaggagtgccgcctgtgcgcgcggtggtccgacgccggcgccagggggagccgccggtccgggtgcggggcgtgcgcggggacgcgccgggcgccctgccggtgctgcggcgggtccgggactgggcggcgcgcggccgtgcgggtcgccgcctccgcgcgcgcggcccccaccgcccgggctgcccgatgagacggcgacggcgacggcgacggtgatgcctgctcgcctcttggcctctcctcgacccggctcccggatcatggatgaaggctctgccctctgcggctccctgccaggacagacagaacagaggaaccgcggcgtcggcttgtttcttcttgtttttttttttctagctggaaaaaatttagagaaaaattctgtaacatacggagtatacatagtttgtagtacaagtagattagagatttgatcatcaatatatatatatttgcatagcaaggtttattcc

SEQ ID NO: 884 - protein, 127 aa, Panicum virgatum
  misc_feature (1)..(127): Ceres CLONE ID no.1759608
  misc_feature (1)..(127): Bit score of 111.0 for HMM based on sequences of FIGURE 28.
  misc_feature (1)..(127): Functional Homolog Of Ceres SEEDLINE ID no. ME11735 at SEQ ID NO: 855
MVAAIAVASAGLGMLAGVAMASRAPPSSSEGPAPWTWRPGAPPAALRWGGGGAPRCEACGGSGKEECRLCARWSDAGARGSRRSGCGACAGTRRAPCRCCGGSGTGRRAAVRVAASARAAPTARAAR

SEQ ID NO: 885 - protein, 117 aa, Oryza sativa subsp. indica
  misc_feature (1)..(117): Public GI ID no.116309500
  misc_feature (1)..(117): Bit score of 185.1 for HMM based on sequences of FIGURE 28.
  misc_feature (1)..(117): Functional Homolog Of Ceres SEEDLINE ID no. ME11735 at SEQ ID NO: 855
MVVVVAPIAVASAGLGMLAGVAMASRSSNSSSSSGRTSSPAALLRWGAPEPAPRCAACGGTGREECRLCARWSDARGDCSGCRACAGTRRAPCRSCGGSGTGRRAPVRVSSSAPPSR

SEQ ID NO: 886 - protein, 120 aa, Oryza sativa subsp. japonica
  misc_feature (1)..(120): Public GI ID no.115446281
  misc_feature (1)..(120): Bit score of 217.8 for HMM based on sequences of FIGURE 28.
  misc_feature (1)..(120): Functional Homolog Of Ceres SEEDLINE ID no. ME11735 at SEQ ID NO: 855
MVGPIVIASAGLGMLAGVAMANRTMGGGGDGRQLPAASRWDARPRCATCGGSGRVDCLCNRWSDGDSGCRTCAGSGRMPCRSCGGSGTGRPLPARLIARGHHHHHNPPPSSAPGRGGDYS

SEQ ID NO: 887 - protein, 101 aa, Oryza sativa subsp. japonica
  misc_feature (1)..(101): Public GI ID no.125582239
  misc_feature (1)..(101): Bit score of 139.0 for HMM based on sequences of FIGURE 28.
  misc_feature (1)..(101): Functional Homolog Of Ceres SEEDLINE ID no. ME11735 at SEQ ID NO: 855
MANRTMGGGGDGRQLPAASRWDARPRCATCGGSGRVDCLCNRWSDGDSGCRTCAGSGRMPCRSCGGSGTGRPLPARLIARGHHHHHNPPPSSAPGRGGDYS

SEQ ID NO: 888 - protein, 117 aa, Oryza sativa subsp. japonica
  misc_feature (1)..(117): Public GI ID no.38347221
  misc_feature (1)..(117): Bit score of 185.8 for HMM based on sequences of FIGURE 28.
  misc_feature (1)..(117): Functional Homolog Of Ceres SEEDLINE ID no. ME11735 at SEQ ID NO: 855
MVVVVAPIAVASAGLGMLAGVAMANRSNNSSSSSGRTSSPAALLRWGAPEPAPRCAACGGTGREECRLCARWSDARGDCSGCRACAGTRRAPCRSCGGSGTGRRAPVRVSSSAPPSR

SEQ ID NO: 889 - protein, 98 aa, Glycine latifolia
  misc_feature (1)..(98): Public GI ID no.37788355
  misc_feature (1)..(98): Bit score of 207.4 for HMM based on sequences of FIGURE 28.
  misc_feature (1)..(98): Functional Homolog Of Ceres SEEDLINE ID no. ME11735 at SEQ ID NO: 855
MGPMVLSQLATGLSVLAGAVLVKSVMDQKPMAGPFSRCPTCNGTGRVTCLCSRWSDGDVGCSTYAGSGRMACSSCGGSGTGRPLPAKIAIRPPNRPIN

SEQ ID NO: 890 - DNA, 1329 bp, Arabidopsis thaliana
  misc_feature (1)..(1329): Ceres SEEDLINE ID no.ME12910
  misc_feature (1)..(1329): Ceres ANNOT ID no.552727
  misc_feature (1)..(1329): Inplanta Sequence
  misc_feature (1)..(1329): Encodes the peptide sequence at SEQ ID NO. 891
atggagccaacgttccatgcttttatgtttccctggtttgcttttggtcatatgattccttttctacatcttgcaaacaaactagctgagaaaggtcatcaaatcactttcttgctacctaagaaagcccaaaaacagttggaacatcacaatctgttcccagacagtattgtctttcaccctctcacaatccctcatgtcaatggcctccctgctggtgctgagacaacctcggatatctcaatctcgatggacaacttactgtcggaagccttggatctcactcgcgatcaggttgaagctgcggttcgtgctctgagaccggacttgatcttttttgattttgctcattggattccagaaattgccaaagagcatatgatcaagagtgtgagttacatgatagtatctgcaacaacaatagcttatacatttgcccctggtggtgtattaggtgttcccccaccaggttatccttcatcaaaggtgttgtaccgtgaaaacgatgctcatgccttagcaaccttatctatcttctacaagagactttatcatcagatcactacaggttttaagagctgtgacatcattgcattgaggacatgtaatgaaatcgaaggtaaattctgcgactatatatcaagtcaataccataagaaggttctcttgactggtccaatgctccctgagcaagacacaagtaaaccactagaagaacagttgagtcattttctgagcaggttcccaccgaggtcagtggtgttttgtgcacttggtagccagatcgttcttgaaaaggatcaattccaagaactctgcttagggatggagctgacaggtttaccgtttcttatagcggtaaagccaccgagaggatcatcgacggtcgaagaagggttaccagaagggttccaggagcgggtgaaagggcgtggtgtggtttggggaggatgggtgcaacaaccattgatattggatcatccgtcaataggctgctttgtgaaccattgtggtccgggaacaatatgggagtgtcttatgactgattgtcaaatggttttgcttccatttttaggtgatcaagttctcttcacaagattgatgaccgaggaattcaaggtgtctgtagaagtgtcgagagaaaaaacaggatggttttcaaaggagagcttgagcgatgcgatcaagtctgtgatggataaagatagcgacctcggaaagctagtgaggagtaaccacgccaaattgaaggagactcttggtagtcatggattattaactggttacgtggataaatttgtagaggaattgcaagagtatttgatttga

SEQ ID NO: 891 - protein, 442 aa, Arabidopsis thaliana
  misc_feature (1)..(442): Ceres SEEDLINE ID no.ME12910
  misc_feature (1)..(442): Ceres ANNOT ID no.552727
  misc_feature (1)..(442): Bit score of 1064.1 for HMM based on sequences of FIGURE 29.
  misc_feature (7)..(441): Pfam Name: UDPGT Pfam Description: UDP-glucoronosyl and UDP-glucosyl transferase
MEPTFHAFMFPWFAFGHMIPFLHLANKLAEKGHQITFLLPKKAQKQLEHHNLFPDSIVFHPLTIPHVNGLPAGAETTSDISISMDNLLSEALDLTRDQVEAAVRALRPDLIFFDFAHWIPEIAKEHMIKSVSYMIVSATTIAYTFAPGGVLGVPPPGYPSSKVLYRENDAHALATLSIFYKRLYHQITTGFKSCDIIALRTCNEIEGKFCDYISSQYHKKVLLTGPMLPEQDTSKPLEEQLSHFLSRFPPRSVVFCALGSQIVLEKDQFQELCLGMELTGLPFLIAVKPPRGSSTVEEGLPEGFQERVKGRGVVWGGWVQQPLILDHPSIGCFVNHCGPGTIWECLMTDCQMVLLPFLGDQVLFTRLMTEEFKVSVEVSREKTGWFSKESLSDAIKSVMDKDSDLGKLVRSNHAKLKETLGSHGLLTGYVDKFVEELQEYLI

SEQ ID NO: 892 - DNA, 1392 bp, Populus balsamifera subsp. trichocarpa
  misc_feature (1)..(1392): Ceres ANNOT ID no.1466353
  misc_feature (1)..(1392): Encodes the peptide sequence at SEQ ID NO 893
atgagcgatctcatctccaagaggtcaagttttcgcattttaatgttcccctggtttgctgttggtcacttgactccattcctccacctatcaaacaagcttgcagagaagggttgtaccatatctttcttgctacccaataaagccattaaactattacaacatttcaatttataccctgatcacatcactttccaccctgtgaaggttcctcatgttgaaggtctccctcttggcaccgagactgcctccgatattcctattcacttgactcattttctttgcgttgccatggaccgaacaagagaccaagttgagaaaattatacgggaccaaaaacctgattttgtcatgtatgatatggcatattggataccagaagtggccaggccccttgggatcaagacaataaaatattctgttgtttcagctgctgcaatagcaatagttctcgtcccagcacgtaatgttgtcgaaggtaaggccataactgcggctgaattatcagtgccacctaccggctatccatcaacttctgtggtgctccgaggccacgaagtgcgttcattgctctttgtatcacaaccctacggcgaggggacaacgttttatgagagagcctgtacaggaatgaaaggatgtgatgcaattgctataagatcatgctatgagatggaagaaaagttgtgtgattatataggtaggcagtatgggaaaccagtttttttaacaggtccagttttgccagaatcagccaggactcctttagaagaccgttgggctcaatggctaaaccggtttgaagctggctcagtggtattttgctcatttggaagccaactcatccttgaaaaggagcagctccaagaattggttctagggttcgagtcaacaggtttgccgtttttagtggttttaaagccaccagtgggttcatcaactatcgaagaagcattgccggaggggtttgaagagagggttaaagggagaggagtggtttggggtggatgggtgcaacaattggagattttagatcatccatcaatagggtgttttgtgaacacttgtgggtttggatcaatgtgggagtctttaatgagtgattgtcaaatagtattggtgccacatttgggtgaccaaatcttgaacacaaggttaatggctgaggagttgaaggtggctgtagaggtggaaagagatgagaaagggtggtttacaaaggagaaccttagcaatgctatcaagtgtgttatggataaagatagtgaagtgggttccatgataaagaagaatcacaccgagtggaggaagcttttgagaagcgaagggttcatgagtagttattttgacaagtttttccaaaacatgcaagaacttgttgatcataagtga

SEQ ID NO: 893 - protein, 463 aa, Populus balsamifera subsp. trichocarpa
  misc_feature (1)..(463): Ceres ANNOT ID no.1466353
  misc_feature (1)..(463): Bit score of 1153.3 for HMM based on sequences of FIGURE 29.
  misc_feature (712)..(446): Pfam Name: UDPGT Pfam Description: UDP-glucoronosyl and UDP-glucosyl transferase
  misc_feature (1)..(463): Functional Homolog Of Ceres SEEDLINE ID no. ME12910 at SEQ ID NO: 891
MSDLISKRSSFRILMFPWFAVGHLTPFLHLSNKLAEKGCTISFLLPNKAIKLLQHFNLYPDHITFHPVKVPHVEGLPLGTETASDIPIHLTHFLCVAMDRTRDQVEKIIRDQKPDFVMYDMAYWIPEVARPLGIKTIKYSVVSAAAIAIVLVPARNVVEGKAITAAELSVPPTGYPSTSVVLRGHEVRSLLFVSQPYGEGTTFYERACTGMKGCDAIAIRSCYEMEEKLCDYIGRQYGKPVFLTGPVLPESARTPLEDRWAQWLNRFEAGSVVFCSFGSQLILEKEQLQELVLGFESTGLPFLVVLKPPVGSSTIEEALPEGFEERVKGRGVVWGGWVQQLEILDHPSIGCFVNTCGFGSMWESLMSDCQIVLVPHLGDQILNTRLMAEELKVAVEVERDEKGWFTKENLSNAIKCVMDKDSEVGSMIKKNHTEWRKLLRSEGFMSSYFDKFFQNMQELVDHK

SEQ ID NO: 894 - protein, 442 aa, Arabidopsis thaliana
  misc_feature (1)..(442): Public GI ID no.42572855
  misc_feature (1)..(442): Bit score of 956.4 for HMM based on sequences of FIGURE 29.
  misc_feature (7)..(441): Pfam Name: UDPGT Pfam Description: UDP-glucoronosyl and UDP-glucosyl transferase
  misc_feature (1)..(442): Functional Homolog Of Ceres SEEDLINE ID no. ME12910 at SEQ ID NO: 891
MEPKFHAFMFPWFAFGHMIPFLHLANKLAEKGHRVTFLLPKKAQKQLEHHNLFPDSIVFHPLTVPPVNGLPAGAETTSDIPISLDNLLSKALDLTRDQVEAAVRALRPDLIFFDFAQWIPDMAKEHMIKSVSYIIVSATTIAHTHVPGGKLGVRPPGYPSSKVMFRENDVHALATLSIFYKRLYHQITTGLKSCDVIALRTCKEVEGMFCDFISRQYHKKVLLTGPMFPEPDTSKPLEERWNHFLSGFAPKSVVFCSPGSQVILEKDQFQELCLGMELTGLPFLLAVKPPRGSSTVQEGLPEGFEERVKDRGVVWGGWVQQPLILAHPSIGCFVNHCGPGTIWESLVSDCQMVLIPFLSDQVLFTRLMTEEFEVSVEVPREKTGWFSKESLSNAIKSVMDKDSDIGKLVRSNHTKLKEILVSPGLLTGYVDHFVEGLQENLI

SEQ ID NO: 895 - protein, 417 aa, Arabidopsis thaliana
  misc_feature (1)..(417): Public GI ID no.42566366
  misc_feature (1)..(417): Bit score of 855.8 for HMM based on sequences of FIGURE 29.
  misc_feature (7)..(416): Pfam Name: UDPGT Pfam Description: UDP-glucoronosyl and UDP-glucosyl transferase
  misc_feature (1)..(417): Functional Homolog Of Ceres SEEDLINE ID no. ME12910 at SEQ ID NO: 891
MEPKFHAFMFPWFAFGHMIPFLHLANKLAEKGHRVTFLLPKKAQKQLEHHNLFPDSIVFHPLTVPPVNGLPAGAETTSDIPISLDNLLSKALDLTRDQVEAAVRALRPDLIFFDFAQWIPDMAKEHMIKSVSYIIVSATTIAHTHVPGGKLGVRPPGYPSSKVMFRENDVHALATLSIFYKRLYHQITTGLKSCDVIALRTCKEVEDTSKPLEERWNHFLSGFAPKSVVFCSPGSQVILEKDQFQELCLGMELTGLPFLLAVKPPRGSSTVQEGLPEGFEERVKDRGVVWGGWVQQPLILAHPSIGCFVNHCGPGTIWESLVSDCQMVLIPFLSDQVLFTRLMTEEFEVSVEVPREKTGWFSKESLSNAIKSVMDKDSDIGKLVRSNHTKLKEILVSPGLLTGYVDHFVEGLQENLI

SEQ ID NO: 896 - protein, 417 aa, Arabidopsis thaliana
  misc_feature (1)..(417): Public GI ID no.28393204
  misc_feature (1)..(417): Bit score of 851.9 for HMM based on sequences of FIGURE 29.
  misc_feature (7)..(416): Pfam Name: UDPGT Pfam Description: UDP-glucoronosyl and UDP-glucosyl transferase
  misc_feature (1)..(417): Functional Homolog Of Ceres SEEDLINE ID no. ME12910 at SEQ ID NO: 891
MEPKFHAFMFPWFAFGHMIPFLHLANKLAEKGHRVTFLLPKKAQKQLEHHNLFPDSIVFHPLTVPPVNGLPAGAETTSDIPISLDNLLSKALDLTRDQVEAAVRALRPDLIFFDFAQWIPDMAKEHMIKSVSYIIVSATTIAHTHVPGGKLGVRPPGYPSSKVMFRENDVHALATLSIFYKRLYHQITTGLKSCDVIALRTCKEVEDTSKPLEERWNHFLSGFAPKSVVFCSPGSQVILEKDQFQELCLGMELTGLPFLLAVKPPRGSSTVQEGLPEGFEERVKDRGVVWGGWVQQPLILAHPSIGCFVNHCGPGTIWESLVSDCQMVLIPFLSDQVLFTRLMTEEFEVSVEVPRKKTGWFSKESLSNAIKSVMDKDSDIGKLVRSNHTKLKEILVSPGLLTGYVDHFVEGLQENLI

SEQ ID NO: 897 - DNA, 1490 bp, Glycine max
  misc_feature (1)..(1490): Ceres CLONE ID no.519143
  misc_feature (1)..(1490): Encodes the peptide sequence at SEQ ID NO 898
gaatgcctagtgaattagctatgaacaatgatgagctacatgtggttatgttcccattccttgcatttggccacattagtccatttgttcagctctccaacaagttgttctctcatggtgttcatgtcactttcttgtcagctgcatccaacattcccagaatcagatcaactcttaatctcaatccagccatcaatgttatctcactaaagttcccaaatggtataaccaacactgctgaattgccacctcacttagctggaaatctcatacacgcccttgacctcactcaagatcaggtgaagtcccttttgttggaactcaaaccccactatgttttctttgactttgcacaacattggctcccaaaattagcttctgaagttggcatcaagtctgttcatttctcagtctactctgccatttctgatgcttacattaccgtgccttctagatttgctgatgttgaaggaagaaacatcacttttgaggatcttaaaaagcctccacctgggtatcctcaaaactctaatatttccctcaaggcctttgaggccatggactttatgttcctcttcacaagatttggtgaaaaaaaccttactggttatgagcgagttttgcaaagccttggtgagtgttcattcatagtgttcaaaacgtgcaaggaaatagaaggaccctacttagactacatagaaacgcaatttcgaaaaccagttttgctatctggtccactagtccccgagccatcaaccgatgtgcttgaggaaaagtggtccaaatggttagatggtttccctgccaaatctgtcatattatgctcctttggcagtgagacatttctgagtgattatcaaatcaaagaactagccagtgggttagaactcactggcttacctttcattttggttctgaatttcccatccaatctctctgccaaagctgagttggagagagcattgccaaaagggtatttggaaagagtgaagaataggggagtggtgcacagtggttggtttcagcagcagcttgtgctgaaacactcaagtgtggggtgctatgtatgccatggtggctttagttcagtgattgaagctatggtcaatgagtgtcaactggtgctgttgcctttcaagggtgaccagtttttcaactctaaactcattgccaatgatttaaaggcaggggtagaggtgaataggagtgatgaagatgggttctttcacaaagaggatatactggaggcattgaaaactgtcatgttggaggataacaaagagcaagggaagcaaataagagaaaaccacatgcaatggagcaagtttttatcaaataaggaaattcagaacaaattcatcacagatctggttgcccagttaaagtctatggcttagtcttgtctcttccaatggaaaataaagtctaccaagactagaaagtataaactataattcaaaatgatcatattatcatatatcaattgagat

SEQ ID NO: 898 - protein, 464 aa, Glycine max
  misc_feature (1)..(464): Ceres CLONE ID no.519143
  misc_feature (1)..(464): Bit score of 1176.2 for HMM based on sequences of FIGURE 29.
  misc_feature (339)..(421): Pfam Name: UDPGT Pfam Description: UDP-glucoronosyl and UDP-glucosyl transferase
  misc_feature (1)..(464): Functional Homolog Of Ceres SEEDLINE ID no. ME12910 at SEQ ID NO: 891
MPSELAMNNDELHVVMFPFLAFGHISPFVQLSNKLFSHGVHVTFLSAASNIPRIRSTLNLNPAINVISLKFPNGITNTAELPPHLAGNLIHALDLTQDQVKSLLLELKPHYVFFDFAQHWLPKLASEVGIKSVHFSVYSAISDAYITVPSRFADVEGRNITFEDLKKPPPGYPQNSNISLKAFEAMDFMFLFTRFGEKNLTGYERVLQSLGECSFIVFKTCKEIEGPYLDYIETQFRKPVLLSGPLVPEPSTDVLEEKWSKWLDGFPAKSVILCSFGSETFLSDYQIKELASGLELTGLPFILVLNFPSNLSAKAELERALPKGYLERVKNRGVVHSGWFQQQLVLKHSSVGCYVCHGGFSSVIEAMVNECQLVLLPFKGDQFFNSKLIANDLKAGVEVNRSDEDGFFHKEDILEALKTVMLEDNKEQGKQIRENHMQWSKFLSNKEIQNKFITDLVAQLKSMA

SEQ ID NO: 899 - DNA, 1606 bp, Glycine max
  misc_feature (1)..(1606): Ceres CLONE ID no.523757
  misc_feature (1)..(1606): Encodes the peptide sequence at SEQ ID NO 900
gaagccaacatccataaggaacttgcagaaacataaacaaaaaagatgtcttgtgaagttgtgaacaatgatgagcttcatgtggttatgttcccattccttgcatttggtcacattaacgcatttgttcaactctccaacaagttgttctctcatggagttcgtatcactttcttgtcagctgcatccaacattcccagaatcaaatcaactcttaatctcaatccagccatcaatgttatcccactatacttcccaaatggcataaccagcactgctgaattgccaccaaacttggctgcaaatctcatacatgcacttgaccttactcaacctcatgtaaagtcccttttgttggaactcaaaccccattatgttttctttgactttgcacaaaactggctcccaaaactagcttctgaacttggcatcaaatctgttcgctttgcgtccttctctgccatatctgattcttacattactgtgccttcaaggcttgctgatattgaaggaagaaacatcacttttgaggatcttaaaaagcctccaccagggtatcctcaaaactccaacatttccctcaaggcctttgaggccatggacttgatgttcctcttcaaaagatttggtgaaaaaaactttactggttatgagcgagttttgcaaggctttagtgactgctcattaatagtgtttagatcgtgcaaggaaatagaagaatcctacttagactacattgaaaagcaatttgggaaactggttttgttaactggtttccttgtcccagagccatcaatggatgtgctagaggaaaagtggtccaaatggttagacagtttccctgccaaatctgtcatactatgctcctttggcagtgagcaatttctgaatgatgatcaaatcaaagaagtggccagtggcttagaactcagtggcttacctttcattttggttctgaatttcccatccaatctctctgccaaagctgagttagagagagcattaccaaaagggtttttggaaagagtgaagaataggggagtggtgcacactggttggtttcagcagcagcttgtactgaaacactctagcgtgggatgccatttaggccatggtggcttcaattctgtgattgaagctctggccagtgattgtgaactggtgctgttgcctttcaaggctgaccagtttttcaatgctaagctcatagccaaggctttggaggcagggatagaggtgaataggagtgaagatggggactttaagaaagaggatatactgaaggcagtaaaaactatcatggtggaggatgataaagagccagggaagcaaataaaagaaaaccacatgaaatggaaggagtttttattgaataaaggaattcagaacaaattcatcactgatctggttgcccagttgaagtctatggcttagtgttcaggattcggatttcttggactataagctatcatttaaaatttgaactgttcgatcgtgtattagttgttttgtgtgtgaatgtgtgtgactagtttggtcagtgctcattttcttggtctattctcttccaatattaatgtaaaataaagtctactaagactaatcc

SEQ ID NO: 900 - protein, 462 aa, Glycine max
  misc_feature (1)..(462): Ceres CLONE ID no.523757
  misc_feature (1)..(462): Bit score of 997.7 for HMM based on sequences of FIGURE 29.
  misc_feature (338)..(419): Pfam Name: UDPGT Pfam Description: UDP-glucoronosyl and UDP-glucosyl transferase
  misc_feature (1)..(462): Functional Homolog Of Ceres SEEDLINE ID no. ME12910 at SEQ ID NO: 891
MSCEVVNNDELHVVMFPFLAFGHINAFVQLSNKLFSHGVRITFLSAASNIPRIKSTLNLNPAINVIPLYFPNGITSTAELPPNLAANLIHALDLTQPHVKSLLLELKPHYVFFDFAQNWLPKLASELGIKSVRFASFSAISDSYITVPSRLADIEGRNITFEDLKKPPPGYPQNSNISLKAFEAMDLMFLFKRFGEKNFTGYERVLQGFSDCSLIVFRSCKEIEESYLDYIEKQFGKLVLLTGFLVPEPSMDVLEEKWSKWLDSFPAKSVILCSFGSEQFLNDDQIKEVASGLELSGLPFILVLNFPSNLSAKAELERALPKGFLERVKNRGVVHTGWFQQQLVLKHSSVGCHLGHGGFNSVIEALASDCELVLLPFKADQFFNAKLIAKALEAGIEVNRSEDGDFKKEDILKAVKTIMVEDDKEPGKQIKENHMKWKEFLLNKGIQNKFITDLVAQLKSMA

SEQ ID NO: 901 - protein, 473 aa, Petunia x hybrida
  misc_feature (1)..(473): Public GI ID no.2501497
  misc_feature (1)..(473): Bit score of 1257.1 for HMM based on sequences of FIGURE 29.
  misc_feature (343)..(427): Pfam Name: UDPGT Pfam Description: UDP-glucoronosyl and UDP-glucosyl transferase
  misc_feature (1)..(473): Functional Homolog Of Ceres SEEDLINE ID no. ME12910 at SEQ ID NO: 891
MENEMKHSNDALHVVMFPFFAFGHISPFVQLANKLSSYGVKVSFFTASGNASRVKSMLNSAPTTHIVPLTLPHVEGLPPGAESTAELTPASAELLKVALDLMQPQIKTLLSHLKPHFVLFDFAQEWLPKMANGLGIKTVYYSVVVALSTAFLTCPARVLEPKKYPSLEDMKKPPLGFPQTSVTSVRTFEARDFLYVFKSFHNGPTLYDRIQSGLRGCSAILAKTCSQMEGPYIKYVEAQFNKPVFLIGPVVPDPPSGKLEEKWATWLNKFEGGTVIYCSFGSETFLTDDQVKELALGLEQTGLPFFLVLNFPANVDVSAELNRALPEGFLERVKDKGIIHSGWVQQQNILAHSSVGCYVCHAGFSSVIEALVNDCQVVMLPQKGDQILNAKLVSGDMEAGVEINRRDEDGYFGKEDIKEAVEKVMVDVEKDPGKLIRENQKKWKEFLLNKDIQSKYIGNLVNEMTAMAKVSTT

SEQ ID NO: 902 - protein, 471 aa, Petunia x hybrida
  misc_feature (1)..(471): Public GI ID no.397567
  misc_feature (1)..(471): Bit score of 1248.1 for HMM based on sequences of FIGURE 29.
  misc_feature (341)..(425): Pfam Name: UDPGT Pfam Description: UDP-glucoronosyl and UDP-glucosyl transferase
  misc_feature (1)..(471): Functional Homolog Of Ceres SEEDLINE ID no. ME12910 at SEQ ID NO: 891
NEMKHSNDALHVVMFPFFAFGHISPFVQLANKLSSYGVKVSFFTASGNASRVKSMLNSAPTTHIVPLTLPHVEGLPPGAESTAELTPASAELLKVALDLMQPQIKTLLSHLKPHFVLFDFAQEWLPKMANGLGIKTVYYSVVVALSTAFLTCPARVLEPKKYPSLEDMKKPPLGFPQTSVTSVRTFEARDFLYVFKSFHNGPTLYDRIQSGLRGCSAILAKTCSQMEGPYIKYVEAQFNKPVFLIGPVVPDPPSGKLEEKWATWLNKFEGGTVIYCSFGSETFLTDDQVKELALGLEQTGLPFFLVLNFPANVDVSAELNRALPEGFLERVKDKGIIHSGWVQQQHILAHSSVGCYVCHAGFSSVIEALVNDCQVVMLPQKGDQILNAKLVSGDMEAGVEINRRDEDGYFGKEDIKEAVEKVMVDVEKEPGKLIRENQKKWKEFLLNKDIQSKYIGNLVNEMTAMAKVSTT

SEQ ID NO: 903 - protein, 473 aa, Petunia x hybrida
  misc_feature (1)..(473): Public GI ID no.454245
  misc_feature (1)..(473): Bit score of 1206.0 for HMM based on sequences of FIGURE 29.
  misc_feature (343)..(427): Pfam Name: UDPGT Pfam Description: UDP-glucoronosyl and UDP-glucosyl transferase
  misc_feature (1)..(473): Functional Homolog Of Ceres SEEDLINE ID no. ME12910 at SEQ ID NO: 891
MENEMKHSNDALHVVMFPFFAFGHISPFVQLANKLSSYGVKVSFFTASGNASRVKSMLNSAPTTHIVPLTLPHVEGLPPGAESTAELTPASAELLKVALDLMQPQIKTLLSHLKPHFVLFDFAQEWLPKMANGLGIKTVYYSVVVALSTAFLTCPARVLEPKKYPSLEDMKKPPLGFPQTSVTSVRTFEARDFLYVFKSFHNGPTLYDRIQSGLRGCSAILAKTCSQMEGPYIKYVEAQFNKPVFSNRTRSSGPASGKLEEKWATWLNKFEGGTVIYCSFGSETFLTDDQVKELALGLEQTGLPFFLVLNFPANVDVSAELNRALPEGFLERVKDKGIIHSGWVQQQNILAHSSVGCYVCHAGFSSVIEALVNDCQVVMLPQKGDQILNAKLVSGDMEAGVEINRRDEDGYFGKEDIKEAVEKVMVDVEKDPGKLIRENQKKWKEFLLNKDIQSKYIGNLVNEMTAMAKVSTT

SEQ ID NO: 904 - protein, 459 aa, Ipomoea batatas
  misc_feature (1)..(459): Public GI ID no.119394507
  misc_feature (1)..(459): Bit score of 1132.3 for HMM based on sequences of FIGURE 29.
  misc_feature (334)..(420): Pfam Name: UDPGT Pfam Description: UDP-glucoronosyl and UDP-glucosyl transferase
  misc_feature (1)..(459): Functional Homolog Of Ceres SEEDLINE ID no. ME12910 at SEQ ID NO: 891
MGSQATTHHMAMYPWFGVGHLTAFFRLANKLASKGHRISFLIPKNTQSKLASFNLHPHLVSFVPITVPSIPGLPPGAETTSDVPFSSTHLLMEAMDKTQTDIEIILKNLEVDVVFFDFTHWLPGLARKIGIKSVFYSTISPLMHGFALSPERRVAGKQLTEADMMKAPASFPDPSIKLHAHEARGFTARTVMKFGGDITFFDRIFTAVSESDGLAYSTCREIEGQFCDYIETQFKKPVLLAGPALPVPSKSTMEQKWSDWLGKFKEGSVIYCAFGSECTLRKEQFQELLWGLELTGMPFFAALKAPFGTDSIEAAIPEELREKIHGKGIVHGGWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLLNADLDSKYMDSFNQKLQDLLG

SEQ ID NO: 905 - protein, 459 aa, Ipomoea purpurea
  misc_feature (1)..(459): Public GI ID no.62857206
  misc_feature (1)..(459): Bit score of 1133.6 for HMM based on sequences of FIGURE 29.
  misc_feature (333)..(420): Pfam Name: UDPGT Pfam Description: UDP-glucoronosyl and UDP-glucosyl transferase
  misc_feature (1)..(459): Functional Homolog Of Ceres SEEDLINE ID no. ME12910 at SEQ ID NO: 891
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 906 - DNA, 1529 bp, Triticum aestivum
  misc_feature (1)..(1529): Ceres CLONE ID no.766529
  misc_feature (1)..(1529): Encodes the peptide sequence at SEQ ID NO 907
aagcaaaccacatcgatcgatccagcgctagacagagggagaggatggcagtcgacagcatgcacgtcgtgatgttccccttcctcgccttcggccacatcagcccgttcgtgcagctggcgcgcaagctcgtcgccgccggcggggtgcgtgtcacgctgctgtcggccgcggccaacgtgccccgcgtcgaggccatgctggggccggcggccggcgcggtggcggtggccccgctgcgcctccagcgcgtgccggggctccccgagggcgccgagagcacggccgaggtctcggcggacggcgccgagctgctcaaggtcgccgtcgacggcaccaggccgcaggtggcggccctgctcgcggagctccgtcctgacgccctgctgttcgacttcgccaccccgtgggtcaccgagctcgcggcgccgctccgcatcaaggcgctccagttctcggtcttctccgccgtgtccggcgcctacctgatgaaccccgcccgccgcctcggcgccggcggccagctgccaaccgcggacgacctcacgtcgccgcccgcaggcttcccaccgtcgtcgagcatcaccaccgtgccggcctaccaggccgccgacttcagctacgtgttcaccagcttccacggcgagccgtgcgtgtacgaccgcgtcctcgccggcgtccaggccagtgacgccctcgtcatcaagacgtgcttcgagatggaaggcccctacatcaactacctcaccgcccagcacggcaagccggtgctcgtcacgggcccggtcgtgccggagccgccgcagggcgagctggaggagcggtgggccaggtggctctcctccttcccggacaacgccgtcgtgttcgcctccttcgggagcgagacgttcctcccggccgccgccgcgacggagctcctcctcggcctggaatccaccaaccggccgttcttcgtcgtgctcaacttccccaagggcacggacaccgaggcggagctggccaagtgcacgccgccggggttcgccgagaggaccaagggcaggggcgtggtgcacacggggtgggtgcagcagcagcacatcctgcggcaccgcggcgtggggtgcttcgtgaaccacgccgggctgagctccgtggtggaggggctcgtggccggctgccggctggtgctgctgccgatgaagggcgaccagtacctcaacgcggcgctgttcgcgcgtgacctccgcgtcggggcggaggtggcgcggcgcgacagcgacgggtggttcgggcgcggggacgtgagcgacgccgtggacacggcgatggcggacgggtgggagggccaagggattaaatggagggacttcttgatggatgacgccgtgcagaagaggttggcggacgatttcgtcagggattttaagaagttcgtgagggcctgaaaagatgatgtactatgcttttgcttgctacttggtctcgtgtccatgtccatggaggcaaataaatgttatttttaaataaaaatttattttactatc

SEQ ID NO: 907 - protein, 461 aa, Triticum aestivum
  misc_feature (1)..(461): Ceres CLONE ID no.766529
  misc_feature (1)..(461): Bit score of 1138.4 for HMM based on sequences of FIGURE 29.
  misc_feature (341)..(389): Pfam Name: UDPGT Pfam Description: UDP-glucoronosyl and UDP-glucosyl transferase
  misc_feature (1)..(461): Functional Homolog Of Ceres SEEDLINE ID no. ME12910 at SEQ ID NO: 891
MAVDSMHVVMFPFLAFGHISPFVQLARKLVAAGGVRVTLLSAAANVPRVEAMLGPAAGAVAVAPLRLQRVPGLPEGAESTAEVSADGAELLKVAVDGTRPQVAALLAELRPDALLFDFATPWVTELAAPLRIKALQFSVFSAVSGAYLMNPARRLGAGGQLPTADDLTSPPAGFPPSSSITTVPAYQAADFSYVFTSFHGEPCVYDRVLAGVQASDALVIKTCFEMEGPYINYLTAQHGKPVLVTGPVVPEPPQGELEERWARWLSSFPDNAVVFASFGSETFLPAAAATELLLGLESTNRPFFVVLNFPKGTDTEAELAKCTPPGFAERTKGRGVVHTGWVQQQHILRHRGVGCFVNHAGLSSVVEGLVAGCRLVLLPMKGDQYLNAALFARDLRVGAEVARRDSDGWFGRGDVSDAVDTAMADGWEGQGIKWRDFLMDDAVQKRLADDFVRDFKKFVRA

SEQ ID NO: 908 - protein, 459 aa, Ipomoea nil
  misc_feature (1)..(459): Public GI ID no.62857204
  misc_feature (1)..(459): Bit score of 1130.3 for HMM based on sequences of FIGURE 29.
  misc_feature (333)..(420): Pfam Name: UDPGT Pfam Description: UDP-glucoronosyl and UDP-glucosyl transferase
  misc_feature (1)..(459): Functional Homolog Of Ceres SEEDLINE ID no. ME12910 at SEQ ID NO: 891
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFEAESIEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLLNADLDSKYMDSFNQKLQDLLG

SEQ ID NO: 909 - protein, 464 aa, Ipomoea nil
  misc_feature (1)..(464): Public GI ID no.62857210
  misc_feature (1)..(464): Bit score of 1078.5 for HMM based on sequences of FIGURE 29.
  misc_feature (333)..(420): Pfam Name: UDPGT Pfam Description: UDP-glucoronosyl and UDP-glucosyl transferase
  misc_feature (1)..(464): Functional Homolog Of Ceres SEEDLINE ID no. ME12910 at SEQ ID NO: 891
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFEAESIEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLLNADLDGFKVHGLFQSETAGSPWMNII

SEQ ID NO: 910 - protein, 464 aa, Ipomoea nil
  misc_feature (1)..(464): Public GI ID no.62857212
  misc_feature (1)..(464): Bit score of 1082.2 for HMM based on sequences of FIGURE 29.
  misc_feature (333)..(420): Pfam Name: UDPGT Pfam Description: UDP-glucoronosyl and UDP-glucosyl transferase
  misc_feature (1)..(464): Functional Homolog Of Ceres SEEDLINE ID no. ME12910 at SEQ ID NO: 891
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFEAESIEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLLNADLDRFKVHGLFQSETAGSPWMNII

SEQ ID NO: 911 - protein, 479 aa, Oryza sativa subsp. indica
  misc_feature (1)..(479): Public GI ID no.125534279
  misc_feature (1)..(479): Bit score of 1159.1 for HMM based on sequences of FIGURE 29.
  misc_feature (358)..(406): Pfam Name: UDPGT Pfam Description: UDP-glucoronosyl and UDP-glucosyl transferase
  misc_feature (1)..(479): Functional Homolog Of Ceres SEEDLINE ID no. ME12910 at SEQ ID NO: 891
MGSAGAAPVATAAGGGGGDGDLHVVMFPFLAFGHISPFAQLARKMAGVGAGVRVTFLSAAANVPRVEAMLGGTGGTSTVAALELPRVPGLPEGAESTAEVSADGAELLKLAVDGTRPQVEALLARLHPDVVLFDFATPWVVDVARPLGVKAALFSVFAAVSGAYVMAPARRRLPGPWRPTVDDLASAPEGFPPSSPLATVPAYQAADFSYVFESFHGMPCVYDRVAACHNACDALVIKTCAEMEGPYIDYIAAEHGKPVLVTGPIVPEPPRGELEERWATWLSSFPDNSVVFASFGSETFLLHAAATELLLGLEATALPFLAVLNFPKGTDAEAELRKLTPPGLEERVKGRGILHTGWVQQQHILRHRSVGCFVNHSGLSSVVEGLIAGCRLVLLPMKGDQYLNAALFARELRVGTEVARRARDGWFGREDVRDALAAAFAGGEDGGGEEKKWREFLMDDAVQRRFVREFVAGLRRLKG

SEQ ID NO: 912 - protein, 470 aa, Oryza sativa subsp. japonica
  misc_feature (1)..(470): Public GI ID no.115485437
  misc_feature (1)..(470): Bit score of 1130.9 for HMM based on sequences of FIGURE 29.
  misc_feature (349)..(397): Pfam Name: UDPGT Pfam Description: UDP-glucoronosyl and UDP-glucosyl transferase
  misc_feature (1)..(470): Functional Homolog Of Ceres SEEDLINE ID no. ME12910 at SEQ ID NO: 891
MAAAVVEADDEAMHVALFPFLAFGHISPFAQLARSLGAVGGVRVTFLSAAANVARVEAMLPADGTAVVAALHLPRVPGLPVGAESTAEVDADGAELLKLALDGTRPQVEALLARLRPDVVLFDFATPWVADVARQLGARAAHFSVFTAVTSAYLTVPARRRLHHGAASCPTVDDLATAPVGFPPSSSLATVPTYQAADFTYVFTSFHGMPSAYDRVAACDKASDVLVFKTCAEMEGPYIEYVATQYDKPILVTGPLVPEPPHGELEERWETWLSSFPDNAVVFASFGSETFLPTAAATELLLGLEATGQPFVAVLNFPRSVDAEAEVKKCMAPGFEERVKGRGVVHSGWVQQQHILRHRSVGCYVNHAGFSSVVEGLVAGCRLVLLPMKSDQFFNAALLARELRVGTEVARRDGDGWFGHDAVRDAVNAAVADAGGGDDDERKWREFLTDDAVQRRFVEEFVRELRKLVL

SEQ ID NO: 913 - protein, 454 aa, Stevia rebaudiana
  misc_feature (1)..(454): Public GI ID no.23955910
  misc_feature (1)..(454): Bit score of 1137.3 for HMM based on sequences of FIGURE 29.
  misc_feature (11)..(452): Pfam Name: UDPGT Pfam Description: UDP-glucoronosyl and UDP-glucosyl transferase
  misc_feature (1)..(454): Functional Homolog Of Ceres SEEDLINE ID no. ME12910 at SEQ ID NO: 891
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSDGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 914 - protein, 454 aa, Stevia rebaudiana
  misc_feature (1)..(454): Public GI ID no.37993675
  misc_feature (1)..(454): Bit score of 1133.1 for HMM based on sequences of FIGURE 29.
  misc_feature (11)..(452): Pfam Name: UDPGT Pfam Description: UDP-glucoronosyl and UDP-glucosyl transferase
  misc_feature (1)..(454): Functional Homolog Of Ceres SEEDLINE ID no. ME12910 at SEQ ID NO: 891
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSYGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 915 - protein, 465 aa, Nierembergia sp. NB17
  misc_feature (1)..(465): Public GI ID no.22759895
  misc_feature (1)..(465): Bit score of 1222.6 for HMM based on sequences of FIGURE 29.
  misc_feature (341)..(431): Pfam Name: UDPGT Pfam Description: UDP-glucoronosyl and UDP-glucosyl transferase
  misc_feature (1)..(465): Functional Homolog Of Ceres SEEDLINE ID no. ME12910 at SEQ ID NO: 891
MENEKVLHVVMFPFFAFGHISPFAQLANKLSSHGVKVSFFTASGNASRLRSMLNSAPTTTHIDIVPLTLPHVEGLPPGSESTAELTPVTAELLKVALDLMQPQIKTLLSHLKPHFVLFDFAQEWLPKMADELGIKTVFYSVFVALSTAFLTCPARVTEPKKYPTLEDMKKPPLGFPHTSITSVKTFEAQDFLYIFKSFNNRPTVYDRVLSGLKGCSAILAKTCSQMEGPYIEYVKSQFKKPVLLVGPVVPDPPSGKLEEKWDAWLNKFEAGTVIYCSFGSETFLKDDQIKELALGLEQTGLPFFLVLNFPANVDASAELNRGLPEGFRERVKEKGVIHSGWVQQQHILAHTSVGCYVCHAGFSSVIEAFMNDCQVVMLPQKGDQLLNAKLVSGDMKAGVEVNRRDEDGYFSKDDIEEAVEKVMVEKVIRENQKKWKEFLLNKDTHSKFVEDLVHDMMAMAKLSTT

SEQ ID NO: 916 - DNA, 1058 bp, Zea mays
  misc_feature (1)..(1058): Ceres SEEDLINE ID no.ME12927
  misc_feature (1)..(1058): Ceres CLONE ID no.239806
  misc_feature (1)..(1058): Inplanta Sequence
  misc_feature (1)..(1058): Encodes the peptide sequence at SEQ ID NO. 917
ctctcctcccctcttctcactcagctcaccagtgctcgctcacctttcccctccctttcctttcctttgctttcctatccttgtgccctcgaactcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagggctggctgcgggaaggtcgtgtatgggaaccctgggaggctggggaggaagaggaggggaggggataaggtgaaggagcaagctggggacgaggcggccaagttcccgtggtccgggatgcgcctggctaccgagaaacggaggagggtgagacgctctccatcgaagaagggaatagtcctgaagcaaaaatcacggaaggtatccctgcagcaccgctcaaagaagttgaaagcttgatagtacttgacttgagctgctgtaccgaaccactggaggatcctgccatcgagcgtggatgcaggccgtggacccataagttcgctggcggacctgccttgtttttaaattaccaaataaacaccgaacgttgaaggacttgtaaggattttgtgcctttgatatgggatttagaaggctgcatcgggcatgtgtgctggaggaccagacctggaagggttcatgggcgttccctatcctatactgtcccttcgtttgatatgagaattgagatttgtttagtaattaactgactactagcattgctgattagagatcatgtactgttattttcc

SEQ ID NO: 917 - protein, 201 aa, Zea mays
  misc_feature (1)..(201): Ceres SEEDLINE ID no.ME12927
  misc_feature (1)..(201): Ceres CLONE ID no.239806
  misc_feature (1)..(201): Bit score of 337.5 for HMM based on sequences of FIGURE 30.
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLARAGCGKVVYGNPGRLGRKRRGGDKVKEQAGDEAAKFPWSGMRLATEKRRRVRRSPSKKGIVLKQKSRKVSLQHRSKKLKA

SEQ ID NO: 918 - DNA, 390 bp, Populus balsamifera subsp. trichocarpa
  misc_feature (1)..(390): Ceres ANNOT ID no.1503548
  misc_feature (1)..(390): Encodes the peptide sequence at SEQ ID NO 919
atgcactactataggagaagaagtgactccatctttgatgctttcactctaaatcccctaccatatccagttctcttaatcttggcagtactatcaatatttcttggcatgtcttggttctttagctatgaagacatggtggagactactgaggaacaaatgggttggattcttttggttgtaccgttagtgctgatagtcatagttcgatggctttcatctatggaaaatcctgacatgatctttgttatgtcaccatgggacaagcgccggaggacacaccaccggccatcagaagggagctctccttggggtgtggctgctttcattgtgttgcttcttgttttggtgaagtttcaatctacctttcttgatagctggcttgtttga

SEQ ID NO: 919 - protein, 129 aa, Populus balsamifera subsp. trichocarpa
  misc_feature (1)..(129): Ceres ANNOT ID no.1503548
  misc_feature (1)..(129): Bit score of 348.2 for HMM based on sequences of FIGURE 30.
  misc_feature (1)..(129): Functional Homolog Of Ceres SEEDLINE ID no. ME12927 at SEQ ID NO: 917
MHYYRRRSDSIFDAFTLNPLPYPVLLILAVLSIFLGMSWFFSYEDMVETTEEQMGWILLVVPLVLIVIVRWLSSMENPDMIFVMSPWDKRRRTHHRPSEGSSPWGVAAFIVLLLVLVKFQSTFLDSWLV

SEQ ID NO: 920 - DNA, 569 bp, Arabidopsis thaliana
  misc_feature (1)..(569): Ceres CLONE ID no.37778
  misc_feature (1)..(569): Encodes the peptide sequence at SEQ ID NO 921
aagaagaccttctctcatcatcattattataggaagttaggaactatggcttatgaagagagaagatcatcgatcctggattcattctcgctatcgccactaccatacccagttcttttgatcctagccgttgcttcagtgttcttgttgagttcatggtacttcagcttggaagaagcagccgaatcagcggaagagcagataaattttgcgcttctcttgattcctctgtttcttatagtcttggtccggtggttatcttccatggagaaccctgatgcgcttctcgggatgttttcaagcagtcgtcggacaacttacgtgagtcccggagccggaggtgacggtggaagctcgccgtggggagtggcggcgttgatagttttgttgcttgtattgcttcagtatcaatcaagtttcttggagatgtggtctggttaatgatattgataggttttttgattttcacgtgttttgttttgtcgtctagtagcacgatgatgtaaaaatttggtcattacttacgaattacgaggtttaaaatctcgtgacggtactacatgttatcc

SEQ ID NO: 921 - protein, 131 aa, Arabidopsis thaliana
  misc_feature (1)..(131): Ceres CLONE ID no.37778
  misc_feature (1)..(131): Bit score of 304.3 for HMM based on sequences of FIGURE 30.
  misc_feature (1)..(131): Functional Homolog Of Ceres SEEDLINE ID no. ME12927 at SEQ ID NO: 917
MAYEERRSSILDSFSLSPLPYPVLLILAVASVFLLSSWYFSLEEAAESAEEQINFALLLIPLFLIVLVRWLSSMENPDALLGMFSSSRRTTYVSPGAGGDGGSSPWGVAALIVLLLVLLQYQSSFLEMWSG

SEQ ID NO: 922 - DNA, 742 bp, Glycine max
  misc_feature (1)..(742): Ceres CLONE ID no.681297
  misc_feature (1)..(742): Encodes the peptide sequence at SEQ ID NO 923
agcgccaaatcatcaagtacaaactttatttcgcaaaataagcgaccaaccaaacgtagcactctcgtcctcatcttcagctattataaataaacaaaacaggacacaaactcatccaacagttctgaattaaaatgggctatggtagaagcagagcatcctctgttttggacggtttcagtctaaaccccgtgccataccccgttctgctaatcttatcactgatccttctattcctcggcatttcatggtacttgtcgtatgaagaagtagttgaagccgctgaagaacaactggggtggatgctgttagccacaccagtggtgctaatactcgtagttcgttggttatcgtcagtggatacttcagaatggttcttctttaactcctcgccatgggagaggcgtaggagaacccaccacttcccatcagagggtagctccccttggggtgttgctgctttgatcctgcttgttctcgtgcttcttcattatcactccacttttcttgatgcctggtttgtttgattttatttcgtcctctgtttagagtttcttggtatctctatagttacgagctttgtttgtgtttattacttatttatagagaaagaacatagtaactttgatgcaagcctttgtgattatcgtagatatgtagatgattagattatgctgctctatgaatatgaatttatgaattgtatttaaggtgttttgtgattatgaatgtatttcttcct

SEQ ID NO: 923 - protein, 130 aa, Glycine max
  misc_feature (1)..(130): Ceres CLONE ID no.681297
  misc_feature (1)..(130): Bit score of 325.0 for HMM based on sequences of FIGURE 30.
  misc_feature (1)..(130): Functional Homolog Of Ceres SEEDLINE ID no. ME12927 at SEQ ID NO: 917
MGYGRSRASSVLDGFSLNPVPYPVLLILSLILLFLGISWYLSYEEVVEAAEEQLGWMLLATPVVLILVVRWLSSVDTSEWFFFNSSPWERRRRTHHFPSEGSSPWGVAALILLVLVLLHYHSTFLDAWFV

SEQ ID NO: 924 - DNA, 688 bp, Triticum aestivum
  misc_feature (1)..(688): Ceres CLONE ID no.575835
  misc_feature (1)..(688): Encodes the peptide sequence at SEQ ID NO 925
cactttccccacctctcaggccaagcaaacgcacaccaggcgaggcaacgcaaagaagcaggcaggcagccatgtcgtactacgaccggcgcggggagtcgtcggtgctggaggcgttcacgctgtcgccgctgccgtacccggtgatcctgatcctgatgatggtgacgctgctgctgggggcgtcgtggttcttctcgtacgaggacttcatggaggaggcgtcggagcagttcagctggttcctgctgggcgtgcccatcgcgctcgtcctcctcatccgctggatctcctccgtcgacaccttcgagggctacttcgggttctaccccaccgagagccgctggagggggtacccggccgcgccctccgagggcagctccccctggggcgtcgccatggtcgtcgtcctcctgctcctcctcgccagcttccactccaccttccaggacatgtggaagccttgatggaatgatcgatgctccgatccatacctcgtatgtacgtgtatgtgtgtatgtatgtaattccatcgtatcgatctgtagtacacctacgaatgattgttgcttccaccttccaggcggttgctgcacctgcacgtatgtgtgccttgcttttcctcctgtactgtacatagatgaaggttatattctgctagctgaaaaactatagagcttgagtgtcg

SEQ ID NO: 925 - protein, 131 aa, Triticum aestivum
  misc_feature (1)..(131): Ceres CLONE ID no.575835
  misc_feature (1)..(131): Bit score of 355.8 for HMM based on sequences of FIGURE 30.
  misc_feature (1)..(131): Functional Homolog Of Ceres SEEDLINE ID no. ME12927 at SEQ ID NO: 917
MSYYDRRGESSVLEAFTLSPLPYPVILILMMVTLLLGASWFFSYEDFMEEASEQFSWFLLGVPIALVLLIRWISSVDTFEGYFGFYPTESRWRGYPAAPSEGSSPWGVAMVVVLLLLLASFHSTFQDMWKP

SEQ ID NO: 926 - DNA, 758 bp, Zea mays
  misc_feature (1)..(758): Ceres CLONE ID no.1588376
  misc_feature (1)..(758): Encodes the peptide sequence at SEQ ID NO 927
ctcctcccctcttctcactcagctcaccagtgctcgctcacctttcccctccctttcctttcctttgctttcctatccttgtgccctcgaactcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggccggatgtgggtcctgctcctgttcgattccacgcgcgcacgtatgcgattgtactgctggttgctgcttgatcgatcgatggatcgatgattccatgtacatatttgatagggggatgctgctgctaggctattagctgcaggctatagagtttgagggtgatatacttatcagtttgctgcctgtaagactggttttggttttgctataatcgtgatgtattcagatgtacagtg

SEQ ID NO: 927 - protein, 133 aa, Zea mays
  misc_feature (1)..(133): Ceres CLONE ID no.1588376
  misc_feature (1)..(133): Bit score of 349.6 for HMM based on sequences of FIGURE 30.
  misc_feature (1)..(133): Functional Homolog Of Ceres SEEDLINE ID no. ME12927 at SEQ ID NO: 917
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLASFHSTIHDMWGP

SEQ ID NO: 928 - DNA, 819 bp, Zea mays
  misc_feature (1)..(819): Ceres CLONE ID no.425212
  misc_feature (1)..(819): Encodes the peptide sequence at SEQ ID NO 929
acgatcgtggttggtgttggttacacgcgcctatatcgccggttcggccgcacgtccgcctcctcctctcctcctccctcttctcagctcaccagtgctcgctcacctttccccttcctttcctttcctttcctatcctcgtgccctcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgacggagagccgctggaagggccgctacgagcggggccccgccgagggcagctcgccctggggcgtcgccttgctcgtcctcctcctcctcgtgctcgccagcttccactccaccatccacgacatgtggggcccgtgaacggatgtagtgattgtagtcctgctcctgttcggttccacgcgcgcacgtatgcgcttgtgctactggttgctgcttgatcgatcgatggatcgatgattccatgtacatatttgttagggggatgctgcggctaggctattagctgcaggctatagagtttgagggtgatatacttatcagtttgctgcctgtaagactggttttggttttgctataatcgtgatatattccgatgtacagtatac

SEQ ID NO: 929 - protein, 133 aa, Zea mays
  misc_feature (1)..(133): Ceres CLONE ID no.425212
  misc_feature (1)..(133): Bit score of 350.7 for HMM based on sequences of FIGURE 30.
  misc_feature (1)..(133): Functional Homolog Of Ceres SEEDLINE ID no. ME12927 at SEQ ID NO: 917
MSYYGDRRAESSIVEAFTLSPLPYPVILVLLMVTLLLGASWFFTYDDFIEEASQQLSWALLGVPIALVLLIRWISSVDSFEGYLGFYPTESRWKGRYERGPAEGSSPWGVALLVLLLLVLASFHSTIHDMWGP

SEQ ID NO: 930 - DNA, 432 bp, Zea mays
  misc_feature (1)..(432): Ceres CLONE ID no.341454
  misc_feature (1)..(432): Encodes the peptide sequence at SEQ ID NO 931
aagtcctcctcgatcacactccaccacgattgccaagtgtcaatctcgacacggcagcaggagcctttgggccgtcgttacacgcacctatccatctcatctccgcggcacacgacacgatcgtggttggtgttggttacacgcgcctatatcgccgccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgacggagagc

SEQ ID NO: 931 - protein, 133 aa, Zea mays
  misc_feature (1)..(133): Ceres CLONE ID no.341454
  misc_feature (1)..(133): Bit score of 335.9 for HMM based on sequences of FIGURE 30.
  misc_feature (1)..(133): Functional Homolog Of Ceres SEEDLINE ID no. ME12927 at SEQ ID NO: 917
  misc_feature (79)..(79): Xaa is any aa, unknown or other
  misc_feature (91)..(91): Xaa is any aa, unknown or other
MSYYGDRRAESSIVEAFTLSPLPYPVILVLLMVTLLLGASWFFTYDDFIEEASQQLSWALLGVPIALVLLIRWISSVDXFEGYLGFYPTEXRWKGRYERGPAEGSSPWGVALLVLLLLVLASFHSPHPDMWGP

SEQ ID NO: 932 - DNA, 742 bp, Zea mays
  misc_feature (1)..(742): Ceres CLONE ID no.1460136
  misc_feature (1)..(742): Encodes the peptide sequence at SEQ ID NO 933
cactttccccacctcgcaggccaagcaaacgcacgccaggcgaggcagcacaaagaagcagcgaggcagccatgtcgtactacgaccggcgcggggagtcgtcggtgctggaggcgttcacgctgtcgccgctgccgtacccggtgatcctgatcctgatgatggtgacgctgctgctgggggcgtcgtggttcttctcctacgaggagttcatggaggaggcgtcggagcagttcagctggttcctgctgggcgtgcccatcgcgctcgtcctcctcatccgctggatctcctccgtcgacaccttcgagggctacttcggcttctaccccaccgagagccgctggcggggctacccggccgcgccctccgagggcagctccccctggggcgtcgccatggtcgtcctcctcctcctcgtcctcgccagcttccactccaccttccaggacatgtggaaggcttgatggaatgatcggttctccgatccatacctcgtacgtatgtgtgtatgtatgtgattccatcgtgtcgatctgtagtacgcctatgaatgattgattgttgcttccaggcggttgctgcacctgcacgtatgtatgccttgcttttcctcctgtactgtacatagatgatggaggttatattctgctagtagctaaaaactatagagcttgagtgttacccctctgtactggttcttgttctgtgtcttactgaatgaatcaataggtttctgttg

SEQ ID NO: 933 - protein, 131 aa, Zea mays
  misc_feature (1)..(131): Ceres CLONE ID no.1460136
  misc_feature (1)..(131): Bit score of 355.4 for HMM based on sequences of FIGURE 30.
  misc_feature (1)..(131): Functional Homolog Of Ceres SEEDLINE ID no. ME12927 at SEQ ID NO: 917
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVLLLLVLASFHSTFQDMWKA

SEQ ID NO: 934 - DNA, 603 bp, Musa acuminata
  misc_feature (1)..(603): Ceres CLONE ID no.1714750
  misc_feature (1)..(603): Encodes the peptide sequence at SEQ ID NO 935
ccatttctccaacaaaaagcctcggtacctctctctctctctctctcatggcctatgacagaagaaggtcctctttgtttgatgccttcaccctctcacctctcccgtaccccgtgctgctgatactgctgatggttttcctcttgctaagcctatcatggttcttcgaccacgagtcgttcatggaggagacggaggagcagatgagttgggtgctcctcacgctccccgtcgttctgatcctcgtcatccggtggctctcctccatcgaaaggctcgacgatacgctgatggggctgttccggtacgatcgtcgtcgtccgagttactacggctacagccagccgcaggagggaagctcaccgtggggcatcgccgcggtcctcgtcttgttgctcgtgatggtctacttccactcgagcatccaggatatgtggggaccttgatttgatcccttttgtgatacaaatgttccacatgtacagcttcttctcttctcattgatgtctaatgtctactactactctactcttgtcatgggcttgtttatactggactcggtttccccgttctatatttctctacacgtacagcttcttctct

SEQ ID NO: 935 - protein, 132 aa, Musa acuminata
  misc_feature (1)..(132): Ceres CLONE ID no.1714750
  misc_feature (1)..(132): Bit score of 334.2 for HMM based on sequences of FIGURE 30.
  misc_feature (1)..(132): Functional Homolog Of Ceres SEEDLINE ID no. ME12927 at SEQ ID NO: 917
MAYDRRRSSLFDAFTLSPLPYPVLLILLMVFLLLSLSWFFDHESFMEETEEQMSWVLLTLPVVLILVIRWLSSIERLDDTLMGLFRYDRRRPSYYGYSQPQEGSSPWGIAAVLVLLLVMVYFHSSIQDMWGP

SEQ ID NO: 936 - DNA, 785 bp, Panicum virgatum
  misc_feature (1)..(785): Ceres CLONE ID no.1721907
  misc_feature (1)..(785): Encodes the peptide sequence at SEQ ID NO 937
gcgtccttctccctcgctctctttcccctcccgacctcccctccgaagcaagaatcaccacaggagccccggccccggaccccgaaccaacggcggccatggcgtactacggcgaccggcggccggagtcgtcgatcgtggaggcgttcacgctgtcgccgctgccgtacccggtgatcctgatcctgctcatggtctcgctcctcctgggcgtctcgtggttcttcacctacgaggacttcatcgaggaggcggcggagcagttcagctgggcgctgctggtcgtgcccatcgcgctcgtgctcctcatccgctggatctcctccgtcgactccttcgacggctacttcttcggcttctaccccagcgagcgccgctggaggcccggctacgggagcgcccccgccgagggcagctcgccctggggcgtcgccatgctcgtcctgctcctcatcgtgctcgccagcttccacgagaccatccgggacatgtggcggccatgatcgatcgaatccatcatccggcctcgtctcgtctatcctgatgaggaacacgtacgcgtgattcggtctgctgtccaccacacctctagtgctcgatttctcatgctttttcttgcgcgcttgcattggctgatcgctgatcctatatatttctacgcgcgcatgcatgtttgcgcttgtacttcttgttccatcgaatcgatgctgtacatactgcataatacggattctgcaactggctagattatagactgtgagggtgatactcgattagctgcatgt

SEQ ID NO: 937 - protein, 134 aa, Panicum virgatum
  misc_feature (1)..(134): Ceres CLONE ID no.1721907
  misc_feature (1)..(134): Bit score of 361.8 for HMM based on sequences of FIGURE 30.
  misc_feature (1)..(134): Functional Homolog Of Ceres SEEDLINE ID no. ME12927 at SEQ ID NO: 917
MAYYGDRRPESSIVEAFTLSPLPYPVILILLMVSLLLGVSWFFTYEDFIEEAAEQFSWALLVVPIALVLLIRWISSVDSFDGYFFGFYPSERRWRPGYGSAPAEGSSPWGVAMLVLLLIVLASFHETIRDMWRP

SEQ ID NO: 938 - DNA, 854 bp, Panicum virgatum
  misc_feature (1)..(854): Ceres CLONE ID no.1764054
  misc_feature (1)..(854): Encodes the peptide sequence at SEQ ID NO 939
accacgcaggcacgaccgtccccccgccccgcgtccttctccctcgctctctttcccctcccaacctcccctccgaagcaagaatcaccagaggagcccggccccggaccccggaccccgaaccaagccaaccaggtgcggtgcgggcgtgagcggcggccatggcgtactacggcgaccagcgcccggagtcgtcgatcgtggaggcgttcacgctgtcgccgctgccgtacccggtgatcctgatcctgctcgtggtctcgctcctcctgggcgtctcgtggttcttcacctacgaggacttcatcgaggaggcggcggagcagttcagctgggcgctgctggccgtgcccatcgcgctcgtgctcctcatccgctggatctcctccgtcgactccttcgacggctacttcttcggcttcctccccagcgagcgccgctggaggcccggctacgggagcgcccccgccgagggcagctcgccctggggcgtcgccatgctcgtcctgcttctcatcgtgctcgcgagcttccacgagaccatccgggacatgtggcggccatgaccgaatccatccgccctcgtctgtcctgacgacctctagtgctcgatttctcatgctttttattgcgcgcttggttgatcgctgatcctatatgtttctacgcgcgcatgcatgtttctacgcgcgcttgtacttcttgctccatcggtgctgtacatactgcataatacggattctgcaactggctagattatagactctgagggtgatactcgatcaattagctgcatgtaaccctggttctgtttttttttgtgcgtgttatataatcaaggtctgctttgcttt

SEQ ID NO: 939 - protein, 134 aa, Panicum virgatum
  misc_feature (1)..(134): Ceres CLONE ID no.1764054
  misc_feature (1)..(134): Bit score of 349.8 for HMM based on sequences of FIGURE 30.
  misc_feature (1)..(134): Functional Homolog Of Ceres SEEDLINE ID no. ME12927 at SEQ ID NO: 917
MAYYGDQRPESSIVEAFTLSPLPYPVILILLVVSLLLGVSWFFTYEDFIEEAAEQFSWALLAVPIALVLLIRWISSVDSFDGYFFGFLPSERRWRPGYGSAPAEGSSPWGVAMLVLLLIVLASFHETIRDMWRP

SEQ ID NO: 940 - protein, 130 aa, Oryza sativa subsp. japonica
  misc_feature (1)..(130): Public GI ID no.115451923
  misc_feature (1)..(130): Bit score of 353.8 for HMM based on sequences of FIGURE 30.
  misc_feature (1)..(130): Functional Homolog Of Ceres SEEDLINE ID no. ME12927 at SEQ ID NO: 917
MAYQRGETSSVVEAFTLSPLPYPVILILLMVMLLLGVSWFFTYEDFMEEAAEQLSWALLLVPVALVLLIRWISSVDTFDGYFSFYPTERRWNRYDPGPAEGSSPWGVAMVVLLLLVLASFHSTFQDMWKP

SEQ ID NO: 941 - DNA, 1917 bp, Populus balsamifera subsp. trichocarpa
  misc_feature (1)..(1917): Ceres ANNOT ID no.1460725
  misc_feature (1)..(1917): Encodes the peptide sequence at SEQ ID NO 942
atgggtgatacggaggatgctaatagtgaaatgatacacaggttgcaatcttcttttggaacaacacaatcgtcatctgctacaatgtctaaacaacccttttctttgataaaccaattagatgtttctcaattgaatttgaaccaaacccagttgcgggcaaggcattttgcgaatttttatcagaattttagtggtgatagtaacaaaagagtagggattccgccttcacatcctaatcagatcccacccatttcgccgtattcccagatcccggtgtctaggccagcgaaccagcaaatgagtacccagaatttcagtatgggacctacccattcgcgatctttatcgcagccatcatcgtttttctgccttgattccttgccaccgttgagtccggccccttttcgtgactcctcttcgccaacggtttcggaccctatttcaactgatgtgtccatggaggataaggatggtagctctcattcgttgttgccaccctccccttttaataggggcaatgctccacgtgttggtgagagtttacctccacggaaagcccatagaaggtctaacagtgatattccatttggtaatgtgttgcaatgttcacctccccttattccgttgaggggttcaggtggcttggagcggtcgttgtccggtagagagaatccagcgatggctaagccagctcagttggtaaaaaaagaatgggagagaggtggtgaaagcattgcggaggggacgggtgagaggaaatctgaaggggatgtggatgatttgttttctgcttatatgaatttagataacattgatgcgttgaactcttcgggtactgatgagaagaatggtaatgagaatcgtgaggatttggatagtagagctagtggaactaagacaaatggtggtgatagcagtgataatgaggcagaaagcagcgttaatgaaagtggtggcagcgtgccaagaggaggatttagttcttcaacagagaagagggaggggatcaaaaggagtgctggaggtgatatcgctcctacctccaggcactacagaagtgtgtcaatggatagtttcatgggcaaattgaactttggtgacgagtctccaaaattgccaccttcaccaggaactcgtccaggtcaactttcacccaccaattcaatggatggcaatgcctttagcttggagtttgggaatggtgaatttagtggtgctgaactgaagaaaattatggctaatgagaaacttgctgagattgcttcaactgacccaaaacgtgcaaagagtttgtggcatcataggcagatgccaaagtcgagcgtactgagcgatggtttttctcgatatgttataagcctggccccgatgtttcattttcttcatttgttggtcaatatcaggattttggcgaatcggcaatcagctgctcgttctaaggagaggaagatgagatatatttcagaattagaacacaaggttcagactttgcagacagaagctaccacattgtctgctcagcttactcttttacagagggattctgttggtcttacaagccagaataatgaattgaaatttcgccttcaagccatggagcaacaagcacaactccgagatgctctaaacgaagcattaaacggtgaagtacgacggttgaagattgctacggcagagcagggtggggattctgacccatccaagggcttggttcagcagcagctttctgtcaaccctcagatgttcatgcagcagccacgaccttctcaacttaacaggcagcaattgcagcagcagcagcagccttcagcctcccaaatcaacatgcatcagttgcaacagcagcagcagtcctcccagccacagcctcaacaaaatggcagtactaccttaaagtcagattcgaatcaatag

SEQ ID NO: 942 - protein, 638 aa, Populus balsamifera subsp. trichocarpa
  misc_feature (1)..(638): Ceres ANNOT ID no.1460725
  misc_feature (1)..(638): Bit score of 1202.4 for HMM based on sequences of FIGURE 56.
  misc_feature (473)..(524): Pfam Name: bZIP_1 Pfam Description: bZIP transcription factor
  misc_feature (1)..(638): Functional Homolog Of Ceres SEEDLINE ID no. ME20628 at SEQ ID NO: 1681
MGDTEDANSEMIHRLQSSFGTTQSSSATMSKQPFSLINQLDVSQLNLNQTQLRARHFANFYQNFSGDSNKRVGIPPSHPNQIPPISPYSQIPVSRPANQQMSTQNFSMGPTHSRSLSQPSSFFCLDSLPPLSPAPFRDSSSPTVSDPISTDVSMEDKDGSSHSLLPPSPFNRGNAPRVGESLPPRKAHRRSNSDIPFGNVLQCSPPLIPLRGSGGLERSLSGRENPAMAKPAQLVKKEWERGGESIAEGTGERKSEGDVDDLFSAYMNLDNIDALNSSGTDEKNGNENREDLDSRASGTKTNGGDSSDNEAESSVNESGGSVPRGGFSSSTEKREGIKRSAGGDIAPTSRHYRSVSMDSFMGKLNFGDESPKLPPSPGTRPGQLSPTNSMDGNAFSLEFGNGEFSGAELKKIMANEKLAEIASTDPKRAKSLWHHRQMPKSSVLSDGFSRYVISLAPMFHFLHLLVNIRILANRQSAARSKERKMRYISELEHKVQTLQTEATTLSAQLTLLQRDSVGLTSQNNELKFRLQAMEQQAQLRDALNEALNGEVRRLKIATAEQGGDSDPSKGLVQQQLSVNPQMFMQQPRPSQLNRQQLQQQQQPSASQINMHQLQQQQQSSQPQPQQNGSTTLKSDSNQ

SEQ ID NO: 943 - DNA, 608 bp, Zea mays
  misc_feature (1)..(608): Ceres SEEDLINE ID no.ME12929
  misc_feature (1)..(608): Ceres CLONE ID no.208995
  misc_feature (1)..(608): Inplanta Sequence
  misc_feature (1)..(608): Encodes the peptide sequence at SEQ ID NO. 944
agaccaggccactcaacagcatcactcaaagccaagcaacagcagcagcttccctagcaacaccttgcccctgagctcatgggatccctgggccccacagtgagcttgagcatcatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcgagtacggccttcccgccgacggcgacgtcgacagcaagcgccgcttcgccatgggcgccttcctctggcccgaccagtactgatccaaccaaacaaagctcagcgctagctagctgcgtgccggccgtgatctcgtcatatttagaggatcagctgcatcagttatagcgagacctaattgatcatctccatcgatcgtatacatgttaccatcgttctgcttgtagttgtagcggccggacatgctgcattctagtatatagctggatcgcgcgctgtatagtgtagtatgtctatgaaataaaagaaatgttgtttattttatcac

SEQ ID NO: 944 - protein, 94 aa, Zea mays
  misc_feature (1)..(94): Ceres SEEDLINE ID no.ME12929
  misc_feature (1)..(94): Ceres CLONE ID no.208995
  misc_feature (1)..(94): Bit score of 231.8 for HMM based on sequences of FIGURE 31.
MGSLGPTVSLSIMARPGGQQPAEMERKKDSGVFFGGGCGFRMPLHYPRYKKADYESMPEWRVDCLLREYGLPADGDVDSKRRFAMGAFLWPDQY

SEQ ID NO: 945 - DNA, 279 bp, Populus balsamifera subsp. trichocarpa
  misc_feature (1)..(279): Ceres ANNOT ID no.1447562
  misc_feature (1)..(279): Encodes the peptide sequence at SEQ ID NO 946
atgagtggagttagctgcccaagcagtgtcagctcggccatgcctaaagacttgaggcctaatgggtataaccagcatcaagcaagcaaaagaggcacctgctcttgcttccagatgccactgcattacccaaggtacaagaagtctgactacgagaccatgcctgagtggagattggactgcttgttgaaagagtacgggctgcctgctattggagatgctaaccagaagaggaagtttgccatgggagccttcctttggccttcagagaatgagtga

SEQ ID NO: 946 - protein, 92 aa, Populus balsamifera subsp. trichocarpa
  misc_feature (1)..(92): Ceres ANNOT ID no.1447562
  misc_feature (1)..(92): Bit score of 221.7 for HMM based on sequences of FIGURE 31.
  misc_feature (1)..(92): Functional Homolog Of Ceres SEEDLINE ID no. ME12929 at SEQ ID NO: 944
MSGVSCPSSVSSAMPKDLRPNGYNQHQASKRGTCSCFQMPLHYPRYKKSDYETMPEWRLDCLLKEYGLPAIGDANQKRKFAMGAFLWPSENE

SEQ ID NO: 947 - protein, 101 aa, Arabidopsis thaliana
  misc_feature (1)..(101): Public GI ID no.98962139
  misc_feature (1)..(101): Bit score of 233.2 for HMM based on sequences of FIGURE 31.
  misc_feature (1)..(101): Functional Homolog Of Ceres SEEDLINE ID no. ME12929 at SEQ ID NO: 944
MGIKFSQGPSNTTIHNRSHQDGEDQRNETATKINHDKPQNQSSSFQIPLHYPKYTKSDYEKMPEWQLDRLLREYGLPVIGDSYEKRKFAIGAFLWSSENEH

SEQ ID NO: 948 - protein, 102 aa, Arabidopsis thaliana
  misc_feature (1)..(102): Public GI ID no.116830207
  misc_feature (1)..(102): Bit score of 233.2 for HMM based on sequences of FIGURE 31.
  misc_feature (1)..(102): Functional Homolog Of Ceres SEEDLINE ID no. ME12929 at SEQ ID NO: 944
MGIKFSQGPSNTTIHNRSHQDGEDQRNETATKINHDKPQNQSSSFQIPLHYPKYTKSDYEKMPEWQLDRLLREYGLPVIGDSYEKRKFAIGAFLWSSENEHG

SEQ ID NO: 949 - DNA, 496 bp, Glycine max
  misc_feature (1)..(496): Ceres CLONE ID no.641607
  misc_feature (1)..(496): Encodes the peptide sequence at SEQ ID NO 950
aaaagcaaggctaaaagagaatcaaatcggagtggtggaggaatggaatcagtgactactcggccttccccaaacgtagttggagttgcaaattccaaacatggcgtggagtggtgtgggcactttcagatgccactgcactatccaaggtacacccaagctgactatgaggcaatgccagagtggaggcttgactgcttgctcaaagagtatggtttaccaatctttggggatgttgagagcaagagaaagtttgccatgggtgccttcctatggatcaagtgagcttccaatgttcttaggcatgttcttgccatgaccctcttggaattttgcacttgttatatttgatataagtgtgggagtttttaataatgattagtattagttagttaatactagtatgttgtggtataattaacacataattatatcccttaaacatattattatgggtttgcttctaagtctatatatataaaataatatttgttgt

SEQ ID NO: 950 - protein, 80 aa, Glycine max
  misc_feature (1)..(80): Ceres CLONE ID no.641607
  misc_feature (1)..(80): Bit score of 183.4 for HMM based on sequences of FIGURE 31.
  misc_feature (1)..(80): Functional Homolog Of Ceres SEEDLINE ID no. ME12929 at SEQ ID NO: 944
MESVTTRPSPNVVGVANSKHGVEWCGHFQMPLHYPRYTQADYEAMPEWRLDCLLKEYGLPIFGDVESKRKFAMGAFLWIK

SEQ ID NO: 951 - DNA, 599 bp, Zea mays
  misc_feature (1)..(599): Ceres CLONE ID no.232893
  misc_feature (1)..(599): Encodes the peptide sequence at SEQ ID NO 952
caggccactcaacagcatcactcaaagccaagcaacagcagcagcttccctagcaacaccttgcccctgagctcatgggatccctgggccccacagtgagcttgagcatcatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcaagtacggccttcccgccgacggcgacgtcgacagcaagcgccgcttcgccatgggcgccttcctctggcccgaccagtactgatccaaccaaacaaagctcagcgctagctagctgcgtgccggccgtgatctcgtcatatttagaggatcagctgcatcagttatagcgagacctaattgatcatctccatcgatcgtatacatgttaccatcgttctgcttgtagttgtagcggcgggacatgctgcattctagtatatagctggatcgcgcgctgtatagtgtagtatgtctatgaaataaaagaaatgttgtttatttc

SEQ ID NO: 952 - protein, 94 aa, Zea mays
  misc_feature (1)..(94): Ceres CLONE ID no.232893
  misc_feature (1)..(94): Bit score of 225.9 for HMM based on sequences of FIGURE 31.
  misc_feature (1)..(94): Functional Homolog Of Ceres SEEDLINE ID no. ME12929 at SEQ ID NO: 944
MGSLGPTVSLSIMARPGGQQPAEMERKKDSGVFFGGGCGFRMPLHYPRYKKADYESMPEWRVDCLLRKYGLPADGDVDSKRRFAMGAFLWPDQY

SEQ ID NO: 953 - DNA, 643 bp, Zea mays
  misc_feature (1)..(643): Ceres CLONE ID no.457959
  misc_feature (1)..(643): Encodes the peptide sequence at SEQ ID NO 954
attcgagcagcatcgtcacccagagccaagcagctagctagtagcggccggcagcatcgcgtagtagagtgtgctagctcagagcagcgcgcagcttccaccctgcgcgcgcatatatgggacccttgggccccaccgtgagcttcagcatcatggtcatggccaagctcagcggcgccgcccagcagcagcccgaggatgagagggagaggaaggagggcgtcaggtgcggcggcgtcggcgggtgcggcttccggatgccgctgcactacccgcgctacaagaaggcggactacgaggccatgcccgagtggcgcgtcgactgcctgctccgcgagtacggcctccccgccgacggcgacctcgacagcaagcgccgcttcgccatgggcgccttcctctggcccgaccagtactgatctgatacaaccaaacaagctagctagctagcccaagcccagagcgcggcgtgccggccgtgaatagtctcgtcatgttcagagcatcagctgtagcgatcgagacctaaatcatcatcgtgcatatgccatatgctctcttgttatttataagttaccatctgcttgtagttgtatagtatagctaattattagctatggaataattaagagatgtttatggg

SEQ ID NO: 954 - protein, 100 aa, Zea mays
  misc_feature (1)..(100): Ceres CLONE ID no.457959
  misc_feature (1)..(100): Bit score of 208.5 for HMM based on sequences of FIGURE 31.
  misc_feature (1)..(100): Functional Homolog Of Ceres SEEDLINE ID no. ME12929 at SEQ ID NO: 944
MGPLGPTVSFSIMVMAKLSGAAQQQPEDERERKEGVRCGGVGGCGFRMPLHYPRYKKADYEAMPEWRVDCLLREYGLPADGDLDSKRRFAMGAFLWPDQY

SEQ ID NO: 955 - DNA, 598 bp, Zea mays
  misc_feature (1)..(598): Ceres CLONE ID no.274971
  misc_feature (1)..(598): Encodes the peptide sequence at SEQ ID NO 956
aatgccattcgagcagcatcgtcacccagagccaagctgcaagcagctagtagcggccggcagcatcgcgtagtagagtgtgctcagagcagcgcgcgcatgggacccttgggccccaccgtgagcttcagtatcatggtcatggccaagctcagcggcgccgcccagcagcagccggaggatgagagggagaggaaggagggcggcagtgggtgcggcttccggatgccgctgcactacccgcgctacaagaaggcggactacgaggccatgcccgagtggcgcgtcgactgcctgctccgcgagtacggcctccccgccgacggcgacctcgacagcaagcgccgcttcgccatgggcgccttcctctggcccgaccagcactgatctgatacaaccaaacaagctagcgcgctagcccagagcgcggcgtgccggccgtgaatagtctcgtcatgttcagagcatcagctgtagcgatcgagacctaaatcatcatcgtgcatatgctctcttgctatttataagttaccatctgcttgtagttgtatagtatagctaattattagctatggaataattaagagatgtttatggg

SEQ ID NO: 956 - protein, 95 aa, Zea mays
  misc_feature (1)..(95): Ceres CLONE ID no.274971
  misc_feature (1)..(95): Bit score of 204.8 for HMM based on sequences of FIGURE 31.
  misc_feature (1)..(95): Functional Homolog Of Ceres SEEDLINE ID no. ME12929 at SEQ ID NO: 944
MGPLGPTVSFSIMVMAKLSGAAQQQPEDERERKEGGSGCGFRMPLHYPRYKKADYEAMPEWRVDCLLREYGLPADGDLDSKRRFAMGAFLWPDQH

SEQ ID NO: 957 - DNA, 716 bp, Zea mays
  misc_feature (1)..(716): Ceres CLONE ID no.1590580
  misc_feature (1)..(716): Encodes the peptide sequence at SEQ ID NO 958
ctacacacaagaaacatagaaacgacatatattattaagcatgggttccctaggctcaagcaccattagcagcatgaacatggcgaagcaggcagccaccaccgttggtgctaagaacggcgctgttgctgtcgccgatcagcagaaagtagagggccccaggacgatgaactgcagtagctacaccttccacatgccgctgcactacccgaggtacaagaaggcggactacgagagcatgccggagtggcgcgtcgactgcctgctccgcgagtacggcctccccgtcgacggcgaactcgacagcaagcgaaagttcgccatgggcgccttcctctggcccgaccagtactgaaggaacccgtggcccgagctagctgaggctgctgagcctgagctaacaagagatgaagcaactgcagtcgtagccggagctagctgtgtgatgcgccactgctgctgcctccggcgaccagggttacatccctgacgtaggcaagtgtgaggagtgtggagaagaatcatatatttatgtgtagtgctgatacattatgagtctacgtactcgcctcgatcttgcttctgcttttctctacaataataatccattcatgcaaccaggatcgaataattgcatgctggtgtaccaatatatgaactaataataatatcggttcgcaatgaataaatatatgagtggtgccggttcttgtttg

SEQ ID NO: 958 - protein, 104 aa, Zea mays
  misc_feature (1)..(104): Ceres CLONE ID no.1590580
  misc_feature (1)..(104): Bit score of 206.4 for HMM based on sequences of FIGURE 31.
  misc_feature (1)..(104): Functional Homolog Of Ceres SEEDLINE ID no. ME12929 at SEQ ID NO: 944
MGSLGSSTISSMNMAKQAATTVGAKNGAVAVADQQKVEGPRTMNCSSYTFHMPLHYPRYKKADYESMPEWRVDCLLREYGLPVDGELDSKRKFAMGAFLWPDQY

SEQ ID NO: 959 - DNA, 701 bp, Zea mays
  misc_feature (1)..(701): Ceres CLONE ID no.222888
  misc_feature (1)..(701): Encodes the peptide sequence at SEQ ID NO 960
gttttcaacaaaccatcggccaattccgaagaagaagaagcaacaggaatcgtagcagccaaggcaaccgtgagcatgggctccctgggtcctagcgtggtgaccctgcaggaacagcagcagcagcccaagccccgcaaaccggcggcggcgggcggcggctgccaccagctggagcagcagagcagcaactgcggcgggtcgtcgttccggatgccgctgcactacccgcggtacaagaaggcggactacgaggccatgccggagtggcgcgtcgactgcctgctccgcgagtacggcctccccgtcgccggggaccttcgcgggaagcgggagttcgccatgggcgccttcctctggcccggtcagtactgatgaactgtacgtttgatggagtcccagatcgaagcagcatatgcataaggagtcgagattctccccgccggattcaccattttacctacactagacataggatccagtgattcggtatgcatcagctcgttctcgatcgttccatgaaactactataattgtcgtcgctctcctcctcacctcgcgtgcatcgttgtggaatcagtaattcatcagcatctgtacaataccatgtggctgggcagagtatgtattgtcagtacgagttagttatttcatcaaaaatggaataaacataaatattccagcttctatgtctgggattc

SEQ ID NO: 960 - protein, 99 aa, Zea mays
  misc_feature (1)..(99): Ceres CLONE ID no.222888
  misc_feature (1)..(99): Bit score of 180.6 for HMM based on sequences of FIGURE 31.
  misc_feature (1)..(99): Functional Homolog Of Ceres SEEDLINE ID no. ME12929 at SEQ ID NO: 944
MGSLGPSVVTLQEQQQQPKPRKPAAAGGGCHQLEQQSSNCGGSSFRMPLHYPRYKKADYEAMPEWRVDCLLREYGLPVAGDLRGKREFAMGAFLWPGQY

SEQ ID NO: 961 - DNA, 465 bp, Musa acuminata
  misc_feature (1)..(465): Ceres CLONE ID no.1715150
  misc_feature (1)..(465): Encodes the peptide sequence at SEQ ID NO 962
aatagactcgaagccaaggagagaggcggaaggaggagcagcatgggctccatttctcaacctgtagccaatctctccctcgccgccagcgcgcaggcgaagcagcaacaacgagatctgcactgcttccgtatgccactgcactacccgcgctacacccgagccgactacgagtcgatgccggagtggaagctcgactgcctcctccgggagtacggcctccccgtgaccggcgacgtcgaccacaagaggagcttcgccatgggcgccttcctctggcccgcccactaaagccccatacacttcctcactatatgtctatggagaatgacctgctactactactactactactgctgttaccttgtcataaagccaaacagttctctgtgatggttagatgagctttgcttcacttcctctatccttgtcgatggttgaaatcaatcaatcaatcagattacg

SEQ ID NO: 962 - protein, 82 aa, Musa acuminata
  misc_feature (1)..(82): Ceres CLONE ID no.1715150
  misc_feature (1)..(82): Bit score of 195.8 for HMM based on sequences of FIGURE 31.
  misc_feature (1)..(82): Functional Homolog Of Ceres SEEDLINE ID no. ME12929 at SEQ ID NO: 944
MGSISQPVANLSLAASAQAKQQQRDLHCFRMPLHYPRYTRADYESMPEWKLDCLLREYGLPVTGDVDHKRSFAMGAFLWPAH

SEQ ID NO: 963 - DNA, 678 bp, Panicum virgatum
  misc_feature (1)..(678): Ceres CLONE ID no.1873767
  misc_feature (1)..(678): Encodes the peptide sequence at SEQ ID NO 964
gcaaggcaagatcgagcaggatcactcaagccaagcagcagcagcagcagcaagcctcttgcagagtgctgagcagagcagcagctccctgcgcgcgcatgggatccttgttgggccctaccgtgaccgtgaacgtgagcatgaccaagcccgacgctgcggctgccggcggcgggcagcagccgccggagaggaaggagggcggcggcaggtgcggcgtgctcggctgcggcttccggatgcccctgcactacccgcggtacaagaaggaggactacgagggcatgccggagtggcgcgtcgacagcctgctccgcgagtacggcctccctgccgacggcgacctcgacagcaagcgccgcttcgccatgggcgccttcctctggcccgaccagtactgaactgcgggaggaagctcgccgtggcccgccgtgatcgatctgatctcaccatgctcggaggacgagctgcacttccacgcagcttcagtgattacgttacatatagcgataacaacctgattgagtcagtcatcacactcactatttagaaagagatcgtcctaacttatcatcatctgcttgtaatggccggacatgacacagaggcggtgaatgcgtatgtttcttgcgccctgtatagctatggcggaataataagatgtgctcattctctatc

SEQ ID NO: 964 - protein, 100 aa, Panicum virgatum
  misc_feature (1)..(100): Ceres CLONE ID no.1873767
  misc_feature (1)..(100): Bit score of 225.9 for HMM based on sequences of FIGURE 31.
  misc_feature (1)..(100): Functional Homolog Of Ceres SEEDLINE ID no. ME12929 at SEQ ID NO: 944
MGSLLGPTVTVNVSMTKPDAAAAGGGQQPPERKEGGGRCGVLGCGFRMPLHYPRYKKEDYEGMPEWRVDSLLREYGLPADGDLDSKRRFAMGAFLWPDQY

SEQ ID NO: 965 - DNA, 778 bp, Panicum virgatum
  misc_feature (1)..(778): Ceres CLONE ID no.1721758
  misc_feature (1)..(778): Encodes the peptide sequence at SEQ ID NO 966
aataacaacacaacaaacacacaacatcacctctccctccctctcacgcacacagctgcacgcgcgtgcgtggacacaacacacagagcatgggttccctaggcccaaccaccattagtagcatgagcagcatggcgaaggcagcagcagccagcattggtacgaagaatagcgtggttgccgtcgccgatcagcagcaagctgcaggccagaagaactgcggcagctgcgccttccagatgccgctgcactacccgcagtacaagaaggcggactacgagaccatgccggagtggcgcgtcgactgcctgctccgcgagtacggcctccccgtcaccggcaacctcgaaagcaagagaaagttcgccatgggagccttcctctggcccgaccagtactgaaggaactcatcatggccgcgctgaatataataaccgacctgatgaggttgacaagagaccaagtacagtggctggagcttcgtcatgtgcaacgctgcctctgagttcatgaaaacaattaggagcgccttgttgttactgtcttagcttgctgaaacgtcaagtatagttcttgttctacgtactggcagcaatctagctagcatttctacgtactgacatgctgatcatctatgcatgctcttgcgctgaatgatatatgtattgcatctatcaatataaaaattagtaaatgtatgcatggtgccagtttctgttttcagcacttacctctatctcacgtttttgtcaaaaccacaactgagctgattgatcag

SEQ ID NO: 966 - protein, 103 aa, Panicum virgatum
  misc_feature (1)..(103): Ceres CLONE ID no.1721758
  misc_feature (1)..(103): Bit score of 196.1 for HMM based on sequences of FIGURE 31.
  misc_feature (1)..(103): Functional Homolog Of Ceres SEEDLINE ID no. ME12929 at SEQ ID NO: 944
MGSLGPTTISSMSSMAKAAAASIGTKNSVVAVADQQQAAGQKNCGSCAFQMPLHYPQYKKADYETMPEWRVDCLLREYGLPVTGNLESKRKFAMGAFLWPDQY

SEQ ID NO: 967 - protein, 98 aa, Oryza sativa subsp. japonica
  misc_feature (1)..(98): Public GI ID no.115468306
  misc_feature (1)..(98): Bit score of 233.8 for HMM based on sequences of FIGURE 31.
  misc_feature (1)..(98): Functional Homolog Of Ceres SEEDLINE ID no. ME12929 at SEQ ID NO: 944
MGSLGPAVVVSASAAKMAGGGQQPSTERKETSSAFGGGCCGGGFQMPLHYPRYKKADYEAMPEWRVDCLLREYGLPVDGGVEEKRRFAMGAFLWPDQY

SEQ ID NO: 968 - protein, 82 aa, Oryza sativa subsp. japonica
  misc_feature (1)..(82): Public GI ID no.52075879
  misc_feature (1)..(82): Bit score of 177.4 for HMM based on sequences of FIGURE 31.
  misc_feature (1)..(82): Functional Homolog Of Ceres SEEDLINE ID no. ME12929 at SEQ ID NO: 944
MAGGGQQPSTERKETSSAFGGGCCGGGFQMPLHYPRYKKADYEAMPEWRVDCLLREYGLPVDGGVEEKRRFAMGAFLWPDQY

SEQ ID NO: 969 - protein, 94 aa, Oryza sativa subsp. japonica
  misc_feature (1)..(94): Public GI ID no.115445393
  misc_feature (1)..(94): Bit score of 193.8 for HMM based on sequences of FIGURE 31.
  misc_feature (1)..(94): Functional Homolog Of Ceres SEEDLINE ID no. ME12929 at SEQ ID NO: 944
MGSLGPSVVGLQPKAEKTTAAAGGEQQHGGGGGGCGGSSFRMPLHYPRYKKAEYEAMPEWRVDCLLREYGLPVDGDLDAKRRFAMGAFLWPDQY

SEQ ID NO: 970 - protein, 108 aa, Oryza sativa subsp. japonica
  misc_feature (1)..(108): Public GI ID no.125597402
  misc_feature (1)..(108): Bit score of 62.0 for HMM based on sequences of FIGURE 31.
  misc_feature (1)..(108): Functional Homolog Of Ceres SEEDLINE ID no. ME12929 at SEQ ID NO: 944
MAGGGQQPSTERKETSSAFGGGCCGGGFQMPLHYPRYKKADYEAMPEWRVDCLLRGVRPPRRRRRGGEAEVRHGRLPLARPVLKLAVLRLGDIQKPIEQGTSNCMMLI

SEQ ID NO: 971 - DNA, 312 bp, Sorghum bicolor
  misc_feature (1)..(312): Ceres ANNOT ID no.6059980
  misc_feature (1)..(312): Encodes the peptide sequence at SEQ ID NO 972
atgggttccctaggcccaagcaccattagcagcatgaacatggccaaggcagccagcgtcgttggtggtaagaccggcgttgttgctgtcgccgaccagcagaaagaagtcccccccaagacgatgaattgcagtagctacgccttccagatgccgctgcactacccgcggtacaagaaggcggactacgagagcatgccggagtggcgcgtcgactgcctgctccgcgagtacggcctccccgccgacggcgacctcgacagcaagagaaagttcgccatgggcgccttcctctggcccgaccagtactga

SEQ ID NO: 972 - protein, 103 aa, Sorghum bicolor
  misc_feature (1)..(103): Ceres ANNOT ID no.6059980
  misc_feature (1)..(103): Bit score of 235.0 for HMM based on sequences of FIGURE 31.
  misc_feature (1)..(103): Functional Homolog Of Ceres SEEDLINE ID no. ME12929 at SEQ ID NO: 944
MGSLGPSTISSMNMAKAASVVGGKTGVVAVADQQKEVPPKTMNCSSYAFQMPLHYPRYKKADYESMPEWRVDCLLREYGLPADGDLDSKRKFAMGAFLWPDQY

SEQ ID NO: 973 - DNA, 282 bp, Sorghum bicolor
  misc_feature (1)..(282): Ceres ANNOT ID no.6059985
  misc_feature (1)..(282): Encodes the peptide sequence at SEQ ID NO 974
atgggatccttgggccctaccgtgagcttgagcatcatggccaagcccagcggcggccagcagccggagagggagaggaaggagggcggcggcgtcttcagcggcggctgcggcttccggatgccgctgcactacccgcgctacaagaaggcggactacgagagcatgccggagtggcgcgtcgactgcctgctccgtgagtacggcctccccgctgacggcgacctcgacagcaagcgccgcttcgccatgggagccttcctctggcccgaccagtactga

SEQ ID NO: 974 - protein, 93 aa, Sorghum bicolor
  misc_feature (1)..(93): Ceres ANNOT ID no.6059985
  misc_feature (1)..(93): Bit score of 223.8 for HMM based on sequences of FIGURE 31.
  misc_feature (1)..(93): Functional Homolog Of Ceres SEEDLINE ID no. ME12929 at SEQ ID NO: 944
MGSLGPTVSLSIMAKPSGGQQPERERKEGGGVFSGGCGFRMPLHYPRYKKADYESMPEWRVDCLLREYGLPADGDLDSKRRFAMGAFLWPDQY

SEQ ID NO: 975 - DNA, 1046 bp, Zea mays
  misc_feature (1)..(1046): Ceres SEEDLINE ID no.ME12954
  misc_feature (1)..(1046): Ceres CLONE ID no.225681
  misc_feature (1)..(1046): Inplanta Sequence
  misc_feature (1)..(1046): Encodes the peptide sequence at SEQ ID NO. 976
aaaaaacatccagctcaccgcgctaccgtgccccggcatggcgctccacctcaacaccgtcatcgacctcaccgtggacaattactggctgttccgcatcccgcccatcaccatcgacttcctcaacaagctgccgcagcagagcgaggccccgacgccggcatcagccgttaccgcccagcttacccgccgcttcacgtgctccaccggcgacttcgtcctctacagacagccccagcgggtggaggagatggtcacggccgcggggctgcccctggagtgcgcgcccagcgtggcggagttcatcagcctgtcggtccgcagcaactcgtaccgcaagccagtggtcatgaccgtggaggtcggcgcgcccgtggacgaggacgaggacgaggacgaggagctgccgcccggcgcggtcttcgaggagtgcgccatatgctacaaggagtacctggtcggcggagcaacgtccgtgaagctggcgtgcagccacacgttccaccgcaagtgcctggaccgctggacggccgtgaaccggacgtgcccctactgccgggcgccggtgccggtggagcaggactactgggacgacgaggatgcttgcgacaacggggagtcggagtctgatgacatccccagcgaggagggcgacgacgaggagtcggagtatgatgacatccccagcgaggggggcgacgacgaggagacggagcatgatgacatccccagtgaggagggcgatgactgggagtcggagtatgaagacgtccccaacgaggaggacgacggctcctcgccggcgcccgacggcagtagccaggaaatcaccgcggcctctccggagtttgttagttctgtcagggatctgtccctgagctgtctaagattagattagattagattagattatattaggaagtgttagtccggttaggatctggatagtttgtttagattcagttgagggtttattgggtatatatatacctacgtacgttagcttcctgtactcagattggaataagaaagcttagttatattcc

SEQ ID NO: 976 - protein, 286 aa, Zea mays
  misc_feature (1)..(286): Ceres SEEDLINE ID no.ME12954
  misc_feature (1)..(286): Ceres CLONE ID no.225681
  misc_feature (1)..(286): Bit score of 729.4 for HMM based on sequences of FIGURE 32.
  misc_feature (132)..(173): Pfam Name: zf-C3HC4 Pfam Description: Zinc finger, C3HC4 type (RING finger)
MALHLNTVIDLTVDNYWLFRIPPITIDFLNKLPQQSEAPTPASAVTAQLTRRFTCSTGDFVLYRQPQRVEEMVTAAGLPLECAPSVAEFISLSVRSNSYRKPVVMTVEVGAPVDEDEDEDEELPPGAVFEECAICYKEYLVGGATSVKLACSHTFHRKCLDRWTAVNRTCPYCRAPVPVEQDYWDDEDACDNGESESDDIPSEEGDDEESEYDDIPSEGGDDEETEHDDIPSEEGDDWESEYEDVPNEEDDGSSPAPDGSSQEITAASPEFVSSVRDLSLSCLRLD

SEQ ID NO: 977 - DNA, 724 bp, Brassica napus
  misc_feature (1)..(724): Ceres CLONE ID no.957229
  misc_feature (1)..(724): Encodes the peptide sequence at SEQ ID NO 978
  misc_feature (618)..(618): y is t/u or c
  misc_feature (625)..(625): m is a or c
aaacgctcatactcctaacccctctcaacttttcaaaccaaacctctcttctctctttactctctgcaatggcgcgccttctctttcgtcttctccaagaaaccaattctccgacaccggcaacaccttctccggccttatattccgatctcgtggtcgtcatagctgctcttctctgtgcactgatctgcgtcctcggcttactcgccgtctctcgttgcgtctggctccgtcgtatcgcaaacagatccgccacgaattctgatcaaccgccggctaacaaagggttgaagaagaaagtcctaaagtctctgccgaagctcacctactcgccggactctcccccggctgagaagtttgccgagtgcgccatctgtcttatggaattcgccgccggcgatgagctcagggtgttgtcacagtgtggtcacggcttccacgtgtcatgtatcgacacgtggctcgggtctcactcttcttgtccttcctgccgtcagatcttggtggggattgccaggtgtcaaaaatgcggcgggttacccggtagctcgagttcaggacccgaacctgatacccgaatcaagcaagatgatcctaatagtaataataatgataatytatctcmccttaattagttttttagatatttccattaaaattgttcctttcattttaataatgtatatatttacttgttttaaatggatttatgtattggaaagtt

SEQ ID NO: 978 - protein, 188 aa, Brassica napus
  misc_feature (1)..(188): Ceres CLONE ID no.957229
  misc_feature (1)..(188): Bit score of 347.3 for HMM based on sequences of FIGURE 32.
  misc_feature (100)..(141): Pfam Name: zf-C3HC4 Pfam Description: Zinc finger, C3HC4 type (RING finger)
  misc_feature (1)..(188): Functional Homolog Of Ceres SEEDLINE ID no. ME12954 at SEQ ID NO: 976
  misc_feature (184)..(184): Xaa is any aa, unknown or other
  misc_feature (186)..(186): Xaa is any aa, unknown or other
MARLLFRLLQETNSPTPATPSPALYSDLVVVIAALLCALICVLGLLAVSRCVWLRRIANRSATNSDQPPANKGLKKKVLKSLPKLTYSPDSPPAEKFAECAICLMEFAAGDELRVLSQCGHGFHVSCIDTWLGSHSSCPSCRQILVGIARCQKCGGLPGSSSSGPEPDTRIKQDDPNSNNNDNXSXLN

SEQ ID NO: 979 - DNA, 669 bp, Populus balsamifera subsp. trichocarpa
  misc_feature (1)..(669): Ceres ANNOT ID no.1496202
  misc_feature (1)..(669): Encodes the peptide sequence at SEQ ID NO 980
atggcaccgtcaaccatttatcaataccatatgcgccaagatttcagcaccaacgttgacagcaacaattccacagccccaaccaccgatgcaatcatcatccacttacaattcagccatgttcttgaactatgttaccccgaaaccatacaaataccattaaacacaaccaacgaatcccacctatttccacgccagctcttttcatcacatgtaaatcgtgagagtatcgttaaagaaatactttctagcatgggttgttcatcagacttcattgagagtgctgcccctgatatctcctcttttgctttagacatggttactaatccatgcaatgctagtagtagcgaggtactaactatggttttggccatccatgttactactccttatgatgaacgtgaagagattgatcgtgctttaagcgaatctttaatgcaagaagcttcaagattcaagcctgctagtaaatcatgtattgatgggttaaaaagaatgagtcttgagggttcgtgttcaatgaaagaatgcatggtatgcttggaggaattcttgatgggtagcgaggttgtgtgtttgccttgtgggcatatttttcatggagattgtattgttaggtggctggagactagccacttgtgccctttgtgccggtttgccatgccttga

SEQ ID NO: 980 - protein, 222 aa, Populus balsamifera subsp. trichocarpa
  misc_feature (1)..(222): Ceres ANNOT ID no.1496202
  misc_feature (1)..(222): Bit score of 470.0 for HMM based on sequences of FIGURE 32.
  misc_feature (177)..(217): Pfam Name: zf-C3HC4 Pfam Description: Zinc finger, C3HC4 type (RING finger)
  misc_feature (1)..(222): Functional Homolog Of Ceres SEEDLINE ID no. ME12954 at SEQ ID NO: 976
MAPSTIYQYHMRQDFSTNVDSNNSTAPTTDAIIIHLQFSHVLELCYPETIQIPLNTTNESHLFPRQLFSSHVNRESIVKEILSSMGCSSDFIESAAPDISSFALDMVTNPCNASSSEVLTMVLAIHVTTPYDEREEIDRALSESLMQEASRFKPASKSCIDGLKRMSLEGSCSMKECMVCLEEFLMGSEVVCLPCGHIFHGDCIVRWLETSHLCPLCRFAMP

SEQ ID NO: 981 - DNA, 736 bp, Zea mays
  misc_feature (1)..(736): Ceres SEEDLINE ID no.ME12970
  misc_feature (1)..(736): Ceres CLONE ID no.1387146
  misc_feature (1)..(736): Inplanta Sequence
  misc_feature (1)..(736): Encodes the peptide sequence at SEQ ID NO. 982
attcttttgtaagaaaaaagatcagaaggaaagaagagaagaaaaatgccgcatggaacgcttgaagttgttcttgtcagtgccaaaggtctggaggattctgattttctgaatagcatggatccttatgtgctcctcacttgccggactcaagatcagaagagcaatgttgcctcaggacaaggcacaactcctgagtggaatgagacatttatcttcaatgtctctgaaggaactacagagttaaaagccaaaatatttgacacagatgttggcacagaggatgatccccttggtgaagcaactattccattggaggcggttttcctggaaggagatatcccaccagctgcatacaatgtcgtgaaggatgaggagttcaaaggcgagatctggatcgcactatccttcaaaccttcggaaaaccgaagcaggggtttcgaagaggagtcttatggaggctggaaaaactctgaagcttcttactaaagaggaagaacagtaaatgtgtgttgctctttaatttattgagtcttgggaataaaatgttgagcttcccctcttggaaaggattttgttaagaccgtttcttcttattaatattattgttctgttcggtttgaaattcaaaactcttgagaatttgattcttttgtcaagaatttgtttcagtcttttttttttctttggtaatcaatttgtttcagtcttgttttggtatttaagaaaatattat

SEQ ID NO: 982 - protein, 147 aa, Zea mays
  misc_feature (1)..(147): Ceres SEEDLINE ID no.ME12970
  misc_feature (1)..(147): Ceres CLONE ID no.1387146
  misc_feature (1)..(147): Bit score of 357.6 for HMM based on sequences of FIGURE 33.
  misc_feature (6)..(87): Pfam Name: C2 Pfam Description: C2 domain
MPHGTLEVVLVSAKGLEDSDFLNSMDPYVLLTCRTQDQKSNVASGQGTTPEWNETFIFNVSEGTTELKAKIFDTDVGTEDDPLGEATIPLEAVFLEGDIPPAAYNVVKDEEFKGEIWIALSFKPSENRSRGFEEESYGGWKNSEASY

SEQ ID NO: 983 - DNA, 916 bp, Gossypium hirsutum
  misc_feature (1)..(916): Ceres CLONE ID no.1935438
  misc_feature (1)..(916): Encodes the peptide sequence at SEQ ID NO 984
attttgaatttataattgtatctaaactctccaattttttaaaggaatcttcaagccgtgatcaatggaaaactctactagtttgtccgcacatgtgataattccttttacaatatctttgtaaaaagctttatttagaaagagaatccaaagagatagaaagcaaaatcattctcctttatatatattggtctctgggatctgaatttttttgacacagttttctttctttctttttctcggtttctactctccaaaacatcatgcctcagggaaagcttcaagttgtccttgttagtgccaaaggtctcgagaacacagattttctctgtaacatggatccttacgtgcttcttacttgccgaacccaggagcagaaaagcagtgttgcatcaggaaaaggatcagaaccagaatggaacgaggatttcatattcaacatctccgaaggtgcttcggaactcgcactgaaaataatggacagtgatgctggttctcaggatgatttcgtggaagaagtagctataccactggagcctgtatttatcgaaagaaacattcccctgactccatatactgttgtcaaggatggagaatatcgtggggagattaaatttggtctcactttcacccccgaggaacgtgaaagcagggattttgaagttgaagaatcttttggagggtggaagcagtcttcatacactgattaggcaggccacttatagttttcagccttaattcccgtttcaagaagtaactattaagtttgattttcggaccatgtttggttggatgttattaccatgttgtctttttactgccgttaattgtgacactgggaaattgtcactgattgaaatgtttgcctaatttgtactctggagatttagtgacatgttggttcttggatttgagc

SEQ ID NO: 984 - protein, 148 aa, Gossypium hirsutum
  misc_feature (1)..(148): Ceres CLONE ID no.1935438
  misc_feature (1)..(148): Bit score of 354.1 for HMM based on sequences of FIGURE 33.
  misc_feature (6)..(87): Pfam Name: C2 Pfam Description: C2 domain
  misc_feature (1)..(148): Functional Homolog Of Ceres SEEDLINE ID no. ME12970 at SEQ ID NO: 982
MPQGKLQVVLVSAKGLENTDFLCNMDPYVLLTCRTQEQKSSVASGKGSEPEWNEDFIFNISEGASELALKIMDSDAGSQDDFVEEVAIPLEPVFIERNIPLTPYTVVKDGEYRGEIKFGLTFTPEERESRDFEVEESFGGWKQSSYTD

SEQ ID NO: 985 - protein, 150 aa, Cucurbita maxima
  misc_feature (1)..(150): Public GI ID no.117573664
  misc_feature (1)..(150): Bit score of 301.3 for HMM based on sequences of FIGURE 33.
  misc_feature (6)..(92): Pfam Name: C2 Pfam Description: C2 domain
  misc_feature (1)..(150): Functional Homolog Of Ceres SEEDLINE ID no. ME12970 at SEQ ID NO: 982
MGMGMLEVHLISGKGLQAHDPLNKPIDPYVDINYKGQERMSGVAKNGGPNPLWDEKFKFLAEYPGSGGDFHILFKVMDHDAIDGDDYIGDVKIDVKDLLAEGVRKGWSEIPPRMYHVLAHKIHFKGEIEVGVSFKLQGGGGCGGCNPWEN

SEQ ID NO: 986 - protein, 138 aa, Cucurbita maxima
  misc_feature (1)..(138): Public GI ID no.117573666
  misc_feature (1)..(138): Bit score of 265.8 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MGMGMLEVHLISGKGLQAHDPLNKPIDPYVDINYKGQERMSGVAKNAGPDPVWNEKFKFLAEYPGSGGDFHILFKVMDHDVIDGDDYIGDVKIDVKDLLAEGIRNGWSELPPRMYQVIAHKRYFKGEIEVGVFFQRQG

SEQ ID NO: 987 - protein, 150 aa, Cucurbita maxima
  misc_feature (1)..(150): Public GI ID no.25090878
  misc_feature (1)..(150): Bit score of 288.8 for HMM based on sequences of FIGURE 33.
  misc_feature (6)..(92): Pfam Name: C2 Pfam Description: C2 domain
  misc_feature (1)..(150): Functional Homolog Of Ceres SEEDLINE ID no. ME12970 at SEQ ID NO: 982
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 988 - protein, 150 aa, Cucurbita maxima
  misc_feature (1)..(150): Public GI ID no.68349004
  misc_feature (1)..(150): Bit score of 290.2 for HMM based on sequences of FIGURE 33.
  misc_feature (6)..(92): Pfam Name: C2 Pfam Description: C2 domain
  misc_feature (1)..(150): Functional Homolog Of Ceres SEEDLINE ID no. ME12970 at SEQ ID NO: 982
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCNPWEN

SEQ ID NO: 989 - protein, 138 aa, Cucurbita maxima
  misc_feature (1)..(138): Public GI ID no.25090875
  misc_feature (1)..(138): Bit score of 260.9 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 990 - protein, 138 aa, Cucurbita maxima
  misc_feature (1)..(138): Public GI ID no.68349008
  misc_feature (1)..(138): Bit score of 256.5 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MGMGMMEVHLISGKGLQALDPLNKPIDPYAEINFKGQERMSKVAKNAGPDPIWNEKFKFLVEYPGSGGDFHILFKVMDHDAIDGDDYIGDVIIDVQNLLAEGVRKGWSELPPRMYQVLAHKIYFKGEIEVGVFFQRQG

SEQ ID NO: 991 - protein, 138 aa, Cucurbita moschata
  misc_feature (1)..(138): Public GI ID no.68349002
  misc_feature (1)..(138): Bit score of 279.3 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MAMGMLEVHLISGKGLRAHDPLNKPIDPYVEINYKGQERMSKVAKNAGPDPVWNEKFKFLAEYPGSGGDFLILFKVMDHDVIDGDDYIGDVSIDVKDLLVEGVRKGWSELPPRMYQVIAHKLYFKGEIEVGVSFKRQG

SEQ ID NO: 992 - protein, 150 aa, Cucurbita moschata
  misc_feature (1)..(150): Public GI ID no.68348998
  misc_feature (1)..(150): Bit score of 299.5 for HMM based on sequences of FIGURE 33.
  misc_feature (6)..(92): Pfam Name: C2 Pfam Description: C2 domain
  misc_feature (1)..(150): Functional Homolog Of Ceres SEEDLINE ID no. ME12970 at SEQ ID NO: 982
MAMGMLEVHLISGKGLQAHDPLNKPIDPYVEINYKGQERMSKVAKNAGPDPLWDEKFKFLAEYPGSGGDFHVLFKVMDHDAIDGDDYIGDVKIDVKDLLAEGVRKGWSEIRPRMYHVLAHKIHFKGEIEVGVSFKLQGGGGCAGCYPWEN

SEQ ID NO: 993 - protein, 138 aa, Cucurbita moschata
  misc_feature (1)..(138): Public GI ID no.68349000
  misc_feature (1)..(138): Bit score of 261.4 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MGMGMLEVHLISGKGLQAHDPLNKPIDPYAEINYKGQERMSKVAKNAGPDPLWDEKFKFLAEYPGSGGDFHIFFKVMDHDAIDDDDLIGEVKIDIKDLLAEGVRKGWSKIPPRMYQVLLLNLYFKGEIEVGVSFQRQG

SEQ ID NO: 994 - DNA, 489 bp, Populus balsamifera subsp. trichocarpa
  misc_feature (1)..(489): Ceres ANNOT ID no.1497170
  misc_feature (1)..(489): Encodes the peptide sequence at SEQ ID NO 995
atgcctgaagggactattcaagttgttcttgtcggagccaaaggtctcgagaacaccgatttcttcaattatagggttccctgcaatgatgtcaaaacatatccatccaatatcgatccatatgtgcttctcacttgccgatctcaggagcaaagaagcagtgttgcttcaggacaaggatctgaaccagaatggaatgaaaccttcgtttttaccatttccgagggtacttcagaactcgttctgaagatagtggatcatgacactctcacggatgatgattaccttggaaaagcaagcattcctttggagccactattcatagaaggaaatctgccaacaactgcatacaatgttgtcaaggacgaggagtaccgtggagagatcagagttggccttagttttactcccgagcgtcgcactagtaggacatttgatgctggggaggagagttatggaggctggaaagaatcagcttacacagattga

SEQ ID NO: 995 - protein, 162 aa, Populus balsamifera subsp. trichocarpa
  misc_feature (1)..(162): Ceres ANNOT ID no.1497170
  misc_feature (1)..(162): Bit score of 345.7 for HMM based on sequences of FIGURE 33.
  misc_feature (6)..(100): Pfam Name: C2 Pfam Description: C2 domain
  misc_feature (1)..(162): Functional Homolog Of Ceres SEEDLINE ID no. ME12970 at SEQ ID NO: 982
MPEGTIQVVLVGAKGLENTDFFNYRVPCNDVKTYPSNIDPYVLLTCRSQEQRSSVASGQGSEPEWNETFVFTISEGTSELVLKIVDHDTLTDDDYLGKASIPLEPLFIEGNLPTTAYNVVKDEEYRGEIRVGLSFTPERRTSRTFDAGEESYGGWKESAYTD

SEQ ID NO: 996 - protein, 147 aa, Arabidopsis thaliana
  misc_feature (1)..(147): Public GI ID no.15221718
  misc_feature (1)..(147): Bit score of 363.4 for HMM based on sequences of FIGURE 33.
  misc_feature (6)..(87): Pfam Name: C2 Pfam Description: C2 domain
  misc_feature (1)..(147): Functional Homolog Of Ceres SEEDLINE ID no. ME12970 at SEQ ID NO: 982
MPHGTLEVVLVSAKGLEDADFLNNMDPYVQLTCRTQDQKSNVAEGMGTTPEWNETFIFTVSEGTTELKAKIFDKDVGTEDDAVGEATIPLEPVFVEGSIPPTAYNVVKDEEYKGEIWVALSFKPSENRSRGMDEESYGGWKNSEASY

SEQ ID NO: 997 - DNA, 697 bp, Arabidopsis thaliana
  misc_feature (1)..(697): Ceres CLONE ID no.18965
  misc_feature (1)..(697): Encodes the peptide sequence at SEQ ID NO 998
atcgaacaaatcagacaaaagcctcgcatctctctctcttgggatctgaatcttcaaattgaaaacaaaaagatcacaagagaaaaaaccaaaaaaaaatgcctcatggaactcttgaagttgttcttgtcagcgccaaaggtctcgaggacgcagattttctgaataacatggatccttatgtgcaactcacttgtcggactcaagatcagaagagcaacgttgcagaaggaatggggacaactccggaatggaatgagacatttatcttcactgtgtctgaaggaactacagagttaaaagcgaaaatcttcgacaaagatgtcggtacagaggatgatgcggttggtgaagcaactattccgttggagccggttttcgtggaaggaagtattccaccaactgcatacaatgtggtgaaagatgaagagtacaaaggagagatttgggtggctctctccttcaagccctcgggaaaccgaagcaggggtatggacgaggagtcctatgggggctggaaaaactctgaagcatcatactaagagaagaaaccattgtgcgtgtcactgtttgatttgagtcttgggaacaaaatgttgagttttcatttgaaagcgtattttttgttcagattgtttttaatgatttcataaactcgtgagatttttgattcttcttttctagaacttgttttggt

SEQ ID NO: 998 - protein, 147 aa, Arabidopsis thaliana
  misc_feature (1)..(147): Ceres CLONE ID no.18965
  misc_feature (1)..(147): Bit score of 361.8 for HMM based on sequences of FIGURE 33.
  misc_feature (6)..(87): Pfam Name: C2 Pfam Description: C2 domain
  misc_feature (1)..(147): Functional Homolog Of Ceres SEEDLINE ID no. ME12970 at SEQ ID NO: 982
MPHGTLEVVLVSAKGLEDADFLNNMDPYVQLTCRTQDQKSNVAEGMGTTPEWNETFIFTVSEGTTELKAKIFDKDVGTEDDAVGEATIPLEPVFVEGSIPPTAYNVVKDEEYKGEIWVALSFKPSGNRSRGMDEESYGGWKNSEASY

SEQ ID NO: 999 - DNA, 617 bp, Arabidopsis thaliana
  misc_feature (1)..(617): Ceres CLONE ID no.15814
  misc_feature (1)..(617): Encodes the peptide sequence at SEQ ID NO 1000
aaaatcagacaaaagcctcgcatctctctctcttgggatctgaatcttcaaattgaaaacaaaaagatcacaagagaaaaaaccaaaaaaaaatgcctcatggaactcttgaagttgttcttgtcagcgccaaaggtctcgaggacgcagattttctgaatcagaagagcaacgttgcagaaggaatggggacaactccggaatggaatgagacatttatcttcactgtgtctgaaggaactacagagttaaaagcgaaaatcttcgacaaagatgtcggtacagaggatgatgcggttggtgaagcaactattccgttggagccggttttcgtggaaggaagtattccaccaactgcatacaatgtggtgaaagatgaagagtacaaaggagagatttgggtggctctctccttcaagccctcggaaaaccgaagcaggggtatggacgaggagtcctatgggggctggaaaaactctgaagcatcatactaagagaagaaaccattgtgcgtgtcactgtttgatttgagtcttgggaacaaaattttgagttttcatttgaaagcgtattttttgttcagattgtttttaatgatttcataaactcgtgagatt

SEQ ID NO: 1000 - protein, 133 aa, Arabidopsis thaliana
  misc_feature (1)..(133): Ceres CLONE ID no.15814
  misc_feature (1)..(133): Bit score of 292.8 for HMM based on sequences of FIGURE 33.
  misc_feature (36)..(73): Pfam Name: C2 Pfam Description: C2 domain
  misc_feature (1)..(133): Functional Homolog Of Ceres SEEDLINE ID no. ME12970 at SEQ ID NO: 982
MPHGTLEVVLVSAKGLEDADFLNQKSNVAEGMGTTPEWNETFIFTVSEGTTELKAKIFDKDVGTEDDAVGEATIPLEPVFVEGSIPPTAYNVVKDEEYKGEIWVALSFKPSENRSRGMDEESYGGWKNSEASY

SEQ ID NO: 1001 - protein, 143 aa, Cicer arietinum
  misc_feature (1)..(143): Public GI ID no.3860331
  misc_feature (1)..(143): Bit score of 331.6 for HMM based on sequences of FIGURE 33.
  misc_feature (6)..(87): Pfam Name: C2 Pfam Description: C2 domain
  misc_feature (1)..(143): Functional Homolog Of Ceres SEEDLINE ID no. ME12970 at SEQ ID NO: 982
MPRGTLEVVLISAKGLEDNDFLSSIDPYVILSYRAQEHKSTVQEGAGSNPQWNETFLFTVSDSASELNLRIMEKDNFNNDDNLGEAIIPLEAVFEEGSLAENAYKLVKEQEYCGEIKVALTFTPERNDEEETCGGWKESTRDF

SEQ ID NO: 1002 - DNA, 779 bp, Glycine max
  misc_feature (1)..(779): Ceres CLONE ID no.1075911
  misc_feature (1)..(779): Encodes the peptide sequence at SEQ ID NO 1003
ggatctacagcaatcagtctcgaccttcagtcgtgctgcctacccatcagcatataattcctgatcgagcgagcgggagaggaaggcgagatcagtcagatcaggcccggagagaagatggcgcaggggacgctggaggtgctgctcgtcggagccaagggactcgagaacaccgactacctctgcaacatggacccgtacgcggttctaaaatgcacatcgcaggagcagaagagcaccgtcgcctcaggaaagggaagtgatcctgaatggaacgaaacctttgtgttcaccgtctctgagaatgcaaccgagctcgtcatcaagctcctcgacagtgatggtggcacggacgacgacagcgttggtgaagcaacgatcccattggatggagtgtacactgaaggaagcatcccaccaactgtttacaatgttgtcaaagacgaagagtaccgtggagaaatcaaaatcggtctgacgttcactccggaggaggctcgtgatgaggatcaacccgaggaaaactacggtgggtggaaccaatcatcttgagaagaagtaggtgctttgctgaactgtggtgcgtgacaagtcgtgtgctagaactaaagcctattttaattgttaaagactgtatttatcattgattccatcaattatggataagctacaaatctccttattgattggtatcgttttctagtattcaaatttgtaataacagtgttccccacttgtatgaagtatgagccctctttaatgtcactaaattgatttgc

SEQ ID NO: 1003 - protein, 144 aa, Glycine max
  misc_feature (1)..(144): Ceres CLONE ID no.1075911
  misc_feature (1)..(144): Bit score of 348.3 for HMM based on sequences of FIGURE 33.
  misc_feature (6)..(87): Pfam Name: C2 Pfam Description: C2 domain
  misc_feature (1)..(144): Functional Homolog Of Ceres SEEDLINE ID no. ME12970 at SEQ ID NO: 982
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDEDQPEENYGGWNQSS

SEQ ID NO: 1004 - DNA, 714 bp, Glycine max
  misc_feature (1)..(714): Ceres CLONE ID no.1652402
  misc_feature (1)..(714): Encodes the peptide sequence at SEQ ID NO 1005
gttgtttcactcctctaattaacacacaatagaagccaattgtgcctctcagagctctttcagattctcccgtgtctcatcatccttccaatattcatcaagatgcctcagggaagcctcgaagtttttcttgttaacgccaaaggccttgaaaacactgattatctttgtaacatggacccttatgtgatcctcatatgtcgcactcaggagcaaaaaagcagtgttgcatcaggtcagggaagtgagccagaatggaacgaggcttttgtattcaacgtgtctgaaggcgtttccgatctgagattgaagatcatggacagtgattccaccacggctcatgatctcgttggagaagctaccattccactggatggattgtttatcgaaggaaatatcccaccaacttcatacaatgttgtcaaggatggccactattgtggggagattagaatcggcctcacttttactcctcaggatcgcagtgaacgctgcccagaggaaaattttgggggatggaaggagtctggttacagagactgattgtgttcatttatagcatttctgagtcatgactactggatccagtattaacttagttgcctattcaagaggatcttcacttttaaattgctttattgtcaattgattaaaattaataccacaaactctaaataattcttaggtcacaaataaattatatttttattttcc

SEQ ID NO: 1005 - protein, 146 aa, Glycine max
  misc_feature (1)..(146): Ceres CLONE ID no.1652402
  misc_feature (1)..(146): Bit score of 322.9 for HMM based on sequences of FIGURE 33.
  misc_feature (6)..(87): Pfam Name: C2 Pfam Description: C2 domain
  misc_feature (1)..(146): Functional Homolog Of Ceres SEEDLINE ID no. ME12970 at SEQ ID NO: 982
MPQGSLEVFLVNAKGLENTDYLCNMDPYVILICRTQEQKSSVASGQGSEPEWNEAFVFNVSEGVSDLRLKIMDSDSTTAHDLVGEATIPLDGLFIEGNIPPTSYNVVKDGHYCGEIRIGLTFTPQDRSERCPEENFGGWKESGYRD

SEQ ID NO: 1006 - DNA, 838 bp, Glycine max
  misc_feature (1)..(838): Ceres CLONE ID no.625129
  misc_feature (1)..(838): Encodes the peptide sequence at SEQ ID NO 1007
aaaaaggaaaaagttggatccagccaaaatccagctccaattggtaactcactgcttgaggcatttctggcactgttttttccacttttattttaactttaagactgcacagagagaagcatataattcctgagtcaatatagaatttgtgaagtcagtccaaacttcagtttcaaagatgcctcgtggaacgcttgaagttgttctgatcagcgccaaaggaatcgatgacaatgattttctctccagcattgatccttatgtgattctcacatacagggcacaggagaaaaagagcactgtgcaagaagatgctggatccaagccacaatggaatgagagctttcttttcactgtctctgacagtgcatctgaacttaatctaaagataatggataaagacaactttagtcaagatgattgtcttggcgtggcaaccattcatctggatccagtgtttgaagcgggtagtattccagaaactgcttacaaggttgtgaaggacgaagaatattgtggagagattaaggtggctctcacttttactgttgagaaaaatgaggagcaggattatgctgaacctgaagagagctatggtggatggaaagaatccagtggggaattttaaagtgaaagaagtatttacatacttccatggccagaattacccttataatgaaaaataagcagttttggggtactttttgagaatttccattattgtgttttctggtgtgaagcaatggtgttgtgctgttaggttgctttcctccctttggatatatattaaagtacattatgtttgatatattgtctttaatgcattagttaacatttt

SEQ ID NO: 1007 - protein, 149 aa, Glycine max
  misc_feature (1)..(149): Ceres CLONE ID no.625129
  misc_feature (1)..(149): Bit score of 309.5 for HMM based on sequences of FIGURE 33.
  misc_feature (6)..(87): Pfam Name: C2 Pfam Description: C2 domain
  misc_feature (1)..(149): Functional Homolog Of Ceres SEEDLINE ID no. ME12970 at SEQ ID NO: 982
MPRGTLEVVLISAKGIDDNDFLSSIDPYVILTYRAQEKKSTVQEDAGSKPQWNESFLFTVSDSASELNLKIMDKDNFSQDDCLGVATIHLDPVFEAGSIPETAYKVVKDEEYCGEIKVALTFTVEKNEEQDYAEPEESYGGWKESSGEF

SEQ ID NO: 1008 - protein, 156 aa, Oryza sativa
  misc_feature (1)..(156): Public GI ID no.2920839
  misc_feature (1)..(156): Bit score of 327.9 for HMM based on sequences of FIGURE 33.
  misc_feature (7)..(92): Pfam Name: C2 Pfam Description: C2 domain
  misc_feature (1)..(156): Functional Homolog Of Ceres SEEDLINE ID no. ME12970 at SEQ ID NO: 982
MAGSGVLEVHLVDAKGLTGNDFLGKIDPYVVVQYRSQERKSSVARDQGKNPSWNEVFKFQINSTAATGQHKLFLRLMDHDTFSRDDFLGEATINVTDLISLGMEHGTWEMSESKHRVVLADKTYHGEIRVSLTFTASAKAQDHAEQVGGWAHSFRQ

SEQ ID NO: 1009 - protein, 159 aa, Oryza sativa
  misc_feature (1)..(159): Public GI ID no.2920837
  misc_feature (1)..(159): Bit score of 314.4 for HMM based on sequences of FIGURE 33.
  misc_feature (7)..(95): Pfam Name: C2 Pfam Description: C2 domain
  misc_feature (1)..(159): Functional Homolog Of Ceres SEEDLINE ID no. ME12970 at SEQ ID NO: 982
MAGSGVLEVHLVDAKGLTGNDFLGEIGNIHPYVVVQYRSQERKSSVARDQGKNPSWNEVFKFQINSTAATGQHKLFLRLMDHDTFSRDDFLGEATINVTDLISLGMEHGTWEMSESKHRVVLADKTYHGEIRVSLTFTASAKAQDHAEQVGGWAHSFRQ

SEQ ID NO: 1010 - DNA, 712 bp, Triticum aestivum
  misc_feature (1)..(712): Ceres CLONE ID no.698452
  misc_feature (1)..(712): Encodes the peptide sequence at SEQ ID NO 1011
gacattcacccagaccaagagagagatccaggacttggccggccggccggagatcgagaaggaggaggagacatggtgcgcgggaagctggaggtgctgctcgtctccgccaagggcctcgacgactccgatttcttcaatagcatggacccgtacgtgatcctcacctgccgcagccacgagcagaaaagcaccgtcgcatcaggagcagggagcgagcctgagtggaacgagaccttcttcttcgccgtctccggcgactctccagagctcagggtcaagatcatggacagcgacgccctctcggccgacgacctcgtcggagaagcatgtatcccgctggaggctgtgctccaggagggcagcctgccgccggccgtgcaccgggtcgtcaaggacgaggagtaccgcggggagatcaagatcgcgctcaccttcaccccggcagaggaaaacgaggaggaggagagctacggcggctggaatcagtccacctgaaaaaggctggcgagccagcaagatggtgctgtatgtctgtcataatggataactgctttggatctccttgatgtgtgtgacagacagggcattcatcagaaaagcgagtaaaaataggggaaatatgtatcgatgcatgaagtactaatcaagcaactcaccgcatcattttgtaatgcacatcaatcaacaatgcttaagcaattcataatgg

SEQ ID NO: 1011 - protein, 141 aa, Triticum aestivum
  misc_feature (1)..(141): Ceres CLONE ID no.698452
  misc_feature (1)..(141): Bit score of 345.6 for HMM based on sequences of FIGURE 33.
  misc_feature (6)..(87): Pfam Name: C2 Pfam Description: C2 domain
  misc_feature (1)..(141): Functional Homolog Of Ceres SEEDLINE ID no. ME12970 at SEQ ID NO: 982
MVRGKLEVLLVSAKGLDDSDFFNSMDPYVILTCRSHEQKSTVASGAGSEPEWNETFFFAVSGDSPELRVKIMDSDALSADDLVGEACIPLEAVLQEGSLPPAVHRVVKDEEYRGEIKIALTFTPAEENEEEESYGGWNQST

SEQ ID NO: 1012 - DNA, 751 bp, Triticum aestivum
  misc_feature (1)..(751): Ceres CLONE ID no.1062021
  misc_feature (1)..(751): Encodes the peptide sequence at SEQ ID NO 1013
ctacagcgattagtctcgaccttcagtcgtgctgcctgctcatcagcatataattcctgatcgagcgagcgggagaggaaggcgagatcaggccgggagagaagatggcgcaggggacgctggaggtgctgctcgtcggagccaaggccctcgagaacaccgactacctctgcaacatggacccgtacgcggttctaaaatgcacctcgcaggagcagaagagcaccgtcgcctcaggaaagggaagtgatcctgagtggaacgaaacctttgtgttcaccgtctctgagaatgcaaccgagctcgtcatcaagcttctggacagtgatggtggcacggacgacgacagcgttggtgaagcaacgatcccattggatggagtgtacactgaaggaagcatcccaccaactgtttacaatgttgtcaaagacgaagagtaccgtggagaaatcaaaatcggtctgacgttcactccggaggaggctcgtgatcaggatcaacccgaggaaaactacggtgggtggaaccaatcatcttaagaagaagcaggtgctttgctgaactatggtgcgtgacaagtcgtgtgctagaactaaagcttattttaattgttaaagactgtatttgtcgttgattccgtcaattatgtataagctacaaatctccttattgattggtatcattttctaatcttcaaatttgtaataatagtgttccccacttgtatgaagtatgagccctttttaatgtc

SEQ ID NO: 1013 - protein, 144 aa, Triticum aestivum
  misc_feature (1)..(144): Ceres CLONE ID no.1062021
  misc_feature (1)..(144): Bit score of 341.5 for HMM based on sequences of FIGURE 33.
  misc_feature (6)..(87): Pfam Name: C2 Pfam Description: C2 domain
  misc_feature (1)..(144): Functional Homolog Of Ceres SEEDLINE ID no. ME12970 at SEQ ID NO: 982
MAQGTLEVLLVGAKALENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDQDQPEENYGGWNQSS

SEQ ID NO: 1014 - DNA, 940 bp, Zea mays
  misc_feature (1)..(940): Ceres CLONE ID no.896122
  misc_feature (1)..(940): Encodes the peptide sequence at SEQ ID NO 1015
  misc_feature (593)..(593): m is a or c
  misc_feature (601)..(601): m is a or c
  misc_feature (609)..(609): m is a or c
  misc_feature (617)..(617): s is g or c
  misc_feature (650)..(650): s is g or c
  misc_feature (678)..(678): y is t/u or c
  misc_feature (696)..(696): r is g or a
  misc_feature (762)..(762): y is t/u or c
  misc_feature (806)..(806): y is t/u or c
  misc_feature (849)..(849): y is t/u or c
  misc_feature (911)..(911): y is t/u or c
  misc_feature (938)..(938): y is t/u or c
ccgcctccatgcgaggaaggtagccagacgcgtataaagggcagccagaaattcggatccacctgtatgcgtctccgttcgttcacgccacaggcaaggcacaggggcttgtgagggagagcgaggagcggaggaggacatggtgcacgggacgctggaagtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagcttatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatactcgccagcggggtctcccagaggacttcggtggatggaagcaatcatcttagagctagatgctttaagggtgcmccagagcmcagcgacmattcatgsgcttggagccttcagccgtcgagtacttcatgstaatgcagaattcattcgatttggcttyttttgattgtttcagaaraagtgttattagtgagtttcaacaaaaaatagctccatattgctctatatcccgtattggaaattytaaggccgtttgtgattactgcttacaacaagaagttttgcttytaattccccctacgcttttttttgaagttttgagtggaacatytttgtgttcaacgtttggggaggtgtaggccagtaatactgcaagaaaggaataatttcccytgcagcaacattgttttttgtgatccytg

SEQ ID NO: 1015 - protein, 143 aa, Zea mays
  misc_feature (1)..(143): Ceres CLONE ID no.896122
  misc_feature (1)..(143): Bit score of 325.2 for HMM based on sequences of FIGURE 33.
  misc_feature (6)..(87): Pfam Name: C2 Pfam Description: C2 domain
  misc_feature (1)..(143): Functional Homolog Of Ceres SEEDLINE ID no. ME12970 at SEQ ID NO: 982
MVHGTLEVLLVGAKGLENTDYLCNMDPYAILKCRSQEQKSSIATGKGTTPEWNENFIFTVSDRTTDLVIKLMDSDTGTADDFVGEATIPLEAVYTERSIPPTLYNVVKGEKYCGEIKVGLTFTPEDTRQRGLPEDFGGWKQSS

SEQ ID NO: 1016 - protein, 143 aa, Zea mays
  misc_feature (1)..(143): Public GI ID no.1498055
  misc_feature (1)..(143): Bit score of 312.3 for HMM based on sequences of FIGURE 33.
  misc_feature (6)..(86): Pfam Name: C2 Pfam Description: C2 domain
  misc_feature (1)..(143): Functional Homolog Of Ceres SEEDLINE ID no. ME12970 at SEQ ID NO: 982
MVHGKLEVLLVSAKGLEDTDFLNNMDPFVILTCRTQEQKSSVANGAGSEPEWNETFVFTVSDDTPQLHLKIMDSDLTNDDFVGERTIPLEAVFQEGSLPPAVHPVVKEEKYCGEVKLALTFTPAAETRRPDDNEEGPPYSSWS

SEQ ID NO: 1017 - DNA, 757 bp, Zea mays
  misc_feature (1)..(757): Ceres CLONE ID no.379263
  misc_feature (1)..(757): Encodes the peptide sequence at SEQ ID NO 1018
atctcgcaatcgaggcgtttttttctgcttcgtaagttcgtggtcgatccagcgagcgagcgagcagaccggcggctaaccgcggagggagagatggcgcaggggacgctggaggtgcttctcgtcggagccaggggcctcgagaacaccgattacctgagcaacatggacccctacgcgcttctgcaatgtcgctcccacgagcagaagagcagcgtcgcatctggcaaaggctgtgaacctgagtggaacgagaccttcgtgttcaccgtctccgatggcgcagcagagctgttcatcaagctcctggacagtgacggtggcactgatgacgattttgttggtgaggcaacgattcctctggaagcagtttacacggaaggaaacatccctccgactgtttacaatgttgtgaaagacgaagaataccgcggagaaatcaaagttggcctcacgttcactccagaggaccagggcttctgaggaataacttggcgtgtggccgctggaactggaggcagcaggcagtcgtcttatgattcagaagcaaacgacggatcgattcccttgatgtactgcagtccagtgagcgtgcatctacaacttgtagaagaagcctgcaacatgatcacgggatcctgtactgcatcactctaaagcctagctaaaaccaccagctcctgtacttgatgccgggcgggcttgtcatgtactgaaacctacaataacggtcgccgaaccccactctttgatgttc

SEQ ID NO: 1018 - protein, 129 aa, Zea mays
  misc_feature (1)..(129): Ceres CLONE ID no.379263
  misc_feature (1)..(129): Bit score of 292.5 for HMM based on sequences of FIGURE 33.
  misc_feature (6)..(87): Pfam Name: C2 Pfam Description: C2 domain
  misc_feature (1)..(129): Functional Homolog Of Ceres SEEDLINE ID no. ME12970 at SEQ ID NO: 982
MAQGTLEVLLVGARGLENTDYLSNMDPYALLQCRSHEQKSSVASGKGCEPEWNETFVFTVSDGAAELFIKLLDSDGGTDDDFVGEATIPLEAVYTEGNIPPTVYNVVKDEEYRGEIKVGLTFTPEDQGF

SEQ ID NO: 1019 - protein, 128 aa, Zea mays
  misc_feature (1)..(128): Public GI ID no.5565983
  misc_feature (1)..(128): Bit score of 299.6 for HMM based on sequences of FIGURE 33.
  misc_feature (6)..(86): Pfam Name: C2 Pfam Description: C2 domain
  misc_feature (1)..(128): Functional Homolog Of Ceres SEEDLINE ID no. ME12970 at SEQ ID NO: 982
MVHGKLEVLLVSAKGLEDTDFLNNMDPFVILTCRTQEQKSSVANGAGSEPEWNETFVFTVSDDTPQLHLKIMDSDLTNDDFVGEATIPLEAVFQEGSLPPAVHPVVKEEKYCGEVKLALTFTPAAETR

SEQ ID NO: 1020 - DNA, 747 bp, Zea mays
  misc_feature (1)..(747): Ceres CLONE ID no.218566
  misc_feature (1)..(747): Encodes the peptide sequence at SEQ ID NO 1021
aaaaaaccaaaagcagaggggaaagtgccgtcggctctgactcttgggcacttggctgacgacccgttctctctctgcaactgcaactgcaacgcaccaagaaactgccggcgatcgatcggggaaggagataaacatggtgcacgggaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgaatggaacgagaccttcgtcttcaccgtctccgacgacaccccgcagctgcacctcaagatcatggacagcgacctcaccaacgacgatttcgtcggcgaagcaaccatccccctggaggccgtgtttcaggaaggcagccttcccccggcggttcacccggtcgtcaaggaggagaagtactgcggagaggtcaagctcgctcaccttcactccagcagcggaaactcgccgccctgatgacaacgaggaggggccgccttacagcagctggagttgatctatctgccatgggatgcatgcatcatatatatccaccaagagaagagaggataattaattaatctactcaagagaagaatcagtgttgctgttatgcgaccctctatctatctatatatatgtgcttaatttgtcataacgactgccaatataaaataaactattcagagttgtttgcc

SEQ ID NO: 1021 - protein, 129 aa, Zea mays
  misc_feature (1)..(129): Ceres CLONE ID no.218566
  misc_feature (1)..(129): Bit score of 270.3 for HMM based on sequences of FIGURE 33.
  misc_feature (6)..(86): Pfam Name: C2 Pfam Description: C2 domain
  misc_feature (1)..(129): Functional Homolog Of Ceres SEEDLINE ID no. ME12970 at SEQ ID NO: 982
MVHGKLEVLLVSAKGLEDTDFLNNMDPFVILTCRTQEQKSSVANGAGSEPEWNETFVFTVSDDTPQLHLKIMDSDLTNDDFVGEATIPLEAVFQEGSLPPAVHPVVKEEKYCGEVKLAHLHSSSGNSPP

SEQ ID NO: 1022 - DNA, 683 bp, Panicum virgatum
  misc_feature (1)..(683): Ceres CLONE ID no.2019456
  misc_feature (1)..(683): Encodes the peptide sequence at SEQ ID NO 1023
atgtgccatgacttgctgtattgccaaggggaaagtgtcatcgtccttcagttcttccaacctctgaatctctctgcatctgtgtgatcgaggaagaaaggaggagccaacaaacatggtgcacgggaagctggaggttctccttgtctccgccaagggccttgaggacaccgatttcctcaataacatggacccctacgtgatccttacatgccgcacccaggagcagaaaagcagcgttgcaaatggagaaggaagtgaacctgaatggaacgaaaccttcatcttcacggtctctgacgataccccgcagcttaatctcaagatcatggacagcgacgtcaccaacgatgatttcgttggtgaagcaagcatccccctggaggctgtgtttcaggaaggcagccttcccccgacagttcacccagtcgtcaaggaggagaaatactgcggagagatcaagcttgcactcaccttcactccagcagtggaaactcgccgcccggacaacgaggagggtacttacagcagctggaattgatctgcccgatgtgtgcactgagcaataacataatttactgaagaattactgctgttatgcaacactattttgctttgtcatgaactgaatatttgcatgtaacttccagcattgtgataactattccgaattgttgctttgc

SEQ ID NO: 1023 - protein, 141 aa, Panicum virgatum
  misc_feature (1)..(141): Ceres CLONE ID no.2019456
  misc_feature (1)..(141): Bit score of 341.4 for HMM based on sequences of FIGURE 33.
  misc_feature (6)..(86): Pfam Name: C2 Pfam Description: C2 domain
  misc_feature (1)..(141): Functional Homolog Of Ceres SEEDLINE ID no. ME12970 at SEQ ID NO: 982
MVHGKLEVLLVSAKGLEDTDFLNNMDPYVILTCRTQEQKSSVANGEGSEPEWNETFIFTVSDDTPQLNLKIMDSDVTNDDFVGEASIPLEAVFQEGSLPPTVHPVVKEEKYCGEIKLALTFTPAVETRRPDNEEGTYSSWN

SEQ ID NO: 1024 - DNA, 720 bp, Panicum virgatum
  misc_feature (1)..(720): Ceres CLONE ID no.1803216
  misc_feature (1)..(720): Encodes the peptide sequence at SEQ ID NO 1025
gtctgcgtctccgttcgttcgcgccacaggcaagggataggagctcgtgaggaagagcgaggaggaggacgacatggtgcacgggacgctggaggtgctgctcgtcggcgccaagggcctcgagaacaccgattacctctgcaacatggatccgtatgcgattctcaagtgccgatcacaggagcagaggagcagtattgcagctggaaaaggaactaaccctgagtggaatgaaaactttgtcttcactgtgtccgaccgaactacagacttgataatcaagcttatggatagtgatacaggcacagcagatgactttgtaggtgaagcaatgattccgctggaagcagtgtattcggaaaggagcattccaccaacgatctataatgttgtgaaaggtgaaaaatactgtggcggaatcaaagttggtctcacatttactcccgaggatactcgccagaggggtctcccggatgactgcggtggatggaagcaatctcgctaagaagggcagcaagatcttttgatatttcaccagagcaacagtgataatttgtgtgcttgaggcattcagccctcgaacacgttcacgcttgtgcaacatgaaattcagttgatttggcctctttaaatgtttgaaaagatgtgttattagcgagtttaaattaaaagcatcgtcatattgttgcatcaatacagttcgttaagattggaaatttc

SEQ ID NO: 1025 - protein, 143 aa, Panicum virgatum
  misc_feature (1)..(143): Ceres CLONE ID no.1803216
  misc_feature (1)..(143): Bit score of 312.5 for HMM based on sequences of FIGURE 33.
  misc_feature (6)..(87): Pfam Name: C2 Pfam Description: C2 domain
  misc_feature (1)..(143): Functional Homolog Of Ceres SEEDLINE ID no. ME12970 at SEQ ID NO: 982
MVHGTLEVLLVGAKGLENTDYLCNMDPYAILKCRSQEQRSSIAAGKGTNPEWNENFVFTVSDRTTDLIIKLMDSDTGTADDFVGEAMIPLEAVYSERSIPPTIYNVVKGEKYCGGIKVGLTFTPEDTRQRGLPDDCGGWKQSR

SEQ ID NO: 1026 - protein, 163 aa, Oryza sativa subsp. indica
  misc_feature (1)..(163): Public GI ID no.90399071
  misc_feature (1)..(163): Bit score of 240.3 for HMM based on sequences of FIGURE 33.
  misc_feature (1)..(63): Pfam Name: C2 Pfam Description: C2 domain
  misc_feature (1)..(163): Functional Homolog Of Ceres SEEDLINE ID no. ME12970 at SEQ ID NO: 982
MDPYVILTCRTQEQKSSVAKGAGSEPEWNETFVFTVSDDVPQLNVKIMDSDAFSADDFVGEANIPLEPVFLEGSLPPAVHRVVKEEKYCGEIKVALTFTPAAVKTLTSVSCNIDGVVAIVSEHLVGVCDANVLDTRISSGNSPSSQPRERGGGLQQLELIACY

SEQ ID NO: 1027 - protein, 151 aa, Oryza sativa subsp. indica
  misc_feature (1)..(151): Public GI ID no.125540448
  misc_feature (1)..(151): Bit score of 181.8 for HMM based on sequences of FIGURE 33.
  misc_feature (54)..(95): Pfam Name: C2 Pfam Description: C2 domain
  misc_feature (1)..(151): Functional Homolog Of Ceres SEEDLINE ID no. ME12970 at SEQ ID NO: 982
MDPYAILKCRSQEQRSSIASVLWCIADEWNDLTVKIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 1028 - protein, 144 aa, Oryza sativa subsp. japonica
  misc_feature (1)..(144): Public GI ID no.115459588
  misc_feature (1)..(144): Bit score of 348.7 for HMM based on sequences of FIGURE 33.
  misc_feature (6)..(87): Pfam Name: C2 Pfam Description: C2 domain
  misc_feature (1)..(144): Functional Homolog Of Ceres SEEDLINE ID no. ME12970 at SEQ ID NO: 982
MVQGTLEVLLVGAKGLENTDYLCNMDPYAVLKCRSQEQKSSVASGKGSDPEWNETFMFSVTHNATELIIKLMDSDSGTDDDFVGEATISLEAIYTEGSIPPTVYNVVKEEEYRGEIKVGLTFTPEDDRDRGLSEEDIGGWKQSS

SEQ ID NO: 1029 - protein, 143 aa, Oryza sativa subsp. japonica
  misc_feature (1)..(143): Public GI ID no.115447529
  misc_feature (1)..(143): Bit score of 334.1 for HMM based on sequences of FIGURE 33.
  misc_feature (6)..(87): Pfam Name: C2 Pfam Description: C2 domain
  misc_feature (1)..(143): Functional Homolog Of Ceres SEEDLINE ID no. ME12970 at SEQ ID NO: 982
MVHGTLEVLLVGAKGLENTDYLCNMDPYAILKCRSQEQRSSIASGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 1030 - protein, 145 aa, Oryza sativa subsp. japonica
  misc_feature (1)..(145): Public GI ID no.115461388
  misc_feature (1)..(145): Bit score of 330.2 for HMM based on sequences of FIGURE 33.
  misc_feature (6)..(87): Pfam Name: C2 Pfam Description: C2 domain
  misc_feature (1)..(145): Functional Homolog Of Ceres SEEDLINE ID no. ME12970 at SEQ ID NO: 982
MVHGKLEVLLVCAKGLEDTDFLNDMDPYVILTCRTQEQKSSVAKGAGSEPEWNETFVFTVSDDVPQLNVKIMDSDAFSADDFVGEANIPLEPVFLEGSLPPAVHRVVKEEKYCGEIKVALTFTPAAETRHHHNHENEGEGYSSWN

SEQ ID NO: 1031 - protein, 151 aa, Oryza sativa subsp. japonica
  misc_feature (1)..(151): Public GI ID no.125583020
  misc_feature (1)..(151): Bit score of 181.7 for HMM based on sequences of FIGURE 33.
  misc_feature (54)..(95): Pfam Name: C2 Pfam Description: C2 domain
  misc_feature (1)..(151): Functional Homolog Of Ceres SEEDLINE ID no. ME12970 at SEQ ID NO: 982
MDPYAILKCRSQEQRSSIASVLWCIADEWNDLTVRIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 1032 - protein, 138 aa, Cucurbita maxima x Cucurbita moschata
  misc_feature (1)..(138): Public GI ID no.68349016
  misc_feature (1)..(138): Bit score of 280.4 for HMM based on sequences of FIGURE 33.
  misc_feature (6)..(92): Pfam Name: C2 Pfam Description: C2 domain
  misc_feature (1)..(138): Functional Homolog Of Ceres SEEDLINE ID no. ME12970 at SEQ ID NO: 982
MAMGMLEVHLISGKGLQAHDPLNKPIDPYVEINYKGQERMSKVAKNAGPDPVWNEKFKFLAEYPGSGGDFLILFKVMDHDVIDGDDYIGDVSIDVKDLLVEGVRKGWSELPPRMYQVIAHKLYFKGEIEVGVSFKRQG

SEQ ID NO: 1033 - protein, 150 aa, Cucurbita maxima x Cucurbita moschata
  misc_feature (1)..(150): Public GI ID no.68349012
  misc_feature (1)..(150): Bit score of 300.0 for HMM based on sequences of FIGURE 33.
  misc_feature (6)..(92): Pfam Name: C2 Pfam Description: C2 domain
  misc_feature (1)..(150): Functional Homolog Of Ceres SEEDLINE ID no. ME12970 at SEQ ID NO: 982
MAMGMLEVHLISGKGLQAHDPLNKPIDPYVEINYKGQERMSKVAKNAGPDPLWDEKFKFLAEYPGSGGDFHILFKVMDHDVIDGDDYIGDVKIDVKDLLAEGVRKGWSEIRPRMYHVLAHKIHFKGEIEVGVSFKLQGGGGCAGCYPWEN

SEQ ID NO: 1034 - DNA, 908 bp, Panicum virgatum
  misc_feature (1)..(908): Ceres CLONE ID no.1764766
  misc_feature (1)..(908): Encodes the peptide sequence at SEQ ID NO 1035
cgctttcgccaccggggaggggagggcgaccctccgatcggctccgctatggctggcactgctgttctcaacgagcgcatcctttcttccatgtcccagaaacatgttgctgctcatccatggcatgatttggagataggaccaggggctcctgaagttttcaactgtgtggttgagattcctagaggcagcaaggtgaagtatgagttggacaaggcatctggtctgatcaaggttgatcgtgtcctttactcctctgttgtttacccacacaactatggtttcattccacgcacactctgtgaggatagtgaccccatggacgtcctcatcctgatgcaggaacaagttgtccctgggtgtttcctgcgagctcgtgctattgggctcatgcctatgattgatcaaggagagaaagatgataagatcatagcagtttgcgctgatgaccctgaataccgtcactacacggacatcaaggaccttcctccacatcgccttcaagagattcgccgcttctttgaagattacaagaagaatgaaaacaaagaggtcgcggtgaatgagttcctcccagcaaaagatgccatcgacgcaatcaaatactctatggacctgtatggctcatacatcatcgaaggactgaggaagtaacaagattgcagatgcttcatgatttactcagcagctcgagagtactgtagcacgacatatgttaacatgcacgaactgaaatcatgacaaaggaatattaccttctgttcatgttgagagaagcagcagtgccttttgtttccattatatatgcttatcttggccttgatgaaatctgtcgtcaaaccaacatttgacagaacgattgcctgatagaaaatcacttgatacataaatgtcatttgcttatcttc

SEQ ID NO: 1035 - protein, 201 aa, Panicum virgatum
  misc_feature (1)..(201): Ceres CLONE ID no.1764766
  misc_feature (1)..(201): Bit score of 500.9 for HMM based on sequences of FIGURE 55.
  misc_feature (39)..(193): Pfam Name: Pyrophosphatase Pfam Description: Inorganic pyrophosphatase
  misc_feature (1)..(201): Functional Homolog Of Ceres SEEDLINE ID no. ME19182 at SEQ ID NO: 1577
MAGTAVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCFLRARAIGLMPMIDQGEKDDKIIAVCADDPEYRHYTDIKDLPPHRLQEIRRFFEDYKKNENKEVAVNEFLPAKDAIDAIKYSMDLYGSYIIEGLRK

SEQ ID NO: 1036 - protein, 214 aa, Oryza sativa subsp. japonica
  misc_feature (1)..(214): Public GI ID no.115448167
  misc_feature (1)..(214): Bit score of 510.3 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MAGEADGKAPLGSRYPPAALNERILSSMSQKHVAAHPWHDLEIGPGAPAVFNCVVEIPRGSKVKYELDKATGLIKVDRVLYSSVVYPHNYGFIPRTLCEDGDPMDVLVLMQEQVVPGCFLRARAIGLMPMIDQGEKDDKIIAVCADDPEYRHFRDIKEIPPHRLQEIRRFFEDYKKNENKEVAVNEFLPAEDAINAIKYSMDLYGAYIIESLRK

SEQ ID NO: 1037 - protein, 210 aa, Oryza sativa subsp. japonica
  misc_feature (1)..(210): Public GI ID no.52550777
  misc_feature (1)..(210): Bit score of 512.0 for HMM based on sequences of FIGURE 55.
  misc_feature (51)..(205): Pfam Name: Pyrophosphatase Pfam Description: Inorganic pyrophosphatase
  misc_feature (1)..(210): Functional Homolog Of Ceres SEEDLINE ID no. ME19182 at SEQ ID NO: 1577
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPANTARDAIQYSMDLAAQNILHS

SEQ ID NO: 1038 - DNA, 600 bp, Populus balsamifera subsp. trichocarpa
  misc_feature (1)..(600): Ceres ANNOT ID no.1441778
  misc_feature (1)..(600): Encodes the peptide sequence at SEQ ID NO 1039
atgagcgaccaagagaaaaacaggggagttgttgtagatcaccgccaccatgaagaccaaccaccgccaccgccaccaccccagccccaatatggtacctttcaaggagttgccaattatccaccgccttctcaaagccatgtcatcggctttcctcagcctgtccctcctcctggtatcaccgccgaaccttatgctcagggctaccaaaccgtcccaggttatgctgttgctgaaggaagacctgtgagacaacgtcgcctaccttgttgcggttgtggtgttggctggttcttgtttatcatcggtttctttctgggtgccatcccctggtatattgggttatttatcatagcttgtatgaggatagatccccgagagaaacctggatatgttgcttgcaccattgctctaaggaaacatcttgtcgagcatgagtgccacattgaaataaggtgtctattgcacaatctctgtgtaaagtcatttgtccggcactttctcttaacagtagcttttttgacaatgaaagagccaggagtgattttaaacggaccttattctttgcaaggacctgtatatcaagccagcatttgttag

SEQ ID NO: 1039 - protein, 199 aa, Populus balsamifera subsp. trichocarpa
  misc_feature (1)..(199): Ceres ANNOT ID no.1441778
  misc_feature (1)..(199): Bit score of 257.6 for HMM based on sequences of FIGURE 09.
  misc_feature (1)..(199): Functional Homolog Of Ceres SEEDLINE ID no. 03123 at SEQ ID NO: 218
MSDQEKNRGVVVDHRHHEDQPPPPPPPQPQYGTFQGVANYPPPSQSHVIGFPQPVPPPGITAEPYAQGYQTVPGYAVAEGRPVRQRRLPCCGCGVGWFLFIIGFFLGAIPWYIGLFIIACMRIDPREKPGYVACTIALRKHLVEHECHIEIRCLLHNLCVKSFVRHFLLTVAFLTMKEPGVILNGPYSLQGPVYQASIC

SEQ ID NO: 1040 - protein, 215 aa, Hordeum vulgare subsp. vulgare
  misc_feature (1)..(215): Public GI ID no.4033417
  misc_feature (1)..(215): Bit score of 497.8 for HMM based on sequences of FIGURE 55.
  misc_feature (55)..(156): Pfam Name: Pyrophosphatase Pfam Description: Inorganic pyrophosphatase
  misc_feature (1)..(215): Functional Homolog Of Ceres SEEDLINE ID no. ME19182 at SEQ ID NO: 1577
MSQEDSTSAAAAQQPTSRPAPKLNERILSSLSRRGGGAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYSTSVSLLPRLQEIKRLEDYKKNENKEVAVDAFLPATTAREAIQYSMDLYAQYILQSLRQ

SEQ ID NO: 1041 - protein, 215 aa, Populus tremula x Populus tremuloides
  misc_feature (1)..(215): Public GI ID no.5669924
  misc_feature (1)..(215): Bit score of 542.2 for HMM based on sequences of FIGURE 55.
  misc_feature (53)..(207): Pfam Name: Pyrophosphatase Pfam Description: Inorganic pyrophosphatase
  misc_feature (1)..(215): Functional Homolog Of Ceres SEEDLINE ID no. ME19182 at SEQ ID NO: 1577
MSDVTKTQENEVETKHQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIKELAPHRLSEIRRFFEDYKKNENKEVAVNDFLPSNTAVEAIQYSMDLYAEYILHTLRR

SEQ ID NO: 1042 - DNA, 985 bp, Panicum virgatum
  misc_feature (1)..(985): Ceres CLONE ID no.1778611
  misc_feature (1)..(985): Encodes the peptide sequence at SEQ ID NO 1043
acgcccgccttggttgtctctctcggtctcggcggcctttcctttccttgctagcgctagcggcgacgaccgggcgagtgccgccgtccgccacttcttcgtcggccgaccaccatctgaaaggggatgagtgaagaggacaagactgctgctgctgctgagcagccgaagcgagcccctaagctcaacgaaaggatcctctcttctttgtccaggagatctgtagctgctcatccatggcatgatcttgagatcggtcctggggctcccgctgtcttcaatgttgtcattgagatcacaaagggaagcaaagttaaatatgagcttgacaagaaaactggactgattaaggttgatcgagtcctgtactcatcagttgtataccctcacaattatggtttcattccgaggactctttgtgaggacaatgacccaatggatgttttggtcctgatgcaggagcctgttattccgggttcattcctccgggcaagagcaattggccttatgcctatgattgaccagggtgaaaaggatgacaagataattgctgtctgtgctgatgatcctgaataccgtcactacaatgacatcagtgagctgtctcctcaccgcctgcaagaaatcaagcgcttctttgaagattacaagaaaaatgagaacaaagaggttgctgttgatgcattcttgcctgcgacaactgctcgagatgccattcagtactccatggatctgtatgcacaatatattttgcaaagcttgaggcagtagaatgccagcaactatttattgtggcgtctttgattgtgtgtgattttaagtggacgcttgaattgtgtgcgaccattacaactgaatgatgttgctggctgttatttccttctgcttttcccaggtcttgtataactttgttgttaaattatgaataagcaactttgttgttaaattatgaataaacgaagttcttcgtttaccttgcccatcc

SEQ ID NO: 1043 - protein, 214 aa, Panicum virgatum
  misc_feature (1)..(214): Ceres CLONE ID no.1778611
  misc_feature (1)..(214): Bit score of 536.6 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MSEEDKTAAAAEQPKRAPKLNERILSSLSRRSVAAHPWHDLEIGPGAPAVFNVVIEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTARDAIQYSMDLYAQYILQSLRQ

SEQ ID NO: 1044 - protein, 216 aa, Oryza sativa subsp. japonica
  misc_feature (1)..(216): Public GI ID no.115461719
  misc_feature (1)..(216): Bit score of 525.8 for HMM based on sequences of FIGURE 55.
  misc_feature (54)..(187): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MAPAVEAVEKKTGSAPVKAPALNERILSSMSRRSIAAHPWHDLEIGPGAPTIFNCVIEIPRGSKVKYELDKKTGLIVVDRVLYSSVVYPHNYGFIPRTLCEDSDPLDVLVIMQEPVIPGCFLRAKAIGLMPMIDQGEADDKIIAVCADDPEYKHYNDIKELPPHRLAEIRRFFEDYKKNENKEVAVNDFLPASAAYEAIKHSMDLYATYIVEGLRR

SEQ ID NO: 1045 - protein, 131 aa, Oryza sativa subsp. japonica
  misc_feature (1)..(131): Public GI ID no.115442555
  misc_feature (1)..(131): Bit score of 127.9 for HMM based on sequences of FIGURE 55.
  misc_feature (55)..(112): Pfam Name: Pyrophosphatase Pfam Description: Inorganic pyrophosphatase
  misc_feature (1)..(131): Functional Homolog Of Ceres SEEDLINE ID no. ME19182 at SEQ ID NO: 1577
MAPPLQVATTASSSTREGKAPALNERILSSMSKRSVAAHPWHDLEIGPEAPTIFNCVIEIPRGSKVKYELDKKTGLVKVDRVLYSSVVYPHNYGFIPRTLCDDSDPLDVLVIMQVCISLHVAKSEYNKSFI

SEQ ID NO: 1046 - protein, 195 aa, Oryza sativa subsp. japonica
  misc_feature (1)..(195): Public GI ID no.125574735
  misc_feature (1)..(195): Bit score of 393.7 for HMM based on sequences of FIGURE 55.
  misc_feature (55)..(187): Pfam Name: Pyrophosphatase Pfam Description: Inorganic pyrophosphatase
  misc_feature (1)..(195): Functional Homolog Of Ceres SEEDLINE ID no. ME19182 at SEQ ID NO: 1577
MAEEKKTPCLNERILSSLSKRSVAAHSWHDLEIADADAFSLSKCCIGPGAPQVFNVVVGITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 1047 - protein, 195 aa, Oryza sativa subsp. japonica
  misc_feature (1)..(195): Public GI ID no.15451551
  misc_feature (1)..(195): Bit score of 397.6 for HMM based on sequences of FIGURE 55.
  misc_feature (55)..(187): Pfam Name: Pyrophosphatase Pfam Description: Inorganic pyrophosphatase
  misc_feature (1)..(195): Functional Homolog Of Ceres SEEDLINE ID no. ME19182 at SEQ ID NO: 1577
MAEEKKTPCLNERILSSLSKRSVAAHSWHDLEIADADAFSLSKCCIGPGAPQVFNVVVEITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 1048 - protein, 214 aa, Oryza sativa subsp. japonica
  misc_feature (1)..(214): Public GI ID no.3885882
  misc_feature (1)..(214): Bit score of 498.5 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MAGEADGKAPLGSRYPPAALNERILSSMSQKHVAAHPWHDLEIGPGAPAVFNCVVEIPRGSKVKYELDKATGLIKVDRVLYSSVVYPHNYGFIPRTLCEDGDPMDVLVLMQEQVVPGCFLRARAIGLMPMIDQGEKDDKIIAVCADDLEYRHFRDIKEIPLHRLQEIRRFFEDYKKNENKEVAVNEFLPAEDAINAIKYSMDLYGAYIIESLRK

SEQ ID NO: 1049 - protein, 217 aa, Oryza sativa subsp. indica
  misc_feature (1)..(217): Public GI ID no.125525134
  misc_feature (1)..(217): Bit score of 152.0 for HMM based on sequences of FIGURE 09.
  misc_feature (1)..(217): Functional Homolog Of Ceres SEEDLINE ID no. ME103123 at SEQ ID NO: 218
MGGGGGGDEREKAKGGGGGGGGGGGGEYGTFQGPPSYPPPRPPVVGYPQPAPPPGLYGQGDPYYRPRGGYQGIPARDYEAGARGHGHDRLPCCGIGIGWFLFIVGFFLGAIPWYVGAFLLWCSRVDYREKPGYVACAIADCTEVCARLFLVPRIAVYMNNLHETKTNGQAHRLFVHLALVRREVWFLKTKQLSDFVVQILNNASGASRELGIGLMTL

SEQ ID NO: 1050 - protein, 212 aa, Oryza sativa subsp. japonica
  misc_feature (1)..(212): Public GI ID no.115441255
  misc_feature (1)..(212): Bit score of 504.7 for HMM based on sequences of FIGURE 55.
  misc_feature (51)..(205): Pfam Name: Pyrophosphatase Pfam Description: Inorganic pyrophosphatase
  misc_feature (1)..(212): Functional Homolog Of Ceres SEEDLINE ID no. ME19182 at SEQ ID NO: 1577
MSEADGGEGAKPKRPAPRLNERILSSLSRRSVAAHPWHDLDTGADAPAVFNVVVEISKGSKVKYELDKKTGFIMVDRVLYSSVVYPHNYGFIPRTLCEDNDPMDVLVLMQEPVIPGCFLRARAIGLMPMIDQGEKDDKIIAVCVDDPEYRHYNDLSELSPHRVQEIRRFFEDYKKNENKEVAVNEVLPVTAARDAIQYSMDLYAQYIEHLGQ

SEQ ID NO: 1051 - DNA, 525 bp, Sorghum bicolor
  misc_feature (1)..(525): Ceres ANNOT ID no.6040744
  misc_feature (1)..(525): Encodes the peptide sequence at SEQ ID NO 1052
atgggagggaggcacgaggcggaggcggacggcggaaaggccgggggctactcctcctccggcctcccgccgtcggaggcgccgcacctgcagggccagccgtcgcaggagtacgggtacggcacgttccagggccctcggcaacctcccgtcgggttcccgcagcctgctccgcctcccgggttcggcggcggcggctatcacaaccagcagaagccgtacgcgcccgcggagccctactacgctcaggggtaccaggccgtgccaggctatggtcctgttgctgaaggaagacctgtgagaatgaggcgtctcccatgttgtggcctcggcttaggctggtgtctgttcattactgggtttttccttgctgccattccatggtacattggagcttttattctgatatgtgtgcgggtacatgaccaacgagagaaaccaggatacgttgcttgcacaattgctgctgttgttgctgccgttgccatcctcctgggggtaactaaaggaactcatgtgtggtga

SEQ ID NO: 1052 - protein, 174 aa, Sorghum bicolor
  misc_feature (1)..(174): Ceres ANNOT ID no.6040744
  misc_feature (1)..(174): Bit score of 401.0 for HMM based on sequences of FIGURE 09.
  misc_feature (1)..(174): Functional Homolog Of Ceres SEEDLINE ID no. ME03123 at SEQ ID NO: 218
MGGRHEAEADGGKAGGYSSSGLPPSEAPHLQGQPSQEYGYGTFQGPRQPPVGFPQPAPPPGFGGGGYHNQQKPYAPAEPYYAQGYQAVPGYGPVAEGRPVRMRRLPCCGLGLGWCLFITGFFLAAIPWYIGAFILICVRVHDQREKPGYVACTIAAVVAAVAILLGVTKGTHVW

SEQ ID NO: 1053 - DNA, 1986 bp, Zea mays
  misc_feature (1)..(1986): Ceres SEEDLINE ID no.ME13021
  misc_feature (1)..(1986): Ceres CLONE ID no.244306
  misc_feature (1)..(1986): Inplanta Sequence
  misc_feature (1)..(1986): Encodes the peptide sequence at SEQ ID NO. 1054
agaagtttcagatcctcgcatcgtccgcaccttatcctctcgactttacagtacctgctctcagctcctccctatctcaatggcatccgcgaatgccatctccaccgcctcccccttccggcccctctctcagggcagggcgacgaggtcacagcggttcgtggtgcgtgcgaacgccaaagacattgcctttgaccagaaatccagggcagcgctgcaggccggcgtcgagaagctcgcaaacgccgtcggtgtcaccctcgggccacgagggaggaatgtggtgctcgatgagtacggcaaccccaaagttgtgaatgatggagtcactattgcccgtgctattgagctgtatgatccaatggaaaatgctggtgcagcattgattcgtgaggttgctagcaagaccaatgattcagctggtgatgggactacaactgcatgcgtccttgctcgtgaaatcatcaagctaggccttctgagtgtaacatctggtgcaaatcctgtatcactaaagaaaggaatagacaaaactgtgcagggcctaattcaggagcttgagaataagtctagaccaatcaagggtggtggtgatatcaaagctgttgcatctatctctgctggcaatgatgaatttatcggatccatgattgctgaagcaattgacaaagtggggcctgatggtgttctatcaattgaatcctcctcgtcttttgagaccactgttgaagttgaagaaggaatggagattgaccgcggttatatttccccacaatttgtgacaaaccttgagaaatcaattgtggagtttgagaattgtaaggttcttattactgatcagaagatcacaagcataaaggaaatccttccgattttggagaagaccacacagctgagagcccctctgttcattattgctgaggacattactggtgaagctttggcaactcttgttgttaacaagcttcgaggaattctcaatgttgcagcgattaaggctccaagttttggtgagcggcggaaggctgtacttcaggacattgccatcgtcacaggtgctgagttcctagcaaaagatcttggtttgttgggttgaaaaatgctacagaggaacaacttggcacagcaaggaaagtcacgatacatcagactacaacaaccctcatagcagatgcagccagtaaagatgagatccaggcgagaattgcacaactgaagaaggagcttgctgagactgattcagtttatgatactgagaaattggccgagagaattgctaagcttgccggtggtgttgctgttatcaaggttggagctgcaactgagactgagcttgaggaccgccagctaagaattgaggatgcaaaaaatgccacttttgcagctatagaggagggcattgttccaggaggtggtgcggcatatgtgcacctatctacggttgtccctaagatcaaagaagcaattgaggaccctgatgagcgtcttggcgctgatattattcaaaaggcattggtagcacctgcttcattgattgcacacaatgctggagtagagggtgaagtagttgtcgagaagatcaaggacagcgattgggaggtgggctacaatgcaatgactgacaagtacgagaacctgatggaggctggtgtgatcgaccctgccaaggtgaccaggtgtgcgctccagaatgcggcctcagtagctggaatggtcctaaccacacaggccattgttgttgagaagccaaagccgaagcctcaagtggcagagccaccggagggagcccttaccgtttaaaacttaacgttcttgaggctgctgtccagacggttcagatcagttgagagggtagaactttggtttgagaattttggttcagatccactgggagttatagagtaggattgctatttttcagacgaagagtaattttactctggtctgaacttatccgaatcgaagacatttgcatcaccatttttt

SEQ ID NO: 1054 - protein, 572 aa, Zea mays
  misc_feature (1)..(572): Ceres SEEDLINE ID no.ME13021
  misc_feature (1)..(572): Ceres CLONE ID no.244306
  misc_feature (1)..(572): Bit score of 1555.2 for HMM based on sequences of FIGURE 34.
  misc_feature (53)..(556): Pfam Name: Cpn60_TCP1 Pfam Description: TCP-1/cpn60 chaperonin family
MASANAISTASPFRPLSQGRATRSQRFVVRANAKDIAFDQKSRAALQAGVEKLANAVGVTLGPRGRNVVLDEYGNPKVVNDGVTIARAIELYDPMENAGAALIREVASKTNDSAGDGTTTACVLAREIIKLGLLSVTSGANPVSLKKGIDKTVQGLIQELENKSRPIKGGGDIKAVASISAGNDEFIGSMIAEAIDKVGPDGVLSIESSSSFETTVEVEEGMEIDRGYISPQFVTNLEKSIVEFENCKVLITDQKITSIKEILPILEKTTQLRAPLFIIAEDITGEALATLVVNKLRGILNVAAIKAPSFGERRKAVLQDIAIVTGAEFLAKDLGLLVENATEEQLGTARKVTIHQTTTTLIADAASKDEIQARIAQLKKELAETDSVYDTEKLAERIAKLAGGVAVIKVGAATETELEDRQLRIEDAKNATFAAIEEGIVPGGGAAYVHLSTVVPKIKEAIEDPDERLGADIIQKALVAPASLIAHNAGVEGEVVVEKIKDSDWEVGYNAMTDKYENLMEAGVIDPAKVTRCALQNAASVAGMVLTTQAIVVEKPKPKPQVAEPPEGALTV

SEQ ID NO: 1055 - protein, 580 aa, Chlamydomonas reinhardtii
  misc_feature (1)..(580): Public GI ID no.2493647
  misc_feature (1)..(580): Bit score of 1443.2 for HMM based on sequences of FIGURE 34.
  misc_feature (56)..(560): Pfam Name: Cpn60_TCP1 Pfam Description: TCP-1/cpn60 chaperonin family
  misc_feature (1)..(580): Functional Homolog Of Ceres SEEDLINE ID no. ME13021 at SEQ ID NO: 1054
MAQSQLAKGSRQTTGRPFQNKPARAARRLVIRAADAKEIVFDQESRRRLQAGINKVADAVGVTLGPRGRNVVLEQKFGVPQVINDGVSIRRAIELKDPVENAGAQLIKEVAGRTNDAAGDGTTTASVLAREMIHYGLQSVTAGANPIAVKRGLDKTAEYLVAKLKEHAKPVKGRDDIKNVASISAGNDNAIGEMIADALDKVGSNGVLSIETSNSTETVVEVQEGMEIDRGYISPQFVTNQERLLVEYDNCRVLVTDQKIDAIRDIIPILEQVTRLNAPLLIIAEDVSGEALATLVVNKLRGVLNVCAIKAPGFGERRKSLLQDIAIVTGAEFIAKDLGMKVEQAVVEQLGVARKVTVANNTTTLIADAASKDEIEMRIAQLKKELAETDSVYDTEKLSERIAKLSGGVAVIKVGAATEAELEDRKLRIEDAKNATFAAVEEGIVPGGGAALLHLSELVPAFKETLTDAEEKLGADIVMKSLRAPCRLIADNAGVEGEVIVQRLLGKPFEVGYNAMIDKVENLLDAGVIDPAKVTRNGLLNSVSIAGIMLTTQAVMVEKHKPSEIPGGMTASGMPSGMTI

SEQ ID NO: 1056 - DNA, 2097 bp, Gossypium hirsutum
  misc_feature (1)..(2097): Ceres CLONE ID no.1924252
  misc_feature (1)..(2097): Encodes the peptide sequence at SEQ ID NO 1057
  misc_feature (671)..(671): r is g or a
atatattaaaagaacaaaaaaactagccctaaagccctcaacgcctttgctttagttctttctacacacactctctgcctgcctccccttatccactctttcccaaaaacccagaaaccaaaacaaagcctttaccttgtttattgttttacttatcatttttgttcatcaaactacaacaaaaagaaatggcctctgcaaatgctctttcttcagcttctattctttgctctcccaacaaggggagtttaaggaggaagggaaatcagagacagaaccaaagggtaaattataggcaaggaaacaaccggtttggtgtgaaggcttgtgctaaagaaattgcttttgaccagagttcaagagctgcaatgcaggctggcattgataagttagctgatgctgttggccttacacttggtcctagagggaggaatgttgtgttggatgaatttggaagtccgaaagtcgttaacgatggggtgacaatagctagagctattgagcttcctaatgccatggaaaatgctggtgctgctcttatcagagaggttgcgagtaaaactaatgactctgcaggtgacgggacgactacggcatcggtacttgcacgggaaatcatcaaactaggacttttgactgttacttcgggtgcaaatccggtctcagtgaaraggggtatagataaaaccgtacaaagtttaatagaagagttggaaaagaaggctaggcctgttaaaggccgtgatgatatcaaagctgtggcttcgatttctgctggaaatgatgaccttattggaacaatggtagctgatgctattgacaaagtcggccccgatggtgttttgtcaatcgagtcatcttcttcatttgagactaccgttgatgttgaggaaggaatggagattgacagaggttacatctcaccacaattcgtaacaaatcccgagaaattaatttgtgaattcgagaatgcgagggtgctagtaactgatcaaaagattacagctattaaggacataattcccctcttggagaagactactcagttaagagctccattgcttataattgcggaggatgttactggagaggctcttgctacacttgtagtgaacaaactccgaggtatccttaatgttgcagccattaaagctccgagtttcggcgaaagaagaaaagctgtccttcaagatattgccattcttactggtgccgagttccaagcaaatgatctgggtttgttaatcgagaacacctctgttgagcagcttggtatagccaggaaagttatcatcaccaaggattcaacccaaataattgccgatgccgcttcgaaggatgaaatacaagctagggtgcaacaattaaagaaagaactagccgagacagattctgtttacgacacagaaaaattggcagaaaggattgctaaactatctggtggtgttgcagtcattaaggttggggctgcaactgagactgaacttgaggatcgcaagctacgtattgaagatgccaagaatgctacctttgctgccatagaggaaggtattgtacctggtggtggtgctgcattagttcatctctcgacttgcgtccctgcaattaaggataagcttgaagaccctgaagagcgcataggagccgacattgtgcagaaggctttggtagcaccggcctcgttgatagctcaaaatgcaggaatggaaggtgaggtagtggtggagaaggtaaagaacagcgagtgggagatcggttacaatgcaatgacagacacgtatgagaacttgctggcagctggagttattgacccggcaaaggtgacaagatgtgcgttgcagaacgcagcttcggttgcgggaatggtgcttacgactcaagctattgtcgttgagaaagccaagccaaaggctcctgcagctgctgctcctgaaggtcttaccatttaatcactaggattttaagaaatttcagggattgaatgagcaatgatgtaggtttggtgccctatttttgtattggatttaataaaagaatggtttgtggatgcaatgtaaggttagggatgttgaacaatgtttgattagacattgcagt

SEQ ID NO: 1057 - protein, 586 aa, Gossypium hirsutum
  misc_feature (1)..(586): Ceres CLONE ID no.1924252
  misc_feature (1)..(586): Bit score of 1587.5 for HMM based on sequences of FIGURE 34.
  misc_feature (68)..(571): Pfam Name: Cpn60_TCP1 Pfam Description: TCP-1/cpn60 chaperonin family
  misc_feature (1)..(586): Functional Homolog Of Ceres SEEDLINE ID no. ME13021 at SEQ ID NO: 1054
  misc_feature (161)..(161): Xaa is any aa, unknown or other
MASANALSSASILCSPNKGSLRRKGNQRQNQRVNYRQGNNRFGVKACAKEIAFDQSSRAAMQAGIDKLADAVGLTLGPRGRNVVLDEFGSPKVVNDGVTIARAIELPNAMENAGAALIREVASKTNDSAGDGTTTASVLAREIIKLGLLTVTSGANPVSVXRGIDKTVQSLIEELEKKARPVKGRDDIKAVASISAGNDDLIGTMVADAIDKVGPDGVLSIESSSSFETTVDVEEGMEIDRGYISPQFVTNPEKLICEFENARVLVTDQKITAIKDIIPLLEKTTQLRAPLLIIAEDVTGEALATLVVNKLRGILNVAAIKAPSFGERRKAVLQDIAILTGAEFQANDLGLLIENTSVEQLGIARKVIITKDSTQIIADAASKDEIQARVQQLKKELAETDSVYDTEKLAERIAKLSGGVAVIKVGAATETELEDRKLRIEDAKNATFAAIEEGIVPGGGAALVHLSTCVPAIKDKLEDPEERIGADIVQKALVAPASLIAQNAGMEGEVVVEKVKNSEWEIGYNAMTDTYENLLAAGVIDPAKVTRCALQNAASVAGMVLTTQAIVVEKAKPKAPAAAAPEGLTI

SEQ ID NO: 1058 - protein, 575 aa, Cucurbita maxima
  misc_feature (1)..(575): Public GI ID no.461736
  misc_feature (1)..(575): Bit score of 1252.4 for HMM based on sequences of FIGURE 34.
  misc_feature (54)..(557): Pfam Name: Cpn60_TCP1 Pfam Description: TCP-1/cpn60 chaperonin family
  misc_feature (1)..(575): Functional Homolog Of Ceres SEEDLINE ID no. ME13021 at SEQ ID NO: 1054
MHRFASGLASKARLARKGANQIASRSSWSRNYAAKDVKFGVEARGLMLKGVEDLADAVKVTMGPKGRNVVIEQSYGAPKVTKDGVTVAKSIEFKDKVKNVGASLVKQVANATNDVAGDGTTCATILTRAIFTEGCKSVAAGMNAMDLRRGISMAVDSVVTNLKSRARMISTSEEIAQVGTISANGEREIGELIAKAMEKVGKEGVITISDGKTLFNELEVVEGMKLDRGYISPYFITNQKNQKCELDDPLILIHEKKISSINSVVKVLELALKRQRPLLIVSEDVESDALATLILNKLRAGIKVCAIKAPGFGENRKAGLHDLAVLTGGQLITEELGMNLEKVDLDMLGSCKKITISKDDTVILDGAGDKKSIEERCEQIRSAIELSTSDYDKEKLQERLAKLSGGVAVLKIGGASEAEVGEKKDRVTDALNATKAAVEEGIVPGGGVALLYASKELDKLSTANFDQKIGVQIIQNALKTPVHTIASNAGVEGAVVVGKLLEQDNPDLGYDAAKGEYVDMIKAGIIDPLKVIRTALVDAASVSSLMTTTEAIVVELPKDEKEVPAMGGGMGGMDY

SEQ ID NO: 1059 - protein, 575 aa, Cucurbita maxima
  misc_feature (1)..(575): Public GI ID no.461735
  misc_feature (1)..(575): Bit score of 1210.1 for HMM based on sequences of FIGURE 34.
  misc_feature (54)..(557): Pfam Name: Cpn60_TCP1 Pfam Description: TCP-1/cpn60 chaperonin family
  misc_feature (1)..(575): Functional Homolog Of Ceres SEEDLINE ID no. ME13021 at SEQ ID NO: 1054
MHRFATGLASKARLARNGANQIASRSNWRRNYAAKDVKFGVEARGLMLKGVEDLADAVKVTMGPKGRTVVIEQSFGAPKVTKDGVTVAKSIEFKDKVKNVGASLVKQVANATNDVAGDGTTCATILTKAIFTEGCKSVASGMNAMDLRRGISMAVDSVVTNLKSRARMISTSEEIAQVGTISANGEREIGELIAKAMEKVGKEGVITISDGKTMDNELEVVEGMKLDRGYISPYFITNQKNQKCELDDPLIIIYEKKISSINAVVKVLELALKKQRPLLIVSEDVESEALATLILNKLRAGIKVCAIKAPGFGENRKAGLQDLAVLTGGQVITEELGMNLEKVDLDMLGSCKKITISKDDTVILDGAGDKKAIEERCDQIRSGIEASTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVVVGKLLEQDDPDLGYDAAKGEYVDMVKAGIIDPLKVIRTALVDAASVSSLMTTTEVVVVELPKDENEVPAMGGGMGGMDY

SEQ ID NO: 1060 - DNA, 1764 bp, Populus balsamifera subsp. trichocarpa
  misc_feature (1)..(1764): Ceres ANNOT ID no.1542060
  misc_feature (1)..(1764): Encodes the peptide sequence at SEQ ID NO 1061
atggcaacatctaatgctctctccacagcttccattctttgctctcctaaacagggagggctgaggaggagaggcaatcagcaaaacaactcaaggctgaattatgggctatcaagcagaagattttctgtgcgagcaaatgccaaggatattgcatttgatcagaaatccagagctgccctccaatccggaattgataagcttgccgatgctgttggccttactcttggtcctcggggtagaaatgttgtcttagatgaatttggaagtccaaaggtagttaatgatggggtaacaattgcgcgagctattgagctacctgatcccatggaaaatgctggtgcggctctcatcagagaggtagcaagtaaaactaatgactcggctggtgatggaacaacaactgcatcagttcttgcacgggaaataatcaaactagggcttttgagtgtcacctctggagcaaatccagtttctataaaaaggggaattgataaaactgtgcagggcttggtagaagagctagagaagaaggccagacccgttaaaggtcgtgatgacattaaagccgttgcgtcaatttctgctggaaatgatgaactcattggcacaatgattgccgatgcaattgacaaggttgggcctgatggtgttttatcaattgagtcttcatcttcctttgagaccgtggttgaagtcgaagaaggaatggagatagatagaggttacatctctcctcaatttgttacaaatccagagaagttaatttgtgaatttgagaatgctagagtgttgattactgatcaaaagattactgcaatcaaagacataattcccttgctagaaaagactactcaattgagagctcctttgcttataattgctgaggatgtaactggtgaggctttggctacccttgtggtgaacaagctacgtggtgtactcaatgttgctgctatcaaggctcccggttttggtgaaaggaggaaagctatgcttcaagatattgccattttaacaggagctgaatttcaagctagtgatcttggtttgagcattgaaaacacatcaattgagcagcttggtttggccaggaaggttacaatcagcaaggattccacaaccatcattgctgatgctgcatcgaaagatgaattgcaagctaggattgcacaattgaaaaaagagttgtctgagactgattctgtttatgactcagagaaactggctgaaagaattgccaaattgtctggtggagttgctgttatcaaagtgggtgctgcaacggagactgagcttgaggatcgaaaactacgcattgaggatgccaagaatgcaacttttgctgccatagaggaaggaattgtgcccggtggtggtgctgctttggttcatctctcaacttgtgttcctgcaatcaaggacaaaattgaagatgcagatgagcggttaggtgcggacattgtgcagaaggccctggtatcaccagcatcattgattgctcaaaatgctggaattgagggtgaggtggttgtggagaagctaaaggctagtgaatgggagattggctataatgccatgacagacaagtatgagaatttgatggaggctggagtcattgatccggcaaaggtgacaagatgtgctctgcagaattctgcatctgttgctggaatggtcttgaccacccaggccattgttgtagaaaagcccaagcccaagacacctgcagctgctgctacacaaggccaatatgctgtgtaa

SEQ ID NO: 1061 - protein, 587 aa, Populus balsamifera subsp. trichocarpa
  misc_feature (1)..(587): Ceres ANNOT ID no.1542060
  misc_feature (1)..(587): Bit score of 1607.2 for HMM based on sequences of FIGURE 34.
  misc_feature (68)..(571): Pfam Name: Cpn60_TCP1 Pfam Description: TCP-1/cpn60 chaperonin family
  misc_feature (1)..(587): Functional Homolog Of Ceres SEEDLINE ID no. ME13021 at SEQ ID NO: 1054
MATSNALSTASILCSPKQGGLRRRGNQQNNSRLNYGLSSRRFSVRANAKDIAFDQKSRAALQSGIDKLADAVGLTLGPRGRNVVLDEFGSPKVVNDGVTIARAIELPDPMENAGAALIREVASKTNDSAGDGTTTASVLAREIIKLGLLSVTSGANPVSIKRGIDKTVQGLVEELEKKARPVKGRDDIKAVASISAGNDELIGTMIADAIDKVGPDGVLSIESSSSFETVVEVEEGMEIDRGYISPQFVTNPEKLICEFENARVLITDQKITAIKDIIPLLEKTTQLRAPLLIIAEDVTGEALATLVVNKLRGVLNVAAIKAPGFGERRKAMLQDIAILTGAEFQASDLGLSIENTSIEQLGLARKVTISKDSTTIIADAASKDELQARIAQLKKELSETDSVYDSEKLAERIAKLSGGVAVIKVGAATETELEDRKLRIEDAKNATFAAIEEGIVPGGGAALVHLSTCVPAIKDKIEDADERLGADIVQKALVSPASLIAQNAGIEGEVVVEKLKASEWEIGYNAMTDKYENLMEAGVIDPAKVTRCALQNSASVAGMVLTTQAIVVEKPKPKTPAAAATQGQYAV

SEQ ID NO: 1062 - DNA, 1761 bp, Populus balsamifera subsp. trichocarpa
  misc_feature (1)..(1761): Ceres ANNOT ID no.1462127
  misc_feature (1)..(1761): Encodes the peptide sequence at SEQ ID NO 1063
atggcaacatctaatgctctctccacagcttccattctttgctctcctaaacagggagggttgaggaggaaagggaatcagcaacacaactcaaggctgaattttgggcaatcaaccagaagattcgcggtgcgagcaaatgcaaaggatattgcttttgatcaggactcacgggctgctctccaatccggcattgataagcttgctgatgctgttgggcttactcttggtcctaggggtagaaatgttgtcttagatgaatttggtagtccaaaggtagttaatgatggggtaacaattgcgcgagctattgagctacctgatcccatggaaaatgctggtgcagcactcatcagagaggttgcaagtaaaactaatgactctgctggtgatggaacgacaactgcatcagttcttgctcgggaaataatcaaattaggacttttgagtgtcacgtctggtgcaaatccagtttctattaaaaagggaatcgataaaactgtgcaaggcttggtagaagagttagagaagagggccagacctgttaaaggtcgtgatgacattaaagctgttgcgacaatttctgctggaaatgatgaactcattggcacgatgattgctgatgcaattgacaaggtcgggcctgatggtgttttatcaattgagtcatcatcttcctttgagaccacagttgaagttgaagaaggaatggagatagacagaggttatatctctcctcaatttgttacaaatccggagaagttaatttgtgtatttgagaatgctagagtgctggttacagatcaaaagatttctgcaatcaaagacataattcccttgcttgaaaaaactactcaattgagatctcctttgcttataattgctgaggatgtaacaggtgaggctttggctacccttgtggtgaacaaactgcgtggtatccttaatgtttccgctatcaaggcacctggttttggtgaaaggaggaaagctatgctgcaagacattgccattttaacaggagctgagttccaagccagtgatcttggtttaagcattgaaaacacatcaattgagcagcttggtttggccaggaaggttacaatcagcaaggattccaccaccatcattgctgatgctgcatcaaaggatgagttgcaagctaggattgcacagctgaaaaaagagctgtccgagactgattctgtgtatgactcggagaaactggctgaaagaattgccaaattgtctggtggggttgctgttatcaaagtgggtgctgcaacggagactgagcttgaggatcgcaaactccgcattgaggatgccaagaatgcaacttttgctgccatagaagaaggaattgtgcctggtggtggtgctgctttggttcatctctcaacccatgttcctgcaatcaaggaaaaaattaaagatgcagatgaacggttaggtgctgacatcgtgcagaaggcactggtagcacccgcatcgttgatagctcaaaatgctggaattgaaggtgaggtggttgttgagaagctaaaggaaagtgaatgggagatgggctacaatgccatgacagacaagtatgagaatcttgtggaggctggagtcattgatccagcaaaggtgactagatgtgctttgcagaattctgcatctgtagctggaatggtcctgaccacccaggccattgttgtagaaaagcccaagcctaggacacctgcagctgcctctcctcaaggtcttactgtgtaa

SEQ ID NO: 1063 - protein, 586 aa, Populus balsamifera subsp. trichocarpa
  misc_feature (1)..(586): Ceres ANNOT ID no.1462127
  misc_feature (1)..(586): Bit score of 1595.8 for HMM based on sequences of FIGURE 34.
  misc_feature (68)..(571): Pfam Name: Cpn60_TCP1 Pfam Description: TCP-1/cpn60 chaperonin family
  misc_feature (1)..(586): Functional Homolog Of Ceres SEEDLINE ID no. ME13021 at SEQ ID NO: 1054
MATSNALSTASILCSPKQGGLRRKGNQQHNSRLNFGQSTRRFAVRANAKDIAFDQDSRAALQSGIDKLADAVGLTLGPRGRNVVLDEFGSPKVVNDGVTIARAIELPDPMENAGAALIREVASKTNDSAGDGTTTASVLAREIIKLGLLSVTSGANPVSIKKGIDKTVQGLVEELEKRARPVKGRDDIKAVATISAGNDELIGTMIADAIDKVGPDGVLSIESSSSFETTVEVEEGMEIDRGYISPQFVTNPEKLICVFENARVLVTDQKISAIKDIIPLLEKTTQLRSPLLIIAEDVTGEALATLVVNKLRGILNVSAIKAPGFGERRKAMLQDIAILTGAEFQASDLGLSIENTSIEQLGLARKVTISKDSTTIIADAASKDELQARIAQLKKELSETDSVYDSEKLAERIAKLSGGVAVIKVGAATETELEDRKLRIEDAKNATFAAIEEGIVPGGGAALVHLSTHVPAIKEKIKDADERLGADIVQKALVAPASLIAQNAGIEGEVVVEKLKESEWEMGYNAMTDKYENLVEAGVIDPAKVTRCALQNSASVAGMVLTTQAIVVEKPKPRTPAAASPQGLTV

SEQ ID NO: 1064 - DNA, 1836 bp, Populus balsamifera subsp. trichocarpa
  misc_feature (1)..(1836): Ceres ANNOT ID no.1488631
  misc_feature (1)..(1836): Encodes the peptide sequence at SEQ ID NO 1065
atggcaacatctaatgctctctccacagcttccattctttgctctcctaaacagggagggctgaggaggagaggcaatcagcaaaacaactcaaggctgaattatgggctatcaagcagaagattttctgtgcgagcaaatgccaaggatattgcatttgatcagaaatccagagctgccctccaatccggaattgataagcttgccgatgctgttggccttactcttggtcctcggggtagaaatgttgtcttagatgaatttggaagtccaaaggtagttaatgatggggtaacaattgcgcgagctattgagctacctgatcccatggaaaatgctggtgcggctctcatcagagaggttactcttagtcataccataccattatcacgtgccttgagcaaggttctatgtttgggtttatggttgaaggtagcaagtaaaactaatgactcggctggtgatggaacaacaactgcatcagttcttgcacgggaaataatcaaactagggcttttgagtgtcacctctggagcaaatccagtttctataaaaaggggaattgataaaactgtgcagggcttggtagaagagctagagaagaaggccagacccgttaaaggtcgtgatgacattaaagccgttgcgtcaatttctgctggaaatgatgaactcattggcacaatgattgccgatgcaattgacaaggttgggcctgatggtgttttatcaattgagtcttcatcttcctttgagaccgtggttgaagtcgaagaaggaatggagatagatagaggttacatctctcctcaatttgttacaaatccagagaagttaatttgtgaatttgagaatgctagagtgttgattactgatcaaaagattactgcaatcaaagacataattcccttgctagaaaagactactcaattgagagctcctttgcttataattgctgaggatgtaactggtgaggctttggctacccttgtggtgaacaagctacgtggtgtactcaatgttgctgctatcaaggctcccggttttggtgaaaggaggaaagctatgcttcaagatattgccattttaacaggagctgaatttcaagctagtgatcttggtttgagcattgaaaacacatcaattgagcagcttggtttggccaggaaggttacaatcagcaaggattccacaaccatcattgctgatgctgcatcgaaagatgaattgcaagctaggattgcacaattgaaaaaagagttgtctgagactgattctgtttatgactcagagaaactggctgaaagaattgccaaattgtctggtggagttgctgttatcaaagtgggtgctgcaacggagactgagcttgaggatcgaaaactacgcattgaggatgccaagaatgcaacttttgctgccatagaggaaggaattgtgcccggtggtggtgctgctttggttcatctctcaacttgtgttcctgcaatcaaggacaaaattgaagatgcagatgagcggttaggtgcggacattgtgcagaaggccctggtatcaccagcatcattgattgctcaaaatgctggaattgagggtgaggtggttgtggagaagctaaaggctagtgaatgggagattggctataatgccatgacagacaagtatgagaatttgatggaggctggagtcattgatccggcaaaggtgacaagatgtgctctgcagaattctgcatctgttgctggaatggtcttgaccacccaggccattgttgtagaaaagcccaagcccaagacacctgcagctgctgctacacaaggccaatatgctgtgtaa

SEQ ID NO: 1065 - protein, 611 aa, Populus balsamifera subsp. trichocarpa
  misc_feature (1)..(611): Ceres ANNOT ID no.1488631
  misc_feature (1)..(611): Bit score of 1574.5 for HMM based on sequences of FIGURE 34.
  misc_feature (144)..(595): Pfam Name: Cpn60_TCP1 Pfam Description: TCP-1/cpn60 chaperonin family
  misc_feature (68)..(595): Pfam Name: Cpn60_TCP1 Pfam Description: TCP-1/cpn60 chaperonin family
  misc_feature (1)..(611): Functional Homolog Of Ceres SEEDLINE ID no. ME13021 at SEQ ID NO: 1054
MATSNALSTASILCSPKQGGLRRRGNQQNNSRLNYGLSSRRFSVRANAKDIAFDQKSRAALQSGIDKLADAVGLTLGPRGRNVVLDEFGSPKVVNDGVTIARAIELPDPMENAGAALIREVTLSHTIPLSRALSKVLCLGLWLKVASKTNDSAGDGTTTASVLAREIIKLGLLSVTSGANPVSIKRGIDKTVQGLVEELEKKARPVKGRDDIKAVASISAGNDELIGTMIADAIDKVGPDGVLSIESSSSFETVVEVEEGMEIDRGYISPQFVTNPEKLICEFENARVLITDQKITAIKDIIPLLEKTTQLRAPLLIIAEDVTGEALATLVVNKLRGVLNVAAIKAPGFGERRKAMLQDIAILTGAEFQASDLGLSIENTSIEQLGLARKVTISKDSTTIIADAASKDELQARIAQLKKELSETDSVYDSEKLAERIAKLSGGVAVIKVGAATETELEDRKLRIEDAKNATFAAIEEGIVPGGGAALVHLSTCVPAIKDKIEDADERLGADIVQKALVSPASLIAQNAGIEGEVVVEKLKASEWEIGYNAMTDKYENLMEAGVIDPAKVTRCALQNSASVAGMVLTTQAIVVEKPKPKTPAAAATQGQYAV

SEQ ID NO: 1066 - DNA, 1611 bp, Populus balsamifera subsp. trichocarpa
  misc_feature (1)..(1611): Ceres ANNOT ID no.1474154
  misc_feature (1)..(1611): Encodes the peptide sequence at SEQ ID NO 1067
atgtccttctccttctctatctccggacctcttgccttccctcaacaacccctattctctagtcttggtgggaacaaaagggcaagtgggatatggagaaaccatcaagtagtgaataaattagtggtaagagcaggtccaaagaagatatcttttggtaaagattgtagagaagccttgcaggcaggaattgataagcttgctgatgctgtttctctcactttagggcctcaaggtcgtaatgttgttctttcggattcaaagacgctaaaagtagtaaatgatggtgttacaatagctcgtgcaatagagcttccggattcaatggagaatattggagcaattttaatccaagaggttgctagtaaaatgaatgatatggctggagatggcactactactgctattattttggctctggtcgcttcaatttctgctggaaatgatgaatttgttgggaacctaattgctgaaactatagagaagattggctctgatggagtaatctctcttgaatcatcttcaacctctgatacatttgtgataatagaagaaggaatgaagtttgacaagggttatatgtcaccccaattcatcacaaaccaggaaaaatctttggtggagtttgacaaggccaaagtccttgtaacggatcagaagattgcaaatgtccaagaaatagttcctgtgttggagaagactacccaactcagtgtcccattgttaatcattgctgaggatatctcaaagccagttttggaaacactagtgttgaacaaaatgaaaggtttgctcaatgttgctgttgtcaaatgccctggatttggagatcgaaagaaagcattgttgcaagacattgctcttatgacaggtgctgattttctctctggtgattttgggctgacactcggaagtgtaacctcggatcaacttggcattgcacgaaaagttaccataacaagtaattcaacaaccatagttgctgactcagctaccaaagctgaaattcaggcaagaatccttcagataaaaaaggacctcgctgaaacagataatgctgctctttcaagaaagctctcagagagaattgctaaattatctggtggtgtggctgtaatcaaggtaggagcacacacggagacagaacttgaagataggaaactcagaattgaagatgcaaagaatgctacatttgctgccatggatgaagggatagtacctggtggtggtgcaacatatgtacatctctcggagcagatctcctcaataaaaaattccatgaaagatgaaaatgagaagattggtgctgatattgttgcaaaggcacttcttgcacctgcaaaaacaattgcaactaatgcaggggttgatggagcagttgtggtggataatattcgatcttgtgactggagaactggttacaatgcaatgactggtagatatgaagatcttctcaatgcaggggtggtagatccttgtagagtttctaggtgtgcacttcaaagtgctgtctcaattgctgggatagttctaacaactcaagctgtgctggttgaaaaaataaagaagcccaagcccgctgtcccttgtgttcctggaattacaccttga

SEQ ID NO: 1067 - protein, 536 aa, Populus balsamifera subsp. trichocarpa
  misc_feature (1)..(536): Ceres ANNOT ID no.1474154
  misc_feature (1)..(536): Bit score of 1063.3 for HMM based on sequences of FIGURE 34.
  misc_feature (67)..(521): Pfam Name: Cpn60_TCP1 Pfam Description: TCP-1/cpn60 chaperonin family
  misc_feature (1)..(536): Functional Homolog Of Ceres SEEDLINE ID no. ME13021 at SEQ ID NO: 1054
MSFSFSISGPLAFPQQPLFSSLGGNKRASGIWRNHQVVNKLVVRAGPKKISFGKDCREALQAGIDKLADAVSLTLGPQGRNVVLSDSKTLKVVNDGVTIARAIELPDSMENIGAILIQEVASKMNDMAGDGTTTAIILALVASISAGNDEFVGNLIAETIEKIGSDGVISLESSSTSDTFVIIEEGMKFDKGYMSPQFITNQEKSLVEFDKAKVLVTDQKIANVQEIVPVLEKTTQLSVPLLIIAEDISKPVLETLVLNKMKGLLNVAVVKCPGFGDRKKALLQDIALMTGADFLSGDFGLTLGSVTSDQLGIARKVTITSNSTTIVADSATKAEIQARILQIKKDLAETDNAALSRKLSERIAKLSGGVAVIKVGAHTETELEDRKLRIEDAKNATFAAMDEGIVPGGGATYVHLSEQISSIKNSMKDENEKIGADIVAKALLAPAKTIATNAGVDGAVVVDNIRSCDWRTGYNAMTGRYEDLLNAGVVDPCRVSRCALQSAVSIAGIVLTTQAVLVEKIKKPKPAVPCVPGITP

SEQ ID NO: 1068 - protein, 586 aa, Arabidopsis thaliana
  misc_feature (1)..(586): Public GI ID no.15226314
  misc_feature (1)..(586): Bit score of 1582.9 for HMM based on sequences of FIGURE 34.
  misc_feature (68)..(571): Pfam Name: Cpn60_TCP1 Pfam Description: TCP-1/cpn60 chaperonin family
  misc_feature (1)..(586): Functional Homolog Of Ceres SEEDLINE ID no. ME13021 at SEQ ID NO: 1054
MASANALSSASVLCSSRQSKLGGGNQQQGQRVSYNKRTIRRFSVRANVKEIAFDQHSRAALQAGIDKLADCVGLTLGPRGRNVVLDEFGSPKVVNDGVTIARAIELPNAMENAGAALIREVASKTNDSAGDGTTTASILAREIIKHGLLSVTSGANPVSLKRGIDKTVQGLIEELQKKARPVKGRDDIRAVASISAGNDDLIGSMIADAIDKVGPDGVLSIESSSSFETTVEVEEGMEIDRGYISPQFVTNPEKLLAEFENARVLITDQKITAIKDIIPILEKTTQLRAPLLIIAEDVTGEALATLVVNKLRGVLNVVAVKAPGFGERRKAMLQDIAILTGAEYLAMDMSLLVENATIDQLGIARKVTISKDSTTLIADAASKDELQARIAQLKKELFETDSVYDSEKLAERIAKLSGGVAVIKVGAATETELEDRKLRIEDAKNATFAAIEEGIVPGGGAALVHLSTVIPAIKETFEDADERLGADIVQKALLSPAALIAQNAGVEGEVVVEKIMFSDWENGYNAMTDTYENLFEAGVIDPAKVTRCALQNAASVAGMVLTTQAIVVDKPKPKAPAAAAPEGLMV

SEQ ID NO: 1069 - DNA, 1996 bp, Arabidopsis thaliana
  misc_feature (1)..(1996): Ceres CLONE ID no.25773
  misc_feature (1)..(1996): Encodes the peptide sequence at SEQ ID NO 1070
attcgtttacactaaccacttccttatccacaccaatccagaacgttcctcaaaaagctccctccttttctctcaaaatggcgtctgcaaacgctctctcttccgcctccgtcctctgttcttcccgtcagagtaagttgggaggaggaaatcagcagcaaggtcagagagttagctacaacaagaggacaatcagacgttttagtgttagagctaatgtaaaggaaatagcttttgaccagcactctagagctgctctacaagctggtattgataagcttgctgattgtgttggtctcactcttggccctagagggaggaatgttgtgttggatgaatttggaagtcctaaggttgtgaatgatggagtcaccattgctagagctattgagttacctaatgccatggaaaatgctggtgcagcgcttattcgtgaggttgcgagtaagactaatgactctgctggtgatgggacaaccactgcgtctatccttgctcgggagataatcaaacatggattgttgagcgtcacttctggtgcgaatcccgtttcactcaagaggggaattgataagactgttcaaggtctgatcgaagagcttcagaagaaagctaggcccgtgaaagatcgtgatgacatcagagctgtggcttctatctctgctggaaatgatgaccttatagggtcaatgattgctgatgccatcgacaaagttggacctgatggtgttttgtccattgaatcttcatcttcttttgagaccacggtcgaagttgaagaagggatggagattgacagaggttacatctcgcctcagtttgttacaaaccctgagaaactactagctgagtttgagaatgctagggtattgatcactgatcagaagatcactgcgatcaaagacatcatccctattttggagaagaccactcagcttcgtgctccgttgttgattattgcagaggatgttactggtgaagccttagctacccttgtcgtgaacaagcttcgtggtgtcctcaatgttgttgccgttaaagcgccaggatttggagaaagaagaaaagccatgcttcaagatattgcaatcttgacaggagctgagtacctagccatggacatgagcttactggttgaaaacgcaaccatagatcaattgggtattgcccgaaaagtcacgattagcaaagattcgactaccctcattgcagatgcagcttccaaggacgaattacaagctcggattgctcagctgaagaaagaactattcgagactgattctgtgtatgactcagagaagctcgctgagagaattgcgaagctatctggaggtgttgctgtcattaaagtcggagcagcaactgaaactgagcttgaggaccgtaagcttcgtatcgaggatgcaaagaacgcaacatttgctgctatcgaggaaggcatagttccaggtggtggtgctgctttggtgcatctctccactgttattcccgccattaaggagacttttgaggatgctgatgaacgtttgggagctgacatagtacaaaaggcattgctgtcaccagctgctcttattgctcagaacgctggagttgaaggagaagttgttgtggaaaagattatgttcagcgattgggagaatgggtacaacgcaatgactgatacatatgagaatctgttcgaagctggagtgattgatccggctaaagtgacaagatgtgcgctacagaacgctgcttccgtagcaggaatggtactgaccactcaggccattgttgttgacaaaccgaaacccaaggctcctgctgctgctgctcctgagggtctcatggtgtaatcaaaacacaacatcttatcatcacaatggcatctttgtctttttgcacatttgtcatccccatttatctgcaatgtttttcttttttgggggaatatgagtagtttgttaacagtatcgagaaataattatcatcttttttgtccaatggaaattgc

SEQ ID NO: 1070 - protein, 586 aa, Arabidopsis thaliana
  misc_feature (1)..(586): Ceres CLONE ID no.25773
  misc_feature (1)..(586): Bit score of 1581.8 for HMM based on sequences of FIGURE 34.
  misc_feature (68)..(571): Pfam Name: Cpn60_TCP1 Pfam Description: TCP-1/cpn60 chaperonin family
  misc_feature (1)..(586): Functional Homolog Of Ceres SEEDLINE ID no. ME13021 at SEQ ID NO: 1054
MASANALSSASVLCSSRQSKLGGGNQQQGQRVSYNKRTIRRFSVRANVKEIAFDQHSRAALQAGIDKLADCVGLTLGPRGRNVVLDEFGSPKVVNDGVTIARAIELPNAMENAGAALIREVASKTNDSAGDGTTTASILAREIIKHGLLSVTSGANPVSLKRGIDKTVQGLIEELQKKARPVKDRDDIRAVASISAGNDDLIGSMIADAIDKVGPDGVLSIESSSSFETTVEVEEGMEIDRGYISPQFVTNPEKLLAEFENARVLITDQKITAIKDIIPILEKTTQLRAPLLIIAEDVTGEALATLVVNKLRGVLNVVAVKAPGFGERRKAMLQDIAILTGAEYLAMDMSLLVENATIDQLGIARKVTISKDSTTLIADAASKDELQARIAQLKKELFETDSVYDSEKLAERIAKLSGGVAVIKVGAATETELEDRKLRIEDAKNATFAAIEEGIVPGGGAALVHLSTVIPAIKETFEDADERLGADIVQKALLSPAALIAQNAGVEGEVVVEKIMFSDWENGYNAMTDTYENLFEAGVIDPAKVTRCALQNAASVAGMVLTTQAIVVDKPKPKAPAAAAPEGLMV

SEQ ID NO: 1071 - protein, 575 aa, Arabidopsis thaliana
  misc_feature (1)..(575): Public GI ID no.15239580
  misc_feature (1)..(575): Bit score of 1126.0 for HMM based on sequences of FIGURE 34.
  misc_feature (55)..(559): Pfam Name: Cpn60_TCP1 Pfam Description: TCP-1/cpn60 chaperonin family
  misc_feature (1)..(575): Functional Homolog Of Ceres SEEDLINE ID no. ME13021 at SEQ ID NO: 1054
MFAVSPSSFSPTTISPRRSGQRNEPRKFSVVRAGAKRILYGKDSREKLQAGIDKLADAVSITLGPRGRNVVLAEKDTIKVINDGVTIAKSIELPDTIENAGATLIQEVAIKMNESAGDGTTTAIILAREMIKAGSLAIAFGANAVSVKNGMNKTVKELVRVLQMKSIPVQGKNDIKAVASISAGNDEFVGNLIAETVEKIGPDGVISIESSSTSETSVIVEEGMKFDKGYMSPHFITNQEKSTVEFDKAKILVTDQKITSAKELVPLLEKTSQLSVPLLIIAEDISAEVLEILVVNKKQGLINVAVVKCPGMLDGKKALLQDIALMTGADYLSGDLGMSLMGATSDQLGVSRRVVITANSTTIVADASTKPEIQARIAQMKKDLAETDNSYLSKKIAERIAKLTGGVAVIKVGGHTETELEDRKLRIEDAKNATFAAMREGIVPGGGATYIHLLDEIPRIKKNLMEDSYEQIGADIVAMALTAPAMAIATNAGVDGSVVVQKTRELEWRSGYNAMSGKYEDLLNAGIADPCRVSRFALQNAVSVAGIILTTQAVLVEKIKQPKPAVPQVPGIPTS

SEQ ID NO: 1072 - protein, 583 aa, Brassica napus
  misc_feature (1)..(583): Public GI ID no.464727
  misc_feature (1)..(583): Bit score of 1546.3 for HMM based on sequences of FIGURE 34.
  misc_feature (67)..(568): Pfam Name: Cpn60_TCP1 Pfam Description: TCP-1/cpn60 chaperonin family
  misc_feature (1)..(583): Functional Homolog Of Ceres SEEDLINE ID no. ME13021 at SEQ ID NO: 1054
MATANALSSPSVLCSSRQGKLSGGSQQKGQRVSYRKANRRFSLRANVKEIAFDQSSRAALQAGIDKLADAVGLTLGPRGRNVVLDEFGSPKVVNDGVTIARAIELPDAMENAGAALIREVASKTNDSAGDGTTTASVLAREIIKHGLLSVTSGANPVSLKRGIDKTVQALIEELEKRSRPVKGGRDIKAVATISAGNDELIGAMIADAIDKVGPDGVSPIESSSSFETTVEVEEGMEIDRGYISPQFVTNPEKLLVEFENARVLITDQKITAIKDIIPILEKTTQLRAPLLIIAEDVTGEALATLVVNKLRGVLNVVAVKAPGFGERRKAMLQDIAILTEPSTALDMGLLVENTTIDQLGIARKVTISKDSTTLIADAASKAELQARISQLKKESFETDSVYDSEKLAERIAKLSGGVAVIKVGAATETELEDRKLRIEDAKNATFAAIEEGIVPGGGATLVHLSTVIPAIKETFEDADVRLGADIVQKALVAQSLIAQNAGIEGEVVVEKIMFSEWELGYNAMTDTYENLLEAGVIDPAKVTRCALQNAASVAGMVLTTQAIVVDKPKPKAPAAAAPEGLMV

SEQ ID NO: 1073 - DNA, 1971 bp, Glycine max
  misc_feature (1)..(1971): Ceres CLONE ID no.480644
  misc_feature (1)..(1971): Encodes the peptide sequence at SEQ ID NO 1074
gttgttgttttcagtgtagtggaagaatcactcccttatccatttccacaccacaccatggcctcaaccaacgctctctcttcagcctccattctacgctctcccaaccgccagtctctgacccgaagagcgaaccataatggaagagtaaattaccggaaaccgaataaccgtttctccgtgaaagcctccgccaaagagattgcctttgaccagcattcccgctctgctatgcaggccggcattgacaagctcgccgacgctgttgggctcactcttgggcccagagggaggaatgttgtgttggatgagtttggaagtcctaaagtggtcaacgatggtgtcaccattgctcgcgcaatcgagcttcccgatcctatggagaatgctggtgcagctcttatcagagaggttgctagcaagactaacgactctgcgggtgatgggactaccacggcttcggttcttgctcgcgagataattaagctggggcttctcagtgtgacttctggggcaaatcctgtgtctcttaagagagggattgataagactgtgcagggtttggtggaggagttggagaagaaggctaggcctgtcaaaggtggagatgatatcaaagctgttgcttccatttctgctggaaatgatgagttgattgggcaaatgattgcggaagcaattgataaggttggacctgatggtgttttgtccattgagtcttcatcatcgtttgagaccacagttgaagtggaagaaggaatggagattgacagagggtatatctcgcctcaatttgttacaaaccctgagaagttgattgttgaatttgagaatgcgagagtgttgattacagatcagaagatttcagcaataaaagacattataccactgttggagaaaaccactcagttgagagctcctttgcttatcattgccgaggatgtcactggtgaggctttggccacccttgtcgtgaataagctgcgtggtatccttaacgttgctgccattaaagctcctggctttggtgagcggcgaaaggccctgcttcaagacattgctatattgactggtgctgagttccaagctagtgatctgggtctgcttgttgaaaacacctcagtggagcagcttggtttggctaggaaaattaccatctccaaggattctaccactgtcattgctgatgctgcgacaaaggatgagttgcaagccagggttgctcagttaaagaaggagctgtctcagacagactcagtatatgatactgagaaactggctgagaggatagctaaactgtctggtggagttgcagtcatcaaggttggtgctgctacagagactgagcttgaggatcggaagctccgaatagaggatgccaagaatgcaacttttgctgccattgaggaaggtattgtacctgggggtggcactgcactggttcatctctccactcatgtcccagcaatcaaggacaagcttgaggatgcagatgagaggctaggagctgacattgtgcaaaaggcactgatagctcctgcagcattgattgctcaaaatgctggaatagaaggtgaagttgttgtggagaaaataaagagtggtgaatgggaggtcggttacaatgccatggcagacaggtatgagaatttagtggaggctggagttatcgaccctgccaaggtaactaggtgtgctttgcagaatgctgcttcagttgctggaatggtgttgaccacgcaggccattgtggtggagaaacctaagcccaaggcacctgtagctggtgccccacaaggccttaccgtttgatttttaggctgtagggctacggcgaagaacagttttgtgcagaaaattgaaagtgcgtatgtgttcgaattctgttcaatcggaaaaaaaaatgtatttgtaaacagttttagatttgttgggcttgatgagagaaaagagattataatattggattcc

SEQ ID NO: 1074 - protein, 584 aa, Glycine max
  misc_feature (1)..(584): Ceres CLONE ID no.480644
  misc_feature (1)..(584): Bit score of 1615.9 for HMM based on sequences of FIGURE 34.
  misc_feature (66)..(569): Pfam Name: Cpn60_TCP1 Pfam Description: TCP-1/cpn60 chaperonin family
  misc_feature (1)..(584): Functional Homolog Of Ceres SEEDLINE ID no. ME13021 at SEQ ID NO: 1054
MASTNALSSASILRSPNRQSLTRRANHNGRVNYRKPNNRFSVKASAKEIAFDQHSRSAMQAGIDKLADAVGLTLGPRGRNVVLDEFGSPKVVNDGVTIARAIELPDPMENAGAALIREVASKTNDSAGDGTTTASVLAREIIKLGLLSVTSGANPVSLKRGIDKTVQGLVEELEKKARPVKGGDDIKAVASISAGNDELIGQMIAEAIDKVGPDGVLSIESSSSFETTVEVEEGMEIDRGYISPQFVTNPEKLIVEFENARVLITDQKISAIKDIIPLLEKTTQLRAPLLIIAEDVTGEALATLVVNKLRGILNVAAIKAPGFGERRKALLQDIAILTGAEFQASDLGLLVENTSVEQLGLARKITISKDSTTVIADAATKDELQARVAQLKKELSQTDSVYDTEKLAERIAKLSGGVAVIKVGAATETELEDRKLRIEDAKNATFAAIEEGIVPGGGTALVHLSTHVPAIKDKLEDADERLGADIVQKALIAPAALIAQNAGIEGEVVVEKIKSGEWEVGYNAMADRYENLVEAGVIDPAKVTRCALQNAASVAGMVLTTQAIVVEKPKPKAPVAGAPQGLTV

SEQ ID NO: 1075 - protein, 595 aa, Medicago truncatula
  misc_feature (1)..(595): Public GI ID no.124301264
  misc_feature (1)..(595): Bit score of 1398.9 for HMM based on sequences of FIGURE 34.
  misc_feature (61)..(564): Pfam Name: Cpn60_TCP1 Pfam Description: TCP-1/cpn60 chaperonin family
  misc_feature (1)..(595): Functional Homolog Of Ceres SEEDLINE ID no. ME13021 at SEQ ID NO: 1054
MNTQIHPHTSLLFFPPNRFNFISSFSSFRRRNPQFAVRASPKKISFGKECRENLQVGIDKLADAVSLTVGPKGRNVILSESGKLKVINDGVTIARSIELSDAIENAGAMLIQEVASKMNDLAGDGTSTAIILARAMIKSGLSAVAFGANPISLKKGMEKTVKDLVKFLKKRSIPVEGRDHIKAVASISAGNDEYVGNLIAEAIEKIGFDGVITIESSRSSETSVVIEEGMKIDRGYMSPHFITNQEKSIVEFDNAKVLVTDQKISSVREIVPLLEKAMQLSAPLLIIAEDVTAQVLETLIVNKMQGLLRVAAVKCPGLGDGKKALLQDIALMTGADFLCGDLGLTLEGTTSDQLGSALKVKITSNATTIFADPNTKAEIQARILQIKKDLIETDNANHSRKLSERIAKLTGGIAVIKVGAHTELELEDRKLRIEDAKNATFAAINEGLVPGGGATYVHLLDLIPAIKNSMEDLDEQIGADIVAKALVEPAKSIAANAGVDGDVVVEKTRTFDWRIGYNAMTGTYEDLLNAGVADPSRVARCALQSAVSIAGVVLTTQAILVDKYLGSNKNALTNGKVTVAVSYSWGMMKPMYYKA

SEQ ID NO: 1076 - protein, 587 aa, Pisum sativum
  misc_feature (1)..(587): Public GI ID no.1710807
  misc_feature (1)..(587): Bit score of 1595.8 for HMM based on sequences of FIGURE 34.
  misc_feature (69)..(572): Pfam Name: Cpn60_TCP1 Pfam Description: TCP-1/cpn60 chaperonin family
  misc_feature (1)..(587): Functional Homolog Of Ceres SEEDLINE ID no. ME13021 at SEQ ID NO: 1054
MASTNALSSTSILRSPTNQAQTSLSKKVKQHGRVNFRQKPNRFVVKAAAKDIAFDQHSRSAMQAGIDKLADAVGLTLGPRGRNVVLDEFGSPKVVNDGVTIARAIELPDPMENAGAALIREVASKTNDSAGDGTTTASILAREIIKLGLLNVTSGANPVSIKKGIDKTVAALVEELEKLARPVKGGDDIKAVATISAGNDELIGKMIAEAIDKVGPDGVLSIESSNSFETTVEVEEGMEIDRGYISPQFVTNPEKSIVEFENARVLITDQKISAIKDIIPLLEKTTQLRAPLLIISEDITGEALATLVVNKLRGILNVAAIKAPGFGERRKALLQDIAILTGAEFQASDLGLLVENTTIEQLGLARKVTISKDSTTIIADAASKDELQSRVAQLKKELSETDSIYDSEKLAERIAKLSGGVAVIKVGAATETELEDRKLRIEDAKNATFAAIEEGIVPGGGTALVHLSGYVPAIKEKLEDADERLGADIVQKALVAPAALIAQNAGIEGEVVVEKIKNGEWEVGYNAMTDTYENLVESGVIDPAKVTRCALQNAASVAGMVLTTQAIVVEKPKPKAAVAAAPQGLTI

SEQ ID NO: 1077 - protein, 600 aa, Solanum commersonii
  misc_feature (1)..(600): Public GI ID no.110349923
  misc_feature (1)..(600): Bit score of 1322.4 for HMM based on sequences of FIGURE 34.
  misc_feature (77)..(582): Pfam Name: Cpn60_TCP1 Pfam Description: TCP-1/cpn60 chaperonin family
  misc_feature (1)..(600): Functional Homolog Of Ceres SEEDLINE ID no. ME13021 at SEQ ID NO: 1054
MASTFAGMSSAGPLAAPSTSSNKLSSVANISSTSFGSKRNVALRKSRRLTILAAAKELHFNKDGSAIKKLQNGVNKLADLVGVTLGPKGRNVVLESKYGAPKIVNDGVTVAREVELEDPVKNIGAKLVRQAAAKTNDLAGDGTTTSVVLAQGLIAEGVKVVAAGANPVLITRGIEKTAKALVAELKNMSKEVEDSELPDVAAVSAGNNLEVGSMIAEPMSTVGRKGVVTLEEGKSAENSLRVVEGMQFDRGYFAPYFVTDSEKMSVEYDNCKLLLVDKKITNAKDLVNVLKDAIRNGSPTLIIAENIDQEALATLVVNKLRGALKVAALKAPGFGERKSQYLDDIATLTGGTVIREELGLTLDKADKEVLGHAAKVVLTKDATTIVGDGSTQEAVNKRVAQIKNLIEAADQDYEKEKLNERIAKLSGGVAVIQVGAQTETELKEKKLRVEDALNATKAAVERGIVVGGGCTLLRLAAKVDAIKGTLANDEEKVGADIVQRALSYPLKLIAKNAGVNGSVVSEKVLSSDDPKFGYNAATGNYEDLIMAAGIIDPTKVVRCCLEHAASVAKTFLMSDCVVVEIKEPEAAVAGNPMDNSGYGY

SEQ ID NO: 1078 - protein, 599 aa, Solanum tuberosum
  misc_feature (1)..(599): Public GI ID no.1762130
  misc_feature (1)..(599): Bit score of 1343.0 for HMM based on sequences of FIGURE 34.
  misc_feature (77)..(581): Pfam Name: Cpn60_TCP1 Pfam Description: TCP-1/cpn60 chaperonin family
  misc_feature (1)..(599): Functional Homolog Of Ceres SEEDLINE ID no. ME13021 at SEQ ID NO: 1054
MASTFAGMSSAGPLAAPSTSSNKLSSVANISSTSFGSKRNVALRKSRRPTILAAAKELHFNKDGSAIKKLQNGVNKLADLVGVTLGPKGRNVVLESKYGAPKIVNDGVTVAREVELEDPVENIGAKLVRQAAAKTNDLAGDGTTTSVVLAQGLIAEGVKVVAAGANPVLITRGIEKTAKALVAELKNMSKEVEDSELADVAAVSAGNNLEVGSMIAEAMSKVGRKGVVTLEEGKSAENSLRVVEGMQFDRGYVSPYFVTDSEKMSVEYENCKLLLVDKKITNARDLVNVLEDAIRNGYPILIIAEDIEQEALATLVVNKLRGALKVAALKAPGFGERKSQYLDDIATLTGGTVIREELGLTLDKADKEVLGHAAKVVLTKDATTIVGDGSTQEAVNKRVAQIKNLIEAADQDYEKEKLNERIAKLSGGVAVIQVGAQTETELKEKKLRVEDALNATKAAVEEGIVVGGGCTLLRLAAKVDAIKGTLANDEEKVGADIVKRALSYPLKLIAKNAGVNGSVVSEKVLSSDDPKFGYNAATGNYEDLMAAGIIDPTKVVRCCLEHAASVAKTFLMSDCVVVEIKEPEAAVAGNPMDNSGYGY

SEQ ID NO: 1079 - DNA, 2243 bp, Triticum aestivum
  misc_feature (1)..(2243): Ceres CLONE ID no.706098
  misc_feature (1)..(2243): Encodes the peptide sequence at SEQ ID NO 1080
aacgttctagaatcttcacaaaccctcaacaaggttcccctccctcccctcccctgctccccctctgttcctccgccccctcatcgcagccgcctctctcccgaccaaaagccctagctagctagacccaccccatccatggcgaccatccccaccaccggctccgcctccctcctccggggctccgccgccctccagagggacgggaggtcaaccaggccgtcgtcggcggccaggccgctgccggggcgacgcgcgcgctcgttgtcggtcgtgcgcgcctccgccaaggacatcgccttcgaccaggcgtcgcgctccgccctccaggccggcgtcgagaagctcgccgccgccgtcggcgtcaccctcggccccagaggaaggaatgtcgttttggacgagtttggcagccccaaagtggtcaatgatggagttacaatcgcccgggctattgagcttgctgatcccatggagaatgctggtgctgctttgattcgtgaagttgctagcaagacaaatgactcggcgggtgatgggaccacgaccgcatctgttctggctcgtgagatcattaaactgggattgctgagtgttacctcaggggcaaatccagtgtcaattaagaagggcatagataagactgtgcaaagtttagttgaggaactcgagaagaagtcacgacctgtgaagggcagcggggacattaaagctattgctgccatatctgctggaaatgatgactttattggtaccatgatcgcggaggctattaacaaagttggccctgatggtgtcctctcgattgagtcatcatcgtcgtttgagaccactgttgaagttgaagaaggaatggagattgacagaggatacatctctcctcagtttgtcacaaactctgagaagtcagttgttgagtttgaaaacgctagagttcttgtcactgatcagaagatttcctcaatcaaagaaatccttcctttgttggagcaaactacgcagttgagagcaccacttctcataattgcagaggacgtatctggtgaggctttggcaactctagttgtcaacaagcttagaggaattctgaatgtagctgcgattaaagctcctggttttggtgaaaggcgcaaggctctccttcaggacattgccattgttacaggtgctgaatttcaagccaaagatcttggccaactgatcgagcagacaacagtggagcagctcggcatagccaggaaggtgacaatctccgggtcatccacaaccataatagcagatgttgccaccaaggatgagatccaggccagaatcgcacagctgaagagagagctttctcagacagactccacatatgattctgagaagctggcagagagaatagcaaagctctctggcggagttgccgtgatcaaggttggagctgcaaccgagacggagctcgaggaccgcaagctccgcatagaggatgccaagaatgcaacttttgcagccattgaggaaggtatagtacctggaggtggtgcggcctatgttcacctgtccacatttgtaccagccatcaaggagaagctggatgaccctgaggagcgcctcggtgctgatatcattcagaaggctctagtggcacccgcatcgttgatagcacacaatgcgggagtcgaaggggaggtgatcgtggagaaaatcaaggacagcgagtgggagtttggatacaacgcgatgaccgacaagcatgagaacctggtagaggctggcgtcatcgaccccgcgaaggtgacgaggtgtgccctgcagaacgcggcgtcggtggccggaatggtcctgaccacgcaggcgatcgtcgtggagaagcctagcaagaaggcccccgcgcccgccgggatgccccagggcatgatgtagaagcgcaatgatacgtagcaacctgggggcatgcaattttaggggcagtgggagtgatcatttctccaagggagataactgtgggtacctcgagaaatcattggtgtgtaatggatagtgatgacctgttctattgtctatttggtaccgctaatatcgtgaaaactattttgcctagctgagtttgagaagagtaataaatgagtaaagttgagcatgcccctgatttttctcttgattgtttgatctgggattttaggcaacaactggatgttctctctaggggaatgaaagcatgtaggcaggcagctttggctcaaagcctgaacactttttac

SEQ ID NO: 1080 - protein, 588 aa, Triticum aestivum
  misc_feature (1)..(588): Ceres CLONE ID no.706098
  misc_feature (1)..(588): Bit score of 1557.9 for HMM based on sequences of FIGURE 34.
  misc_feature (70)..(573): Pfam Name: Cpn60_TCP1 Pfam Description: TCP-1/cpn60 chaperonin family
  misc_feature (1)..(588): Functional Homolog Of Ceres SEEDLINE ID no. ME13021 at SEQ ID NO: 1054
MATIPTTGSASLLRGSAALQRDGRSTRPSSAARPLPGRRARSLSVVRASAKDIAFDQASRSALQAGVEKLAAAVGVTLGPRGRNVVLDEFGSPKVVNDGVTIARAIELADPMENAGAALIREVASKTNDSAGDGTTTASVLAREIIKLGLLSVTSGANPVSIKKGIDKTVQSLVEELEKKSRPVKGSGDIKAIAAISAGNDDFIGTMIAEAINKVGPDGVLSIESSSSFETTVEVEEGMEIDRGYISPQFVTNSEKSVVEFENARVLVTDQKISSIKEILPLLEQTTQLRAPLLIIAEDVSGEALATLVVNKLRGILNVAAIKAPGFGERRKALLQDIAIVTGAEFQAKDLGQLIEQTTVEQLGIARKVTISGSSTTIIADVATKDEIQARIAQLKRELSQTDSTYDSEKLAERIAKLSGGVAVIKVGAATETELEDRKLRIEDAKNATFAAIEEGIVPGGGAAYVHLSTFVPAIKEKLDDPEERLGADIIQKALVAPASLIAHNAGVEGEVIVEKIKDSEWEFGYNAMTDKHENLVEAGVIDPAKVTRCALQNAASVAGMVLTTQAIVVEKPSKKAPAPAGMPQGMM

SEQ ID NO: 1081 - DNA, 2041 bp, Zea mays
  misc_feature (1)..(2041): Ceres CLONE ID no.1597831
  misc_feature (1)..(2041): Encodes the peptide sequence at SEQ ID NO 1082
ctctagaagcctccgggtcgctcggtgtgggttgctaactactcgcagcagccagaggccagatccagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaaccacaactgcctctgttctcgctagggagatcatcaaattgggcatgttgagcattacttcaggggcaaatccagtgtccgttaagaagggcattgataagactgttcagaaattggtggaggaacttgagaagaaatcaaggccggtcaagggtagtggggatattaaagctgttgctgccatatcagctggaaatgatgaatttgttgggactatgatcgccgaagctattgacaaggttggccctgatggtgtcctctcaattgagtcgtcatcgtcgtttgagaccacagttgaagttgaagaagggatggagcttgacagaggatatatctcccctcagtttgtcactaaccttgaaaaatctattgttgagttcgaaaatgctcggattcttgtcactgatcagaagatatcatcgataaaagaaattattcctctgttggagcagacaacacagttaagagcaccacttcttataattgcagaggatgtaagtggcgaggcgctggcaacattagtcataaacaagcttagaggaattttaaatgtggctgcaatcaaagctcctggttttggtgagaggcgtaaagctcttcttcaggacattgccattgttacaggtgctgaatatcaatccaaagatcttggtctactagttgaggatacaacagtggagcagcttggcatagctcggaaagttacaatctcaagttcctcgacgaccattatagcagatgctgctagcaaagacgatatccaggccagaatcgcgcagctgaagagagagctttctcagacggactcgacgtatgactctgagaagttggcagagagaattgcaaagctttcaggtggagttgctgtggttaaggttggagcatcgaccgaggcagagctagaggaccgcaagctccgcatagaggacgcgaagaatgcgacttttgcagcaatagaggaaggtattgttccaggaggcggtgcagcgtatgtccatctatcgacattcgtaccggctatcaaggagacgttggatgatcctgaggagcgcctaggtgctgatatcattcagaaggctttggtggcacctgcagcgctgatagcccataatgctggggtggaaggtgaggtgattgtggataaaatccgggaaagcgagtgggagttcggttacaacgccatggcggacaagcacgagaacctggtggaggctggtgtgatcgaccctgccaaagtgactaggtgcgccctgcagaacgctgcctccgtggctggaatggtgctgactacccaagcaatcgttgtggagaagcccaagaaggctccagcagcagctgctgcagcggcaccatagggttctttcaccatgtaataatactttctagtgaaaaacaattttactaggcatggaacaggcacgttagagtgacgaggagaaaaaactatttttgtcatgcgtgggccggaataaattgagtcaggaattgcatggattttgggcc

SEQ ID NO: 1082 - protein, 584 aa, Zea mays
  misc_feature (1)..(584): Ceres CLONE ID no.1597831
  misc_feature (1)..(584): Bit score of 1524.8 for HMM based on sequences of FIGURE 34.
  misc_feature (69)..(572): Pfam Name: Cpn60_TCP1 Pfam Description: TCP-1/cpn60 chaperonin family
  misc_feature (1)..(584): Functional Homolog Of Ceres SEEDLINE ID no. ME13021 at SEQ ID NO: 1054
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKKGIDKTVQKLVEELEKKSRPVKGSGDIKAVAAISAGNDEFVGTMIAEAIDKVGPDGVLSIESSSSFETTVEVEEGMELDRGYISPQFVTNLEKSIVEFENARILVTDQKISSIKEIIPLLEQTTQLRAPLLIIAEDVSGEALATLVINKLRGILNVAAIKAPGFGERRKALLQDIAIVTGAEYQSKDLGLLVEDTTVEQLGIARKVTISSSSTTIIADAASKDDIQARIAQLKRELSQTDSTYDSEKLAERIAKLSGGVAVVKVGASTEAELEDRKLRIEDAKNATFAAIEEGIVPGGGAAYVHLSTFVPAIKETLDDPEERLGADIIQKALVAPAALIAHNAGVEGEVIVDKIRESEWEFGYNAMADKHENLVEAGVIDPAKVTRCALQNAASVAGMVLTTQAIVVEKPKKAPAAAAAAAP

SEQ ID NO: 1083 - protein, 581 aa, Canavalia lineata
  misc_feature (1)..(581): Public GI ID no.3790441
  misc_feature (1)..(581): Bit score of 1540.1 for HMM based on sequences of FIGURE 34.
  misc_feature (66)..(566): Pfam Name: Cpn60_TCP1 Pfam Description: TCP-1/cpn60 chaperonin family
  misc_feature (1)..(581): Functional Homolog Of Ceres SEEDLINE ID no. ME13021 at SEQ ID NO: 1054
MASTNALSSASILRSPNHQSLSRRANQNGRVNYRQPNHRFAVKASAKEIAFDQSSRAAIQAGIDKLADAVGLTLGPRGRNVVLDEFGSPKVVNDGVTIARAIELPDAMENAGAALIREVASKTNDSAGDGTTTASVLAREIIKLGLLSVTSGANPVSLKRGIDKTVQGLVEELEKRARPVKGGDDIKAVASISAGNDELIGKMIAEAIDKVGPDGVLSIESSSSFETTVEVEEGIEIDRGYISSFVTNLEKSIVEFENARVLVTDQKISAIKDIIPLLEKTTQLRAPLIIIAEDVTGEALATLVVNKLRGILNVAAIKAPSFGERRKAVLQDIAILTGAEFQASDLGLLVENTSIEQLGLARKVTISKDSTTIIADAASKDELQARVAQLKKELAETDAVYDSVKLAERITKLSGGVAVIKVGAATETELEDRKLRIEDAKNATFAIEVGIVLVDTALLHLSTHVPAIKDKLEDADERLGADIVQKALIAPASLIAQNAGIEGEVVVEKVKNGEWEVGYNAMTDRYENLVEAGVIDPAKVTRCALQNAASVAGMVLTTQAIVVEKPKPKAPTAAAPQGLTI

SEQ ID NO: 1084 - DNA, 2057 bp, Panicum virgatum
  misc_feature (1)..(2057): Ceres CLONE ID no.1795282
  misc_feature (1)..(2057): Encodes the peptide sequence at SEQ ID NO 1085
agaaccctcgcccgccttctcttccttcttttgtacgccaggccaacctacccctcctacaggacagccgccgccgccgcccccaaaaccctagctagtgctagtctagcagaggcaaccatggccaccatccccaccaccgattccgcccttctcctcggctcatccgctctccacagggccaggcgggcctcggcggcccggctgcccggagccaaccgccgtcgcccccaggccctggtgcgcgcgtccgccaaggagattgccttcgaccagggcgccagagcctccctccaggccggcgtcgagaagctcgccgccgcagtcggcgtcaccctcggccccagaggaaggaatgttgtcttggatgagtttggaacccccaaagtggtcaatgatggagttaccattgctcgtgctattgagctcgctgatcccatggagaatgctggtgcctcattgattcgtgaagttgctagcaagacaaacgactcggctggcgatgggaccacaactgcatccgttctcgccagggagatcataaaattgggtatgttgagtgttacttcaggggcaaacccggtgtctattaagaagggcattgataagactgttcaaaaattggtggaggaacttgagaagaagtccaggcctgtgaagggtggtggagatattaaagctgttgctgctatatcagctggaaatgatgaattcgttgggaccatgatcgctgaagctattgacaaggttggccctgatggtgtgctctcaatcgagtcgtcgtcatcatttgagaccacagttgaagttgaagaagggatggagcttgacagaggatatatctcccctcagtttgtcaccaaccctgagaaatcaactgtggagttcgaaaatgctcgaattctcgtcactgaccagaagatatcatcgataaaagaaatccttcccttgttggagcaaactacgcagttaagagcaccacttctaataattgcagaggatgtaagtggtgaggctttggcaactttagttgtcaacaagcttagaggaatcctaaatgtggctgcaatcaaagctcctggtttcggtgagaggcgtaaagctcttcttcaagacattgctattgttacaggtgctgaatatcaatccaaagatcttggcttactagttgagaagacaacagttgagcagctgggcatagctcgcaaagtgacgatctccagctcgtcgacgacgattatagcagatgctgcaagcaaagatgatatccaggccagaattgcgcagctgaagagagagctttctcagacggactcgacatatgactctgagaagcttgcggagagaatcgcaaagctttctggtggcgttgctgtgataaaggttggtgcttcgactgaggcggagcttgaggaccgcaagctccgcatagagaatgcaaagaatgcaacttttgcggccatcgaggaaggtattgtacctggagggggtgcagcctacgttcatctatcaacatttgtgccggctatcaaggagaagttggatgatcctgaagagcgccttggtgctgatatcattcagaaggcccttgtagcacctgcagcactgatagcgcacaatgctggggttgaaggtgaggtgattgtagataaaatcaaggagagcgaatgggagtatggttacaatgccatggctgacaaacacgagaacttggtagaggctggtgtgatcgaccctgccaaggtcacgagatgcgccctgcagaatgccgcgtcagttgctggaatggtgctgaccacccaggctattgtcgtggagaagccgaagaagaaggctcccgcagctgctggggcacctgagggttcatttgccatgtaatgcgagaataaattttactaggcctgttgggggtggggtggggggatgcaaatctttgagcaaggggagaggagagagaaccggaatctgtgtcttgatctgttgccgaagctgataaactcttttatcctgaattgtttcgctaagctggcggagtgggcagataataaatttattat

SEQ ID NO: 1085 - protein, 585 aa, Panicum virgatum
  misc_feature (1)..(585): Ceres CLONE ID no.1795282
  misc_feature (1)..(585): Bit score of 1554.8 for HMM based on sequences of FIGURE 34.
  misc_feature (65)..(568): Pfam Name: Cpn60_TCP1 Pfam Description: TCP-1/cpn60 chaperonin family
  misc_feature (1)..(585): Functional Homolog Of Ceres SEEDLINE ID no. ME13021 at SEQ ID NO: 1054
MATIPTTDSALLLGSSALHRARRASAARLPGANRRRPQALVRASAKEIAFDQGARASLQAGVEKLAAAVGVTLGPRGRNVVLDEFGTPKVVNDGVTIARAIELADPMENAGASLIREVASKTNDSAGDGTTTASVLAREIIKLGMLSVTSGANPVSIKKGIDKTVQKLVEELEKKSRPVKGGGDIKAVAAISAGNDEFVGTMIAEAIDKVGPDGVLSIESSSSFETTVEVEEGMELDRGYISPQFVTNPEKSTVEFENARILVTDQKISSIKEILPLLEQTTQLRAPLLIIAEDVSGEALATLVVNKLRGILNVAAIKAPGFGERRKALLQDIAIVTGAEYQSKDLGLLVEKTTVEQLGIARKVTISSSSTTIIADAASKDDIQARIAQLKRELSQTDSTYDSEKLAERIAKLSGGVAVIKVGASTEAELEDRKLRIENAKNATFAAIEEGIVPGGGAAYVHLSTFVPAIKEKLDDPEERLGADIIQKALVAPAALIAHNAGVEGEVIVDKIKESEWEYGYNAMADKHENLVEAGVIDPAKVTRCALQNAASVAGMVLTTQAIVVEKPKKKAPAAAGAPEGSFAM

SEQ ID NO: 1086 - protein, 584 aa, Oryza sativa subsp. indica
  misc_feature (1)..(584): Public GI ID no.125546535
  misc_feature (1)..(584): Bit score of 1548.0 for HMM based on sequences of FIGURE 34.
  misc_feature (64)..(567): Pfam Name: Cpn60_TCP1 Pfam Description: TCP-1/cpn60 chaperonin family
  misc_feature (1)..(584): Functional Homolog Of Ceres SEEDLINE ID no. ME13021 at SEQ ID NO: 1054
MATMPSTCASSSSLFLLLRKDRRSSRSASLPGPARRLGVVRASAKEIAFDQGSRSSLQAGVEKLAAAVAVTLGPRGRNVVLDEFGSPKVVNDGVTIARAIELADPMENAGAALIREVASKTNDSAGDGTTTASVLAREIIKLGLLSVTSGANPVSIKKGIDKTVHSLVEELEKKSRPVKGSGDIKAVAAISAGNDDFVGTMIAEAIDKVGPDGVLSIESSSSFETTVEVEEGMEIDRGYISPQFVTNPEKSLVEFENARILVTDQKISSIKEIIPLLEQTTQLRAPLLIIAEDVAGEALATLVVNKLRGILNVAAIKAPGFGERRKALLQDIAIVTGAEFQAKDLGLLVESTTVEQLGIARKVTISQSSTTIIADVATKDEIQARIAQLKRELSQTDSAYDSEKLAERIAKLSGGVAVIKVGAATETELEDRKLRIEDAKNATFAAIEEGIVPGGGAAYVHLSKFVPAIKEKLDDPEERLGADIIQKALVAPAALIAHNAGVEGEVIVEKIKESEWEVGYNAMADRHENLVQAGVIDPAKVTRCALQNAASVAGMVLTTQAIVVEKPKKKASAASGAPEGSLAM

SEQ ID NO: 1087 - protein, 584 aa, Oryza sativa subsp. indica
  misc_feature (1)..(584): Public GI ID no.125564719
  misc_feature (1)..(584): Bit score of 1078.5 for HMM based on sequences of FIGURE 34.
  misc_feature (59)..(562): Pfam Name: Cpn60_TCP1 Pfam Description: TCP-1/cpn60 chaperonin family
  misc_feature (1)..(584): Functional Homolog Of Ceres SEEDLINE ID no. ME13021 at SEQ ID NO: 1054
MSLTTVSFSYPAKPLPKWPCTLPKPPPRARCRFVVRADVKVISSGEACRRGLAAGIDKLADAVAVTLGPKGRNVVIDQDDVPKVINDGITIAKAIELPNAVEHAGAMLLQEIASKTNSSVGDGTTTAIILAREIINLGLLAVATGANPVALRKGIDKAVHELIGILKTKCIPVSTKEDIKAVASISAGNDEYVGDLIADALEKIGPDGIIKIESSSSIYTSVEVQEGMKIDKGYISPHFITNQDKAIVEFENARVLLTDQRVDDVQEILPLLEKTTQLSVPLLIIAEDVSHTVYSTLVLNKLNGLLNVAVVKCPGLGDEKKAILQDIAIMTGADFFASDLGWCLQGATSDQLGMAQKITITSDTTTIIAHPSMRPEIEARIQQLKKDLEETTSAYLKERFSARIAKLSRGIAVIKVGAATEAELEDRKLRAEDAKNATFAAISEGITPGGGVTYVQLSKYIPSIMDLVDDSEEKIGVNIVGKALLVPAITIARNAGADGPAVVEKLLASEWRVGYNAMTDQFEDLVDAGVVDPCRVARCVLQNSASIAGLILMTQAMMFDKIKKKKSPIPQIPGIPPLQINQNA

SEQ ID NO: 1088 - protein, 578 aa, Oryza sativa subsp. japonica
  misc_feature (1)..(578): Public GI ID no.115488160
  misc_feature (1)..(578): Bit score of 1553.7 for HMM based on sequences of FIGURE 34.
  misc_feature (59)..(562): Pfam Name: Cpn60_TCP1 Pfam Description: TCP-1/cpn60 chaperonin family
  misc_feature (1)..(578): Functional Homolog Of Ceres SEEDLINE ID no. ME13021 at SEQ ID NO: 1054
MASANAISTASLLRSFSSQGRVRRAKNGRAQRLVVRADAKDIAFDQKSRAALQAGVEKLANAVGVTLGPRGRNVVLDEYGSPKVVNDGVTIARAIELYDPMENAGAALIREVASKTNDSAGDGTTTASVLAREIIKLGLLSVTSGANPVSLKKGIDKTVHGLIEELEKKARPVKGSGDIKAVASISAGNDELIGSMIADAIDKVGPDGVLSIESSSSFETTVDVEEGMEIDRGYISPQFVTNLEKSIVEFENAKVLITDQKITSIKEILPILEKTTQLRAPLFIIAEDITGEALATLVVNKLRGILNVAAIKAPSFGERRKAVLQDIAIVTGAEFLAKDLGLLVENATEEQLGTARKVTIHQTTTTLIADAASKDEIQARVAQLKKELSETDSIYDTEKLAERIAKLSGGVAVIKVGAATETELEDRQLRIEDAKNATFAAIEEGIVPGGGTAYVHLSTTVPAIKETIEDHDERLGADIIQKALVAPASLIAHNAGVEGEVVVEKIKDGEWEVGYNAMNDKYENLIEAGVIDPAKVTRCALQNAASVAGMVLTTQAIVVEKPKPKAPVAEPAEGTLTV

SEQ ID NO: 1089 - protein, 523 aa, Oryza sativa subsp. japonica
  misc_feature (1)..(523): Public GI ID no.125579010
  misc_feature (1)..(523): Bit score of 1353.0 for HMM based on sequences of FIGURE 34.
  misc_feature (10)..(507): Pfam Name: Cpn60_TCP1 Pfam Description: TCP-1/cpn60 chaperonin family
  misc_feature (15)..(507): Pfam Name: Cpn60_TCP1 Pfam Description: TCP-1/cpn60 chaperonin family
  misc_feature (1)..(523): Functional Homolog Of Ceres SEEDLINE ID no. ME13021 at SEQ ID NO: 1054
MVIFDHWLIIVVIFRGRNVVLDEYGSPKVVNDGVTIARAIELYDPMENAGAALIREVASKTNDSAGDGTTTASVLAREIIKLGLLSVTSGANPVSLKKGIDKTVHGLIEELEKKARPVKGSGDIKAVASISAGNDELIGSMIADAIDKVGPDGVLSIESSSSFETTVDVEEGMEIDRGYISPQFVTNLEKSIVEFENAKVLITDQKITSIKEILPILEKTTQLRAPLFIIAEDITGEALATLVVNKLRGILNVAAIKAPSFGERRKAVLQDIAIVTGAEFLAKDLGLLVENATEEQLGTARKVTIHQTTTTLIADAASKDEIQARVAQLKKELSETDSIYDTEKLAERIAKLSGGVAVIKVGAATETELEDRQLRIEDAKNATFAAIEEGIVPGGGTAYVHLSTTVPAIKETIEDHDERLGADIIQKALVAPASLIAHNAGVEGEVVVEKIKDGEWEVGYNAMNDKYENLIEAGVIDPAKVTRCALQNAASVAGMVLTTQAIVVEKPKPKAPVAEPAEGTLTV

SEQ ID NO: 1090 - protein, 584 aa, Oryza sativa subsp. japonica
  misc_feature (1)..(584): Public GI ID no.31193919
  misc_feature (1)..(584): Bit score of 1548.2 for HMM based on sequences of FIGURE 34.
  misc_feature (64)..(567): Pfam Name: Cpn60_TCP1 Pfam Description: TCP-1/cpn60 chaperonin family
  misc_feature (1)..(584): Functional Homolog Of Ceres SEEDLINE ID no. ME13021 at SEQ ID NO: 1054
MATMPSTCASSSSLFLLLRRDRRSSRSASLPGPARRLGVVRASAKEIAFDQGSRSSLQAGVEKLAAAVAVTLGPRGRNVVLDEFGSPKVVNDGVTIARAIELADPMENAGAALIREVASKTNDSAGDGTTTASVLAREIIKLGLLSVTSGANPVSIKKGIDKTVHSLVEELEKKSRPVKGSGDIKAVAAISAGNDDFVGTMIAEAIDKVGPDGVLSIESSSSFETTVEVEEGMEIDRGYISPQFVTNPEKSLVEFENARILVTDQKISSIKEIIPLLEQTTQLRAPLLIIAEDVAGEALATLVVNKLRGILNVAAIKAPGFGERRKALLQDIAIVTGAEFQAKDLGLLVESTTVEQLGIARKVTISQSSTTIIADVATKDEIQARIAQLKRELSQTDSAYDSEKLAERIAKLSGGVAVIKVGAATETELEDRKLRIEDAKNATFAAIEEGIVPGGGAAYVHLSKFVPAIKEKLDDPEERLGADIIQKALVAPAALIAHNAGVEGEVIVEKIKESEWEVGYNAMADRHENLVQAGVIDPAKVTRCALQNAASVAGMVLTTQAIVVEKPKKKASAASGAPEGSLAM

SEQ ID NO: 1091 - protein, 479 aa, Oryza sativa subsp. japonica
  misc_feature (1)..(479): Public GI ID no.108712217
  misc_feature (1)..(479): Bit score of 1202.8 for HMM based on sequences of FIGURE 34.
  misc_feature (1)..(462): Pfam Name: Cpn60_TCP1 Pfam Description: TCP-1/cpn60 chaperonin family
  misc_feature (2)..(462): Pfam Name: Cpn60_TCP1 Pfam Description: TCP-1/cpn60 chaperonin family
  misc_feature (1)..(479): Functional Homolog Of Ceres SEEDLINE ID no. ME13021 at SEQ ID NO: 1054
MENAGAALIREVASKTNDSAGDGTTTASVLAREIIKLGLLSVTSGANPVSIKKGIDKTVHSLVEELEKKSRPVKGSGDIKAVAAISAGNDDFVGTMIAEAIDKVGPDGVLSIESSSSFETTVEVEEGMEIDRGYISPQFVTNPEKSLVEFENARILVTDQKISSIKEIIPLLEQTTQLRAPLLIIAEDVAGEALATLVVNKLRGILNVAAIKAPGFGERRKALLQDIAIVTGAEFQAKDLGLLVESTTVEQLGIARKVTISQSSTTIIADVATKDEIQARIAQLKRELSQTDSAYDSEKLAERIAKLSGGVAVIKVGAATETELEDRKLRIEDAKNATFAAIEEGIVPGGGAAYVHLSKFVPAIKEKLDDPEERLGADIIQKALVAPAALIAHNAGVEGEVIVEKIKESEWEVGYNAMADRHENLVQAGVIDPAKVTRCALQNAASVAGMVLTTQAIVVEKPKKKASAASGAPEGSLAM

SEQ ID NO: 1092 - protein, 588 aa, Trifolium pratense
  misc_feature (1)..(588): Public GI ID no.84468456
  misc_feature (1)..(588): Bit score of 1599.0 for HMM based on sequences of FIGURE 34.
  misc_feature (70)..(573): Pfam Name: Cpn60_TCP1 Pfam Description: TCP-1/cpn60 chaperonin family
  misc_feature (1)..(588): Functional Homolog Of Ceres SEEDLINE ID no. ME13021 at SEQ ID NO: 1054
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIDKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 1093 - protein, 588 aa, Trifolium pratense
  misc_feature (1)..(588): Public GI ID no.84468296
  misc_feature (1)..(588): Bit score of 1594.2 for HMM based on sequences of FIGURE 34.
  misc_feature (70)..(573): Pfam Name: Cpn60_TCP1 Pfam Description: TCP-1/cpn60 chaperonin family
  misc_feature (1)..(588): Functional Homolog Of Ceres SEEDLINE ID no. ME13021 at SEQ ID NO: 1054
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQAIVVEKPKPRAPVPGAPQGLTV

SEQ ID NO: 1094 - protein, 588 aa, Trifolium pratense
  misc_feature (1)..(588): Public GI ID no.84468438
  misc_feature (1)..(588): Bit score of 1589.3 for HMM based on sequences of FIGURE 34.
  misc_feature (70)..(573): Pfam Name: Cpn60_TCP1 Pfam Description: TCP-1/cpn60 chaperonin family
  misc_feature (1)..(588): Functional Homolog Of Ceres SEEDLINE ID no. ME13021 at SEQ ID NO: 1054
MASTNALSSTSILRSPTNNQAQTSLSKKAKQHGRVNYRQNPNRFMVKAAAKDIAFDQHSRRAMQAGIDKLADAVGLTLGPRGRNVVLDEFGSPKVVNDGVTIARAIELPDPMENAGAALIREVASKTNDSAGDGTTTASILAREIIKLGLLSVTSGANPVSIKKGIDKTVAGLIEELEKLARPVKGGDDIKAVASISAGNDELIGKMIAEAIGKVGPDGVLSIESSSSFETTVEVEEGMEIDRGYISPQFVTNLEKSIVEFENARVLITDQKISAIKDIIPLLEKTTQLRAPLFIIAEDITGEALATLVVNKLRGILNVAAIKAPGFGERRKALLQDIAILTGAEYQASDLGLLVENTSIEQLGLARKVTISKDSTTIIADAASKDELQSRVAQLKKELSETDSVYDSEKLAERIAKLSGGVAVIKVGAATETELEDRKLRIEDAKNATFAAIEEGIVPGGGTALVHLSAYVPAIKEKLEDADERLGADIVQKALVAPASLIAQNAGIEGEVVVEKIRNGEWEVGYNAMTDTYENLIESGVIDPAKVTRCALQNAASVAGMVLTTQATVVEKPKPRAPVPGAPQGLTV

SEQ ID NO: 1095 - protein, 575 aa, Ostreococcus tauri
  misc_feature (1)..(575): Public GI ID no.116060917
  misc_feature (1)..(575): Bit score of 1412.2 for HMM based on sequences of FIGURE 34.
  misc_feature (48)..(553): Pfam Name: Cpn60_TCP1 Pfam Description: TCP-1/cpn60 chaperonin family
  misc_feature (1)..(575): Functional Homolog Of Ceres SEEDLINE ID no. ME13021 at SEQ ID NO: 1054
MTTARGLSARTTRGASNRRVQVQVRAEAKKLTFDMASRRKIQAGIDKLADAVGVTLGPRGRNVVLEEKFGMPQVINDGVTIARAIELPDPVENAGAQLIKEVAGRTNDSAGDGTTTASVLAREMIKYGLQSVAAGANPVTVKRGMDKTSEFCRKKLDELTIPVRNAADIRAVASISAGNNEEIGNMIAEAIEKVGPDGVLSIETGSGLETVVEVEEGMEIDRGYISPQFVNDNERLMVEYEGCRILITDEKIEQVQMLVPLLEEVSQAGSPPLLIIAEDITGEALATLVVNKMRGVLKVAAIKAPGFGERRKALLQDIAIVTGAQYIAKDLGLSVQRATMDSLGYARKVSIAQTTTTLIADGASKEDIDMRVAQLKQELAETDSVYDTEKLSERIAKLAGGVAVIKVGAATETEMEERKLRIEDAKNATFAAVEEGIVPGGGAALVHLSKMIDEFIPTLTSAEERLGAEIVQKALLAPCRLIGNNAGVEGDVIVQHVMEGDFNYGYDAMVGEYGDLIEKGVIDPKKVTRSGVQNSCSIAGMVLTTQAVITEIPKKKRAIGANAGPMADEEGNFSL

SEQ ID NO: 1096 - DNA, 1743 bp, Sorghum bicolor
  misc_feature (1)..(1743): Ceres ANNOT ID no.6039555
  misc_feature (1)..(1743): Encodes the peptide sequence at SEQ ID NO 1097
atggccaccatccccaccacagattccggcctcctcctcggttcctccgctctcctccggaggactaggagggccgcctcgtccgccaggcttcccgccgccgcccgccgtcgcccgcagctcctcgtgcgcgcctccgccaaggagatcgccttcgaccagggctccagagcctcccttcaggccggcgtcgagaagctcgccgccgcggtcggcgtcaccctcggacccagaggaaggaatgttgtcctggatgagtttggaacccccaaagtggtcaatgatggagttaccattgctcgtgctattgagctcgcagatcccatggagaatgctggtgctgcattgattcgtgaagttgctagcaagacgaatgactcggctggtgacggaaccactaccgcctctgttctcgctagggaaatcataaaattgggtatgttgagcattacttcaggggcaaatccagtgtcagttaagaagggcattgataagactgttcagaaattggtggaggaacttgagaagaagtccaggcctgtcaagggtagcggggatattaaagctgttgctgccatatcagctggaaatgatgaatttgttgggactatgattgctgaagctattgacaaggttggccctgatggtgtcctctcaatcgagtcatcatcatcatttgagacgacagttgaagttgaagaagggatggagcttgacagaggatatatctcccctcagtttgtcaccaatcctgaaaaatctactgttgagtttgaaaatgctcggattcttgtcactgatcagaagatatcatcgataaaagaaatcattcctctgttggagcagacaacacagttaagagcaccacttcttataattgcagaggatgtaagtggcgaggcgctggcaacattagttgtaaacaagcttagaggaattctaaatgtggctgcaatcaaagctcctggctttggtgagaggcgtaaagctcttcttcaggacattgccattgttacaggtgctgaatatcaatccaaagatcttggtctactagttgagaatacaacagtagagcagcttggcatagctcggaaagttacaatctcaagttcctcgactaccattatagcagatgctgctagcaaagatgatatccaggccagaattgctcagctgaagagagagctttctcagacggactcggcttatgactctgagaagttggcagagagaattgcaaagctttctggtggagttgctgtgatcaaggttggagcctcaaccgaggcggagcttgaggaccgcaagctccgcatagaggacgcaaagaatgcaacttttgcagctatagaggaaggtattgttccaggaggtggtgcagcctatgttcatctctcaacatttgtaccggctatcaaggagacgttggatgatcctgaagagcggcttggtgccgatatcattcagaaggctttggtggcacctgcagcgttgatagcacataatgctggggtggaaggtgaggtgattgtggataaaatcagggaaagcgaatgggagtttggttataacgccatggcggacaagcacgagaacctggtggaggctggtgtgatcgaccctgcgaaagtgacaaggtgtgccctgcagaacgccgcctcggtggctggaatggtgctgactacccaggcaatcgttgtggagaagccccagaaggctcctgcagctgcagcggcaccctag

SEQ ID NO: 1097 - protein, 580 aa, Sorghum bicolor
  misc_feature (1)..(580): Ceres ANNOT ID no.6039555
  misc_feature (1)..(580): Bit score of 1537.1 for HMM based on sequences of FIGURE 34.
  misc_feature (67)..(570): Pfam Name: Cpn60_TCP1 Pfam Description: TCP-1/cpn60 chaperonin family
  misc_feature (1)..(580): Functional Homolog Of Ceres SEEDLINE ID no. ME13021 at SEQ ID NO: 1054
MATIPTTDSGLLLGSSALLRRTRRAASSARLPAAARRRPQLLVRASAKEIAFDQGSRASLQAGVEKLAAAVGVTLGPRGRNVVLDEFGTPKVVNDGVTIARAIELADPMENAGAALIREVASKTNDSAGDGTTTASVLAREIIKLGMLSITSGANPVSVKKGIDKTVQKLVEELEKKSRPVKGSGDIKAVAAISAGNDEFVGTMIAEAIDKVGPDGVLSIESSSSFETTVEVEEGMELDRGYISPQFVTNPEKSTVEFENARILVTDQKISSIKEIIPLLEQTTQLRAPLLIIAEDVSGEALATLVVNKLRGILNVAAIKAPGFGERRKALLQDIAIVTGAEYQSKDLGLLVENTTVEQLGIARKVTISSSSTTIIADAASKDDIQARIAQLKRELSQTDSAYDSEKLAERIAKLSGGVAVIKVGASTEAELEDRKLRIEDAKNATFAAIEEGIVPGGGAAYVHLSTFVPAIKETLDDPEERLGADIIQKALVAPAALIAHNAGVEGEVIVDKIRESEWEFGYNAMADKHENLVEAGVIDPAKVTRCALQNAASVAGMVLTTQAIVVEKPQKAPAAAAAP

SEQ ID NO: 1098 - DNA, 817 bp, Zea mays
  misc_feature (1)..(817): Ceres SEEDLINE ID no.ME13064
  misc_feature (1)..(817): Ceres CLONE ID no.1408950
  misc_feature (1)..(817): Inplanta Sequence
  misc_feature (1)..(817): Encodes the peptide sequence at SEQ ID NO. 1099
ctcgtccagggatcatcatgatttgattggcaacttaaccagaatcaatgatgaatgacctgagcaaatacaggtcaattttcactagattctattttcttggggaaatcaagtttctctgagacggttatcttccctatcatctgaaagtccctgagactttcgccgctctcatctctctctctcggttcgggtatgactcgtcacgtgatactgacatcagaagaaagaaactctccaccgaccacgatgatcaaacacgcggagaggaggaaggtgggagaggtagccggaggagccgcagctgagtgtgcggccgtgtggtgttgcggtccttgcgccgtggttaacctagttgttctcgctgtgtatagagttcccgcggccgtttgtaagaaagcttggcgacaaaccaaacggcaacgttttatgaggagacgacacggtttacttgcgtcagcggctgccgagagcaccgtgcacgctagactaaaggaggaagatccaacggctgaaattgttttcgaagaaaatgtagtgaatgtcgagttaaacgacgtcgtcgtgcttgaggatgagatgtttgaacgtttctatggggcaggattttggagaagcccgtcacagagggacacatcatcaggaagtatatgatttctttgtgaaaatattaataattaatttgatttatatgtgattctttaaaattatcatgcgggtatgtgaataggagaaatgtagtaatatttatacattgttcgtttttgtttcgttcgatttaaatataactacgtctcaattgggatttggggtggct

SEQ ID NO: 1099 - protein, 152 aa, Zea mays
  misc_feature (1)..(152): Ceres SEEDLINE ID no.ME13064
  misc_feature (1)..(152): Ceres CLONE ID no.1408950
  misc_feature (1)..(152): Bit score of 310.4 for HMM based on sequences of FIGURE 35.
MTRHVILTSEERNSPPTTMIKHAERRKVGEVAGGAAAECAAVWCCGPCAVVNLVVLAVYRVPAAVCKKAWRQTKRQRFMRRRHGLLASAAAESTVHARLKEEDPTAEIVFEENVVNVELNDVVVLEDEMFERFYGAGFWRSPSQRDTSSGSI

SEQ ID NO: 1100 - DNA, 759 bp, Populus balsamifera subsp. trichocarpa
  misc_feature (1)..(759): Ceres ANNOT ID no.1528508
  misc_feature (1)..(759): Encodes the peptide sequence at SEQ ID NO 1101
atggagccaagggtcatctttctagaggccttttcctttcttttcttttctggcatcctcttcatcttcttgagtggattaattggatcggattctcttttaaaaaattattggtttttttcttgcgtttctataatcaattgttgcggctggaatcaagagagcatttcgtctcagcttcatttcttgataaacattattattaacattagcgacaaacgcaactccaacaatcagtgtattatgccattcgcatcttcttcatcattgataaagcgccggccccttttaagacacgccaactcctcgggttcctcctgctgcagcgggcgttttggtgagatagcgggggggacaacagcagagtgtgcagcgatttgttgttgttgtccatgtggattagttaaccttttggttctcactatctacaagattcctgccggaatatgtcgacgtgctttgaaaagaaaacaacggaaaaaactgatcaagaaaggcctttttcccccgcgagggaggggttatggctgtggatcatgcgatgatccggaattacatattcatccaatggctcgtgttgaggattcattgcgagagttcgatggtgaggaggctgtgaagaaggaggaagctatgctgaggttggagaaggagatgtgggagaccttctacggtactgggttctggagaagtccttcacaaagagaattaccagctaagaggagttctccaagagagacacccaacgctagactctaa

SEQ ID NO: 1101 - protein, 171 aa, Populus balsamifera subsp. trichocarpa
  misc_feature (1)..(171): Ceres ANNOT ID no.1528508
  misc_feature (1)..(171): Bit score of 358.7 for HMM based on sequences of FIGURE 35.
  misc_feature (1)..(171): Functional Homolog Of Ceres SEEDLINE ID no. ME13064 at SEQ ID NO: 1099
MPFASSSSLIKRRPLLRHANSSGSSCCSGRFGEIAGGTTAECAAICCCCPCGLVNLLVLTIYKIPAGICRRALKRKQRKKLIKKGLFPPRGRGYGCGSCDDPELHIHPMARVEDSLREFDGEEAVKKEEAMLRLEKEMWETFYGTGFWRSPSQRELPAKRSSPRETPNARL

SEQ ID NO: 1102 - DNA, 868 bp, Arabidopsis thaliana
  misc_feature (1)..(868): Ceres CLONE ID no.9248
  misc_feature (1)..(868): Encodes the peptide sequence at SEQ ID NO 1103
actttaccatccaccagttcttctcaatctttctcttcctgggatcatcatcgttatgatttgattagcaacataacctagaatcaaaatgatgaatgaccttatcaacaacgatgggtcaattttcactagattctatttcctcggagatatctgagagaaaaaggttatttcactaatcgttaatcccagaggtgttttttttttgccaaggtcacgtgatatttttttttaatttcaatgactcgtcacgtgattttaaaatccccgttgttagtttcatcggaagaatcaacgatgagaaactctcctccttcgacgacgtcgttaagcaaagagagacgaaaagttggagaggtagcgggaggagcggcggcggagtgtgcggctgtgtggtgttgttgtccatgcgcggtggtgaatctaatggttttagccgtgtataaagttccggccgcggtttgtaaaaaagcttggaggcgaagcaaacgacgacgttttacgaggaaacgacatggtttgcttgcgtcagcgacggcggaaggaagcgaaagtaccgtacacgctagattgaatgaagaagatctaacggctgagattgtttttgaggaatgtcatgtgagtggtggtgagttaaacgacgtcgtcaggcttgaaaatgaaatgttggatcgtttctatggggctggcttttggagaagcccttcacagaaggacacgtcatcaggaagcctatgaattcttcttcttatgagtattttgggttttttgaaagaattaatagtaatttatttgttttttattttatttttttgtatgtaagttcaattgttttatgtggggtatgtgaatagaagaacattgtagc

SEQ ID NO: 1103 - protein, 165 aa, Arabidopsis thaliana
  misc_feature (1)..(165): Ceres CLONE ID no.9248
  misc_feature (1)..(165): Bit score of 341.4 for HMM based on sequences of FIGURE 35.
  misc_feature (1)..(165): Functional Homolog Of Ceres SEEDLINE ID no. ME13064 at SEQ ID NO: 1099
MTRHVILKSPLLVSSEESTMRNSPPSTTSLSKERRKVGEVAGGAAAECAAVWCCCPCAVVNLMVLAVYKVPAAVCKKAWRRSKRRRFTRKRHGLLASATAEGSESTVHARLNEEDLTAEIVFEECHVSGGELNDVVRLENEMLDRFYGAGFWRSPSQKDTSSGSL

SEQ ID NO: 1104 - protein, 146 aa, Arabidopsis thaliana
  misc_feature (1)..(146): Public GI ID no.21617979
  misc_feature (1)..(146): Bit score of 288.8 for HMM based on sequences of FIGURE 35.
  misc_feature (1)..(146): Functional Homolog Of Ceres SEEDLINE ID no. ME13064 at SEQ ID NO: 1099
MRNSPPSTTSLSKERRKVGEVAGGAAAECAAVWCCCPCAVVNLMVLAVYKVPAAVCKKAWRRSKRRRFTRKRHGLLASATAEGSESTVHARLNEEDLTAEIVFEECHVSGGELNDVVRLENEMLDRFYGAGFWRSPSQKDTSSGSL

SEQ ID NO: 1105 - protein, 139 aa, Medicago truncatula
  misc_feature (1)..(139): Public GI ID no.87240560
  misc_feature (1)..(139): Bit score of 266.3 for HMM based on sequences of FIGURE 35.
  misc_feature (1)..(139): Functional Homolog Of Ceres SEEDLINE ID no. ME13064 at SEQ ID NO: 1099
MTRQNQLQNRRRSVGEVAGNATAECAAICCCVPCAVVDMVALATYKVPASLWKKAAINNRKKRLLKQMKKDMKNFLEHEKPGGPGPETVVVGPTMEELLAQEELPEEDLWARFSVNGFWRSSSSQKHEPDELQTGENNR

SEQ ID NO: 1106 - protein, 182 aa, Lilium longiflorum
  misc_feature (1)..(182): Public GI ID no.19453
  misc_feature (1)..(182): Bit score of 388.6 for HMM based on sequences of FIGURE 35.
  misc_feature (1)..(182): Functional Homolog Of Ceres SEEDLINE ID no. ME13064 at SEQ ID NO: 1099
MAELNVAPSPPPSTILTLEDMLRKLPLPSDETIRSPATTKMCKIVSHRSSPRHPTTKANKGFQCAEVAGGTTAGCAALVCCPCGIVGLLVLATVKLPAGLCRRALSQKRRKRVKKRSTTLRSRAMSFVSDDEDFGVPSFVPRTPETWPSKSPSVEVAEKEEEMWAEFYSAGFWRSPSQKESN

SEQ ID NO: 1107 - DNA, 1073 bp, Panicum virgatum
  misc_feature (1)..(1073): Ceres CLONE ID no.1795329
  misc_feature (1)..(1073): Encodes the peptide sequence at SEQ ID NO 1108
atcgccgcctcctcgtcctcctcgtcctcctcctcctctctatctctctctctctcctccaccaaccaatagagaccggctctaaataccagtccatccggcaggtttgtttaggcagccgcagccggcgttgctcctgtccggagcgctaaggactcccgagaagcagaagcttctatcggcggcggggctcgtggtcgatcgagcgggcaggcgcgggcgcatgcgcgagtacgggcgcgggcacgaggaggaggagggggaggagcatgagccccagccggggtgcggggagggggcggggcaggcggcggccaactgcgcggcggtgtgctgctgctgcccgctggcgctgctcgacgtgctgctgctcgtcaccgtcaagctcccagcgggcgtcatgcggcgggtgaggaggaggaggaggcgccaccgcgaccgcgtcagccgcaagaagcggtcggcggcggcggcggcggtggagcccgcgtcgccgtcggggagcagcggcaaggcgatgatcggcgcggccccgtcgccgctggaggccgaggaagaggaggcgcgcggcgaggcggcggcggcggcggaactggagcgcgagatcatgagctcccggttctacggcgccggcttctggcgcagcgtctcctccggctgtagctcctccgcctccatgcgctaccaatagccagccagcgcgcccctctcctcctcgcgattttgttgcgcacatagcgagtcgacaagcacgccaaatcgccaacaactacttgatcagttcttgaggctttgggggcgttcgttcttggggtgccagtcagagccctactatttggccgtgcacttggtcttgatcgacacgtgcgaatccgttccgtgtggattagactgttggattcgtacgccattgttttgggctagcttggaccacaccggcagcggcagcatgcgataggggcgaccaaaccgggtggtcctggtcccacatgtaagtaactgcttatatcttcccgttttctttgttcctgtgagaaccagcaaatgctggaacctgaaactgatttttgcac

SEQ ID NO: 1108 - protein, 155 aa, Panicum virgatum
  misc_feature (1)..(155): Ceres CLONE ID no.1795329
  misc_feature (1)..(155): Bit score of 280.7 for HMM based on sequences of FIGURE 35.
  misc_feature (1)..(155): Functional Homolog Of Ceres SEEDLINE ID no. ME13064 at SEQ ID NO: 1099
MREYGRGHEEEEGEEHEPQPGCGEGAGQAAANCAAVCCCCPLALLDVLLLVTVKLPAGVMRRVRRRRRRHRDRVSRKKRSAAAAAVEPASPSGSSGKAMIGAAPSPLEAEEEEARGEAAAAAELEREIMSSRFYGAGFWRSVSSGCSSSASMRYQ

SEQ ID NO: 1109 - protein, 225 aa, Oryza sativa subsp. japonica
  misc_feature (1)..(225): Public GI ID no.108862979
  misc_feature (1)..(225): Bit score of 479.7 for HMM based on sequences of FIGURE 35.
  misc_feature (1)..(225): Functional Homolog Of Ceres SEEDLINE ID no. ME13064 at SEQ ID NO: 1099
MAAVAPIAMPARVHHHHHHHRRALAASPAALAAAGNGLSATRRVRRSPAVEMRRERERRRAREQQPRCGEVAGGTAAECAAVFCCFPFAVVELVVLAAVRAPAALCRRAVRGGRRRRVRSTKPKETGAMDIASPRSLAAAAAKARKVDADFPATPKAEHLVDMEKEVWASFYGGGFWRSPSQREDRRCIAAGDGAAAAALFFFSFTTVVGFLAFLLPFLGKREDR

SEQ ID NO: 1110 - protein, 187 aa, Oryza sativa subsp. japonica
  misc_feature (1)..(187): Public GI ID no.115489628
  misc_feature (1)..(187): Bit score of 369.3 for HMM based on sequences of FIGURE 35.
  misc_feature (1)..(187): Functional Homolog Of Ceres SEEDLINE ID no. ME13064 at SEQ ID NO: 1099
MAAVAPIAMPARVHHHHHHHRRALAASPAALAAAGNGLSATRRVRRSPAVEMRRERERRRAREQQPRCGEVAGGTAAECAAVFCCFPFAVVELVVLAAVRAPAALCRRAVRGGRRRRVRSTKPKETGAMDIASPRSLAAAAAKARKVDADFPATPKAEHLVDMEKEVWASFYGGGFWRSPSQREDRR

SEQ ID NO: 1111 - DNA, 479 bp, Zea mays
  misc_feature (1)..(479): Ceres SEEDLINE ID no.ME13071
  misc_feature (1)..(479): Ceres CLONE ID no.208453
  misc_feature (1)..(479): Inplanta Sequence
  misc_feature (1)..(479): Encodes the peptide sequence at SEQ ID NO. 1112
aatcccgtgccattctaactagaagcaatactgatggcccaaaacaagatgattgtgatggttctcctcctttccacctttcttgtggtggcaagatcgttgtgggttccagaagaaccctcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagaactccgataatatatacactagtggatcagtggtcatctttgtagccatgtctaccacacgatggccttgattatattgtcttattgttttgtttttggtttccaatagtatcctaattccttgttcatgtaacctaatgtcactcaaagcattttatatgcctcacttaattaaataaatacaaaggcaaaggcatgttatgttttgatcc

SEQ ID NO: 1112 - protein, 74 aa, Zea mays
  misc_feature (1)..(74): Ceres SEEDLINE ID no.ME13071
  misc_feature (1)..(74): Ceres CLONE ID no.208453
  misc_feature (1)..(74): Bit score of 163.5 for HMM based on sequences of FIGURE 36.
MAQNKMIVMVLLLSTFLVVARSLWVPEEPSNADDIRGACIEECTKENKAPGDKKTCEVLCTKLTKKPSEEGKHD

SEQ ID NO: 1113 - protein, 129 aa, Oryza sativa subsp. indica
  misc_feature (1)..(129): Public GI ID no.125541485
  misc_feature (1)..(129): Bit score of 363.3 for HMM based on sequences of FIGURE 36.
  misc_feature (1)..(129): Functional Homolog Of Ceres SEEDLINE ID no. ME13071 at SEQ ID NO: 1112
MAQNKTIAVALLLATLVAVMGKEPETLEETLRAGCKEECSEQKKKAPIDEKQCEDFCFIKTKSIFEAHKGVKDLKADRFIDFCNNECNAVYKEDPATSKKCAESCEADAKEAEVFLDKVVAYMQTMKQA

SEQ ID NO: 1114 - protein, 129 aa, Oryza sativa subsp. japonica
  misc_feature (1)..(129): Public GI ID no.115449245
  misc_feature (1)..(129): Bit score of 361.6 for HMM based on sequences of FIGURE 36.
  misc_feature (1)..(129): Functional Homolog Of Ceres SEEDLINE ID no. ME13071 at SEQ ID NO: 1112
MAQNKTIAVALLLATLVAVMGKEPETLEEAVRAGCKEECSEQKKKAPIDEKQCEDFCFIKTKSIFEAHKGVKDLKADRFIDFCNNECNAVYKEDPATSKKCAESCEADAKEAEVFLDKVVAYIQTTKQA

SEQ ID NO: 1115 - DNA, 725 bp, Brassica napus
  misc_feature (1)..(725): Ceres SEEDLINE ID no.ME13087
  misc_feature (1)..(725): Ceres CLONE ID no.968180
  misc_feature (1)..(725): Inplanta Sequence
  misc_feature (1)..(725): Encodes the peptide sequence at SEQ ID NO. 1116
acaacaacaactcacaacaataacaatcacaccaaacacatacacaaacctttaatcgtttcgttttaacatctgaaaagaaaaacaaaaatggttgcaatctctgagattaatccgacggtggaggctaccgcggcgaactgtctgatgcttttatcaagagtcggacaaaaaggtggggatcaaaaacgcgttttcacatgtaaaacgtgtttgaaagagtttcattcgtttcaagcgttgggaggtcaccgtgcgagtcacaagaaacctaacaacaatgagagtctctctggattggtgaagaaagccaaagctccttcgtcgcacccttgtccgatatgcggagtggagtttccgatgggacaagctctaggaggtcacatgaggagacacaggaacgagattggcggcggagcagcgttggttacacgggcgttattgccggagccgacgatgacgacgttgaagaagtcgagcagtgggaagagggtggcgtgtttggatctgagtttggggatggttgagaatttgaatctcaagttggagcttggaagaactgtttgttgatttgttttttcttttaatggatataataattagtttccttcattctttgaatttttccttaatagtttagatttgtatatctgcagatttaggaaactttcatagggtgtaatcttttctttcctagtgaatatatttacttagaattggagatt

SEQ ID NO: 1116 - protein, 159 aa, Brassica napus
  misc_feature (1)..(159): Ceres SEEDLINE ID no.ME13087
  misc_feature (1)..(159): Ceres CLONE ID no.968180
  misc_feature (1)..(159): Bit score of 330.7 for HMM based on sequences of FIGURE 37.
  misc_feature (80)..(102): Pfam Name: zf-C2H2 Pfam Description: Zinc finger, C2H2 type
MVAISEINPTVEATAANCLMLLSRVGQKGGDQKRVFTCKTCLKEFHSFQALGGHRASHKKPNNNESLSGLVKKAKAPSSHPCPICGVEFPMGQALGGHMRRHRNEIGGGAALVTRALLPEPTMTTLKKSSSGKRVACLDLSLGMVENLNLKLELGRTVC

SEQ ID NO: 1117 - DNA, 744 bp, Gossypium hirsutum
  misc_feature (1)..(744): Ceres CLONE ID no.100062822
  misc_feature (1)..(744): Encodes the peptide sequence at SEQ ID NO 1118
cagatttcaacagcaaaacccaaagtttcatactttacagtgttccaagtattcagtgttttttatacaagttttcagattaatgaagagaggcagagatattgatgcgatggatatggcagattgtttgatgttattatcgagagttggggaaaccgaccgggttgctggtcgtgtctttgcatgcaagacatgtaataaaaagttttcatctttccaagcacttggaggtcacagggcgagtcataagaagccgaagctaacggtaggagacaatgaagggttagcggtttcgcctaagaagccgaagacccacgagtgttcgatatgtgggctggagttcgccattggtcaagctctcggcggtcacatgaggagacatagggctgctctgaatgacgggttggtaactcgggatttgttgccggagatgaataaatcgaccggagatggtagggatccatctatagatttgggtttgacgtcttggggagtggatttggagttgaagctggggaaagtgacaccaactccggttgttcattgttttatataggattaatacatgtgggttcatattattagagcacggtataggtagataggatttgattttaacattctttcgttacttgtatattgtttttggtctattttttactccatttttactacattgttattcatgtcttatttttatgttaaaattgataataaaattaaagaatataaaaaaattcaatt

SEQ ID NO: 1118 - protein, 157 aa, Gossypium hirsutum
  misc_feature (1)..(157): Ceres CLONE ID no.100062822
  misc_feature (1)..(157): Bit score of 348.2 for HMM based on sequences of FIGURE 37.
  misc_feature (33)..(55): Pfam Name: zf-C2H2 Pfam Description: Zinc finger, C2H2 type
  misc_feature (1)..(157): Functional Homolog Of Ceres SEEDLINE ID no. ME13087 at SEQ ID NO: 1116
MKRGRDIDAMDMADCLMLLSRVGETDRVAGRVFACKTCNKKFSSFQALGGHRASHKKPKLTVGDNEGLAVSPKKPKTHECSICGLEFAIGQALGGHMRRHRAALNDGLVTRDLLPEMNKSTGDGRDPSIDLGLTSWGVDLELKLGKVTPTPVVHCFI

SEQ ID NO: 1119 - DNA, 594 bp, Populus balsamifera subsp. trichocarpa
  misc_feature (1)..(594): Ceres ANNOT ID no.1440025
  misc_feature (1)..(594): Encodes the peptide sequence at SEQ ID NO 1120
atgaagagagatagagaacaggcagagatagacttggccaaatgcttgatgctactttctaaagttggccaagctgatcacgagatactaactaattatagatcagcagcagcagcagcagcagcagcaacggcaggggccggggccggggccggtcgctcattttcatgcaaaacatgcaacaagaatttcccttcatttcaagcattaggaggccaccgtgcaagtcacaagaaaccaaaactcaaggaatcaactgggaacttgttgaagctgcctaattcgccttcaaagccaaaaactcaccagtgctccatttgcggccttgaatttcctctcgggcaagcacttggaggtcacatgaggagacatagggcgcctaataatgttgataccaccagtactagtagtaaagatcatgaattggctgtgactcaaccgcctttcttacccgctgtcccagttttgaagagatccaatagcagcaagagagttctgtgcttggatttgagcttggccctgcctatgtatcagaatgactcggagttgcagttagagaaggtcgctcgtcccatgttgagatgttttatctaa

SEQ ID NO: 1120 - protein, 181 aa, Populus balsamifera subsp. trichocarpa
  misc_feature (1)..(181): Ceres ANNOT ID no.1440025
  misc_feature (1)..(181): Bit score of 301.0 for HMM based on sequences of FIGURE 37.
  misc_feature (86)..(108): Pfam Name: zf-C2H2 Pfam Description: Zinc finger, C2H2 type
  misc_feature (1)..(181): Functional Homolog Of Ceres SEEDLINE ID no. ME13087 at SEQ ID NO: 1116
MLLSKVGQADHEILTNYRSAAAAAAAATAGAGAGAGRSFSCKTCNKNFPSFQALGGHRASHKKPKLKESTGNLLKLPNSPSKPKTHQCSICGLEFPLGQALGGHMRRHRAPNNVDTTSTSSKDHELAVTQPPFLPAVPVLKRSNSSKRVLCLDLSLALPMYQNDSELQLEKVARPMLRCFI

SEQ ID NO: 1121 - DNA, 567 bp, Populus balsamifera subsp. trichocarpa
  misc_feature (1)..(567): Ceres ANNOT ID no.1461865
  misc_feature (1)..(567): Encodes the peptide sequence at SEQ ID NO 1122
atgaagagagggagagaagagggagagttagacatggccaattgcttgatgctactttataaagttggcaaagctgatgatcatgagctgccaactaattataaatcatcgtcaccatccggggccggtcgcttgttttcgtgcaaaacatgtaacaagaatttctcttcatttcaagcgttaggaggccaccgtgcaagtcacaagaaaccaaaacttgtgggatcaactgggaacttgttaatgaagttgcccaattcgcctccaaagccaaagaatcaccagtgctctatttgcgggcttgaatttcctatcgggcaagcgcttggaggtcatatgaggaggcatagggctggtaatattgatgctaccagtaacagtgctgataatgaactggctgtgacttatccacctttcttaccagccatcccagttttgaagaaatcgaatagcagcaagagagtcctgtgcttggatttgagcttggcactgcctatggatcagaatgagtcggagttgcagttaaggaaggccggcacgcgacctgtgttgaaatgttttatctag

SEQ ID NO: 1122 - protein, 188 aa, Populus balsamifera subsp. trichocarpa
  misc_feature (1)..(188): Ceres ANNOT ID no.1461865
  misc_feature (1)..(188): Bit score of 289.8 for HMM based on sequences of FIGURE 37.
  misc_feature (46)..(68): Pfam Name: zf-C2H2 Pfam Description: Zinc finger, C2H2 type
  misc_feature (1)..(188): Functional Homolog Of Ceres SEEDLINE ID no. ME13087 at SEQ ID NO: 1116
MKRGREEGELDMANCLMLLYKVGKADDHELPTNYKSSSPSGAGRLFSCKTCNKNFSSFQALGGHRASHKKPKLVGSTGNLLMKLPNSPPKPKNHQCSICGLEFPIGQALGGHMRRHRAGNIDATSNSADNELAVTYPPFLPAIPVLKKSNSSKRVLCLDLSLALPMDQNESELQLRKAGTRPVLKCFI

SEQ ID NO: 1123 - protein, 162 aa, Arabidopsis thaliana
  misc_feature (1)..(162): Public GI ID no.15238538
  misc_feature (1)..(162): Bit score of 319.4 for HMM based on sequences of FIGURE 37.
  misc_feature (82)..(104): Pfam Name: zf-C2H2 Pfam Description: Zinc finger, C2H2 type
  misc_feature (1)..(162): Functional Homolog Of Ceres SEEDLINE ID no. ME13087 at SEQ ID NO: 1116
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 1124 - DNA, 766 bp, Arabidopsis thaliana
  misc_feature (1)..(766): Ceres CLONE ID no.40576
  misc_feature (1)..(766): Encodes the peptide sequence at SEQ ID NO 1125
atcatcacaactactatcacaccaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctagattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcattggagatttgttatgagatc

SEQ ID NO: 1125 - protein, 162 aa, Arabidopsis thaliana
  misc_feature (1)..(162): Ceres CLONE ID no.40576
  misc_feature (1)..(162): Bit score of 317.4 for HMM based on sequences of FIGURE 37.
  misc_feature (82)..(104): Pfam Name: zf-C2H2 Pfam Description: Zinc finger, C2H2 type
  misc_feature (1)..(162): Functional Homolog Of Ceres SEEDLINE ID no. ME13087 at SEQ ID NO: 1116
MVAISEIKSTVDVTAANCLMLLSRVGQENVDGGDQKRVFTCKTCLKQFHSFQALGGHRASHKKPNNDALSSRLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 1126 - protein, 162 aa, Arabidopsis thaliana
  misc_feature (1)..(162): Public GI ID no.21593615
  misc_feature (1)..(162): Bit score of 314.7 for HMM based on sequences of FIGURE 37.
  misc_feature (82)..(104): Pfam Name: zf-C2H2 Pfam Description: Zinc finger, C2H2 type
  misc_feature (1)..(162): Functional Homolog Of Ceres SEEDLINE ID no. ME13087 at SEQ ID NO: 1116
  misc_feature (133)..(133): Xaa is any aa, unknown or other
MVAISEIKSTVDVTAANCLMLLSRVGQENVDGGDQKRVFTCKTCLKQFHSFQALGGHRASHKKPNNDALSSRLMKKVKTSSHPCPICGVEFPMGQALGGHMRRHRNESGAAGGALVTRALLPEPTVTTLKKSXSGKRVACLDLSLGMVDNLNLKLELGRTVY

SEQ ID NO: 1127 - DNA, 777 bp, Brassica napus
  misc_feature (1)..(777): Ceres CLONE ID no.955063
  misc_feature (1)..(777): Encodes the peptide sequence at SEQ ID NO 1128
atcaacaactatcacacaaacacataaactcaaaaatcttattctatttgtttcgttttatcatcagaaaaacataaacatggttgctatttcagagatcaagtccacggtggagactacggcggcgaactgtctgatgctcttatcaagggtcggacaagaaaacgttgacggtggaagcgcaaaacgcgttttcacatgtaagacgtgtttgaaggagtttcattcgtttcaagcgttgggaggtcaccgtgcgagccacaagaagcctaacaatgagaatctctctagtttgatgaagaagacgaaagcttcgtcttcccatccttgtccgatatgtggagtggagtttcccatgggacaagctctaggaggacacatgaggagacacaggaacgagagtggcggcgccggcgcgttggttacacgcgagttactgtcggaggcagcgttgacgacgttgaagaaatcaagcagtgggaggttggcttgtctggatctgagtttgggaatggtggagaatttgaatctcaagttggaacttggaagacctgtttgttgatttgttttttctttttcctttgtgttcttttttcctggatatattaattagtttctctcattctttgatttgtttccttaatattttagattcatacatatacatctgcagatttaggaaactttcatagggtataatgtctttcctttcgtggtgaaatatactttacttagcattggagatttgttatatatgatatctttcagtttaagcgt

SEQ ID NO: 1128 - protein, 160 aa, Brassica napus
  misc_feature (1)..(160): Ceres CLONE ID no.955063
  misc_feature (1)..(160): Bit score of 313.1 for HMM based on sequences of FIGURE 37.
  misc_feature (82)..(104): Pfam Name: zf-C2H2 Pfam Description: Zinc finger, C2H2 type
  misc_feature (1)..(160): Functional Homolog Of Ceres SEEDLINE ID no. ME13087 at SEQ ID NO: 1116
MVAISEIKSTVETTAANCLMLLSRVGQENVDGGSAKRVFTCKTCLKEFHSFQALGGHRASHKKPNNENLSSLMKKTKASSSHPCPICGVEFPMGQALGGHMRRHRNESGGAGALVTRELLSEAALTTLKKSSSGRLACLDLSLGMVENLNLKLELGRPVC

SEQ ID NO: 1129 - protein, 172 aa, Glycine max
  misc_feature (1)..(172): Public GI ID no.69111473
  misc_feature (1)..(172): Bit score of 361.4 for HMM based on sequences of FIGURE 37.
  misc_feature (40)..(62): Pfam Name: zf-C2H2 Pfam Description: Zinc finger, C2H2 type
  misc_feature (1)..(172): Functional Homolog Of Ceres SEEDLINE ID no. ME13087 at SEQ ID NO: 1116
MKRGREESKLDMANCLMLLTKVGESETNYPISKGSDIGDFKCKTCNRRFSSFQALGGHRASHKKPKLMVTDLSCHQELPNPTMKQQPRMHPCPICGLEFAIGQALGGHMRKHRTAINDGLLCGKPSSSLSILKESSKDGDQKLNLRLDLNLTPLEEDDLKLNLRTPVLNCFI

SEQ ID NO: 1130 - DNA, 598 bp, Glycine max
  misc_feature (1)..(598): Ceres CLONE ID no.1042389
  misc_feature (1)..(598): Encodes the peptide sequence at SEQ ID NO 1131
aactcattacatagaaactagctagggcacttctccaatctcaacaactttcgtgtagtgcactgttttgctatagtaacccattaattaaaccgacctacgtagtagccatgaagagaggcagagaagagagtaagttagacatggctaattgcttgatgctattgacgaaagttggagagagtgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacct

SEQ ID NO: 1131 - protein, 162 aa, Glycine max
  misc_feature (1)..(162): Ceres CLONE ID no.1042389
  misc_feature (1)..(162): Bit score of 327.6 for HMM based on sequences of FIGURE 37.
  misc_feature (40)..(62): Pfam Name: zf-C2H2 Pfam Description: Zinc finger, C2H2 type
  misc_feature (1)..(162): Functional Homolog Of Ceres SEEDLINE ID no. ME13087 at SEQ ID NO: 1116
MKRGREESKLDMANCLMLLTKVGESETNYPISKGSDIGDFKCKTCNRRFSSFQALGGHRASHKKPKLMVTDLSCHQELPNPTMKQQPRMHPCPICGLEFAIGQALGGHMRKHRTAINDGLLCGKPSSSLSILKESSKDGDQKLNLRLDLNLTPLEEDDLKLN

SEQ ID NO: 1132 - protein, 165 aa, Medicago truncatula
  misc_feature (1)..(165): Public GI ID no.92873711
  misc_feature (1)..(165): Bit score of 360.9 for HMM based on sequences of FIGURE 37.
  misc_feature (34)..(56): Pfam Name: zf-C2H2 Pfam Description: Zinc finger, C2H2 type
  misc_feature (1)..(165): Functional Homolog Of Ceres SEEDLINE ID no. ME13087 at SEQ ID NO: 1116
MAMKRQRSNEGIDYANCLMLLSCPQQKSYENGEYECKTCNKKFSSFQALGGHRASHKRMKLAEGEELKEQAKSLSLWNKPKMHECSICGMGFSLGQALGGHMRKHRAVINEGVSSINQIIEKFPVLKRLNSKRIMGLDLNLTPLENDDLMFGIKSPPTPIPLSLF

SEQ ID NO: 1133 - protein, 190 aa, Catharanthus roseus
  misc_feature (1)..(190): Public GI ID no.55734106
  misc_feature (1)..(190): Bit score of 389.3 for HMM based on sequences of FIGURE 37.
  misc_feature (55)..(77): Pfam Name: zf-C2H2 Pfam Description: Zinc finger, C2H2 type
  misc_feature (1)..(190): Functional Homolog Of Ceres SEEDLINE ID no. ME13087 at SEQ ID NO: 1116
MVMINIPMKRTREANDFDSITTMANCLMLLSQNRSGEFIDSTTSNSSNLNSNRVFECKTCNRQFPSFQALGGHRASHKRPRLGGDLTLSQIPVAAAKPKTHECSICGLEFAIGQALGGHMRRHRAAMSDSASGNSASPPRDDRTVVVKKSNIVDDDNDRRVWGLDLNLTPFENHLEFQLGKIAPTVDCFL

SEQ ID NO: 1134 - protein, 174 aa, Petunia x hybrida
  misc_feature (1)..(174): Public GI ID no.2346974
  misc_feature (1)..(174): Bit score of 386.3 for HMM based on sequences of FIGURE 37.
  misc_feature (46)..(68): Pfam Name: zf-C2H2 Pfam Description: Zinc finger, C2H2 type
  misc_feature (1)..(174): Functional Homolog Of Ceres SEEDLINE ID no. ME13087 at SEQ ID NO: 1116
MSAMKRSREDRQVEAAAMANCLMLLSKLNDKSTSTTTTNQDHHNDFECKTCNKRFSSFQALGGHRASHKRPKLLIGAGEFLVQPSSKKMHECSICGMEFSLGQALGGHMRRHRAAIDEKSKAATKAMMIPVLKKSNSSKRIFCLDLNLTPRNEDVDLKLWPTAPISSPVLRIFI

SEQ ID NO: 1135 - DNA, 999 bp, Triticum aestivum
  misc_feature (1)..(999): Ceres CLONE ID no.569852
  misc_feature (1)..(999): Encodes the peptide sequence at SEQ ID NO 1136
cattcagacccatcccagccaaaagcacctggccatcagcgttccttctcctagctttgtctcagttgtcttccggtcttctgctctgctctttggactaatggcccatgggaagaggtctaggcagcaggccgagtcgacctcggtcagcctgctggacctggacagcggcgacatggcgcgcatcctgctgctcttctccggccaccaccagcaccacgcccactacgggccttcgtcgcctgagagggtgttcgagtgcaagacctgcaaccggcggttcccgtccttccaggcgctcggtgggcaccgcgccagccacaagaagccgcgcctggcggacggcgccggcgccgagccgcccaagcccaaggtgcacggctgctccatctgcgggctcgagttcgccgtcggccaggcgctcggcggccacatgcgccgccaccgcgctgtcgcggcggcagggcccggcgtcgggcttgggctcagcctcggcctcggtctcgggccgaacgaggacggcaacaagaaggcggcggcggcggccgagctggcgctcgacctgaacgagccggcactggaggaggagccggccgatcgcgccatgcttgggctcgccgtgggattccggccccgtggtggttgactttcgacgttaggttgaacagaagaaatttgcgtctgaaccatacaaattttttgtagttcaatactatttgcattgagctgctcgagaagtcaacgacccttggaacattagaaatgctggctcgcgtatagtataacatttctaaagtctcaggggcaggggctctatatttacaaggtttgacttctggcggtatttgtagtactagacgggtttttctcttctgctccccctttttccacggggagttcagtttttttatgctccttggccttgaggcatatctactacggagtacgtatgaatatggttgtaaacctctcgaattacgcgaatattatacaaggatt

SEQ ID NO: 1136 - protein, 156 aa, Triticum aestivum
  misc_feature (1)..(156): Ceres CLONE ID no.569852
  misc_feature (1)..(156): Bit score of 287.4 for HMM based on sequences of FIGURE 37.
  misc_feature (27)..(49): Pfam Name: zf-C2H2 Pfam Description: Zinc finger, C2H2 type
  misc_feature (1)..(156): Functional Homolog Of Ceres SEEDLINE ID no. ME13087 at SEQ ID NO: 1116
MARILLLFSGHHQHHAHYGPSSPERVFECKTCNRRFPSFQALGGHRASHKKPRLADGAGAEPPKPKVHGCSICGLEFAVGQALGGHMRRHRAVAAAGPGVGLGLSLGLGLGPNEDGNKKAAAAAELALDLNEPALEEEPADRAMLGLAVGFRPRGG

SEQ ID NO: 1137 - DNA, 595 bp, Musa acuminata
  misc_feature (1)..(595): Ceres CLONE ID no.1715326
  misc_feature (1)..(595): Encodes the peptide sequence at SEQ ID NO 1138
aacaattcgtatctcggaaagagttcgaggcatcgagccgctggatgaagcgttcaagagaggcagaagaagaagaagaacaagcagcaggcgcggagctgttgctgttgctgtcgctctcccgcggggataagcctgcgacggttcgcaagaaggtcagagcggcggagggcgtgttcgagtgcaagatttgcagccgccagttcccgacgttccaggctctcggcggccaccggaccagccacaaccgcccgagggtcgatcgttccacgtcgagacgcagcgtgcaccagtgctccatctgtggcgtggagttcgcgatggggcaagctctgggcggccacatgcgccgacataagcccatggccgaggactcgaagcggagtgatccgaagaagatggacttgacaatggctgatccagagttcggtgatctgcatcgagtccgcaggactggttctcactgtcagctgcttcagctgttcgtatagaatacgcaaattctatatgtatagggtttcattgtgagatattctattctttcgtattttcctagaataaatggagtagatgatcatatactccgtctgagact

SEQ ID NO: 1138 - protein, 148 aa, Musa acuminata
  misc_feature (1)..(148): Ceres CLONE ID no.1715326
  misc_feature (1)..(148): Bit score of 267.6 for HMM based on sequences of FIGURE 37.
  misc_feature (82)..(104): Pfam Name: zf-C2H2 Pfam Description: Zinc finger, C2H2 type
  misc_feature (1)..(148): Functional Homolog Of Ceres SEEDLINE ID no. ME13087 at SEQ ID NO: 1116
MKRSREAEEEEEQAAGAELLLLLSLSRGDKPATVRKKVRAAEGVFECKICSRQFPTFQALGGHRTSHNRPRVDRSTSRRSVHQCSICGVEFAMGQALGGHMRRHKPMAEDSKRSDPKKMDLTMADPEFGDLHRVRRTGSHCQLLQLFV

SEQ ID NO: 1139 - DNA, 670 bp, Parthenium argentatum
  misc_feature (1)..(670): Ceres CLONE ID no.1608104
  misc_feature (1)..(670): Encodes the peptide sequence at SEQ ID NO 1140
gtgagcttagggagataaaaaccatattccaaacatcaatattgtacaacatccttaattccatcaaacgaattgtatatttcgatacaaatgacgatcaagagaagttgggaagacgacagggaagtcgaaaacttagctatggcaaactgcttgatgctcctctctcgggtcgggcaatcgggttctacaccggaccgggttttccattgcaagacgtgtgacaaagagtttaagtcgttccaagcgttaggtggccatcgggcaagccacaagcgaccgaaaacaagcgatgggagtgaagcacggacgcctcctaagccgaagacacatgagtgccccgtatgtggattggagtttgcgatcgggcaggcgttgggtggtcatatgaggcggcatcgtgacgttggtaacgagaaaagtggtcgaccggttgcggctcgaccggagtcggttaccaaaagagggttgtttatggatttgaacttgaccccgcttgaaaacgatttgaagttgtggagtaatacggttaacacggctcttgctatgtaaacgatgtcgttttatgaacgttacataagttgatggcttttttcgtcatcactggattgtacataagttatagggaatacgagctgtgtagattggagcaatatattttataaattca

SEQ ID NO: 1140 - protein, 153 aa, Parthenium argentatum
  misc_feature (1)..(153): Ceres CLONE ID no.1608104
  misc_feature (1)..(153): Bit score of 338.6 for HMM based on sequences of FIGURE 37.
  misc_feature (39)..(61): Pfam Name: zf-C2H2 Pfam Description: Zinc finger, C2H2 type
  misc_feature (1)..(153): Functional Homolog Of Ceres SEEDLINE ID no. ME13087 at SEQ ID NO: 1116
MTIKRSWEDDREVENLAMANCLMLLSRVGQSGSTPDRVFHCKTCDKEFKSFQALGGHRASHKRPKTSDGSEARTPPKPKTHECPVCGLEFAIGQALGGHMRRHRDVGNEKSGRPVAARPESVTKRGLFMDLNLTPLENDLKLWSNTVNTALAM

SEQ ID NO: 1141 - protein, 144 aa, Oryza sativa subsp. japonica
  misc_feature (1)..(144): Public GI ID no.115456237
  misc_feature (1)..(144): Bit score of 210.0 for HMM based on sequences of FIGURE 37.
  misc_feature (100)..(122): Pfam Name: zf-C2H2 Pfam Description: Zinc finger, C2H2 type
  misc_feature (1)..(144): Functional Homolog Of Ceres SEEDLINE ID no. ME13087 at SEQ ID NO: 1116
MTKHPRDGEVISLSLSLTLGAAADSGERKKPRRGSSPAASGSGDFVCKTCSRAFPSFQALGGHRTSHLRGRHGLALGLAAATAKETTKKVQEKPAAAATHECHICGQGFEMGQALGGHMRRHREEAAAAAAAVHAPPVLLELFV

SEQ ID NO: 1142 - protein, 145 aa, Oryza sativa subsp. japonica
  misc_feature (1)..(145): Public GI ID no.125588419
  misc_feature (1)..(145): Bit score of 153.7 for HMM based on sequences of FIGURE 37.
  misc_feature (101)..(123): Pfam Name: zf-C2H2 Pfam Description: Zinc finger, C2H2 type
  misc_feature (1)..(145): Functional Homolog Of Ceres SEEDLINE ID no. ME13087 at SEQ ID NO: 1116
MTKHPRDGEVISLSLSLTLGAAADSGERKKPRRGSSPAASGSGDFVCKTCSRAFPSFQALGRPPDQPPARPATGLALGLAAATAKETTKKVQEKPAAAATHECHICGQGFEMGQALGGHMRRHREEAAAAAAAVHAPPVLLELFV

SEQ ID NO: 1143 - protein, 183 aa, Juglans regia
  misc_feature (1)..(183): Public GI ID no.68655289
  misc_feature (1)..(183): Bit score of 362.3 for HMM based on sequences of FIGURE 37.
  misc_feature (99)..(121): Pfam Name: zf-C2H2 Pfam Description: Zinc finger, C2H2 type
  misc_feature (1)..(183): Functional Homolog Of Ceres SEEDLINE ID no. ME13087 at SEQ ID NO: 1116
MAMKRMRSEDIVGDKDSLDDMAKCLMLLSHGGGLTTDTKPKTCPHPVDVFECKTCNRQFSSFQALGGHRASHKRPRLMGEEHKVDRTKLQSSGNKPKMHECSLCGQKFSMGQALGGHMRRHRANEGLSSIMNPLDHAKVPMLMKRSNSTRVVCSLDLNLTPLENDLKLLFGKMAPKVDLRLMI

SEQ ID NO: 1144 - protein, 161 aa, Brassica carinata
  misc_feature (1)..(161): Public GI ID no.81022807
  misc_feature (1)..(161): Bit score of 318.8 for HMM based on sequences of FIGURE 37.
  misc_feature (83)..(105): Pfam Name: zf-C2H2 Pfam Description: Zinc finger, C2H2 type
  misc_feature (1)..(161): Functional Homolog Of Ceres SEEDLINE ID no. ME13087 at SEQ ID NO: 1116
MVAISEIKSTVETTAAANCLMLLSRVGQENVDGGSAKRVFTCKTCLKEFHSFQALGGHRASHKKPNNENLSGLMKKTKASSSHPCPICGVEFPMGQALGGHMRRHRNESGGAGALVTRELLPEAALMTLKKSSSGRLACLDLSLGMVENLNLKLELGRPVC

SEQ ID NO: 1145 - protein, 168 aa, Hordeum vulgare subsp. vulgare
  misc_feature (1)..(168): Public GI ID no.75706704
  misc_feature (1)..(168): Bit score of 269.3 for HMM based on sequences of FIGURE 37.
  misc_feature (19)..(41): Pfam Name: zf-C2H2 Pfam Description: Zinc finger, C2H2 type
  misc_feature (1)..(168): Functional Homolog Of Ceres SEEDLINE ID no. ME13087 at SEQ ID NO: 1116
MPMPMPVAARGHRAPERVFVCKTCDRVFPSFQALGGHRASHKKPRLDDGGDLKPKLHGCSVCGLEFAIGQALGGHMRRHRAMAAGGGGGVMPMTPPTAAAIKEHGESGDDDAVVGMKRGLWLDLNHPPCDEYGAGSESDDECGHVDAAAAGYTFHQFMDTGTMAVDCV

SEQ ID NO: 1146 - DNA, 696 bp, Sorghum bicolor
  misc_feature (1)..(696): Ceres ANNOT ID no.6016055
  misc_feature (1)..(696): Encodes the peptide sequence at SEQ ID NO 1147
atggccaagagggagagggcggcgtgggaggtggaggcgggcgccgccgcggacacggcccgcctgctcatgctcctcgcgcaggcgcagcagcagcacctcctgcagcagcacgcccaccaccaccaccaccaccaccacggggtcggggtgccgccgttccccgcggggcgcgccgcagtgcacgggcgcgtgttcgagtgcaagacgtgcagccggcagttccccacgttccaggcgctcgggggccaccgcgccagccacaagcgcccgagggtgctccagcagcagcagctacagcagcagcagacagtcgtcgccgatcacgcggggcagctctgcctcgggcgccagccgctgcagctgccgctgccgacgacgacgacgccgcagcaggccaagccgagggtgcacgagtgccccgtatgcgggctggagttcgccgtcggccaggcgctcggcggccacatgcgccggcaccgcgccgaggccgaggccgaggccaccgaggcgcccagcaaggtgatgatgcgcccggcgcacgacaagacctgcgacgtcgccggtgggatctgcctggacctcaacctcacgccgtcggagaactgcgccaagtgccggagcgtggtggtgctaggcgccgccgccgggcagggtgtacataagacgctcgccatgttagattgctcgctgtag

SEQ ID NO: 1147 - protein, 231 aa, Sorghum bicolor
  misc_feature (1)..(231): Ceres ANNOT ID no.6016055
  misc_feature (1)..(231): Bit score of 325.1 for HMM based on sequences of FIGURE 37.
  misc_feature (138)..(160): Pfam Name: zf-C2H2 Pfam Description: Zinc finger, C2H2 type
  misc_feature (1)..(231): Functional Homolog Of Ceres SEEDLINE ID no. ME13087 at SEQ ID NO: 1116
MAKRERAAWEVEAGAAADTARLLMLLAQAQQQHLLQQHAHHHHHHHHGVGVPPFPAGRAAVHGRVFECKTCSRQFPTFQALGGHRASHKRPRVLQQQQLQQQQTVVADHAGQLCLGRQPLQLPLPTTTTPQQAKPRVHECPVCGLEFAVGQALGGHMRRHRAEAEAEATEAPSKVMMRPAHDKTCDVAGGICLDLNLTPSENCAKCRSVVVLGAAAGQGVHKTLAMLDCSL

SEQ ID NO: 1148 - DNA, 579 bp, Sorghum bicolor
  misc_feature (1)..(579): Ceres ANNOT ID no.6016061
  misc_feature (1)..(579): Encodes the peptide sequence at SEQ ID NO 1149
atgacgcttacgagacacgaagcggaggagagcaaggagatggagggcctccgggcgcacgccgaggcgctgctcacgctgtcggcgcccgcgtcgtcgtcgtcgttgggcaccggcggcacgccgccggcgccgtcctcggccgcggcccgcagggccatggcggccgagggcgtgttcgagtgcaagacgtgcagcaagcgcttcccgtcgttccaggcgctcggcgggcaccgcaccagccacacgcggctgcaggcgaggatgctcagcgacccagcggcggccgcggccgcggccgagagggacagggcgcgggtgcacgagtgcgccgtctgcggcctcgagttctccatgggccaggcgctcggcgggcacatgcgccgccacaggggcgaggcgccgccagccgcgcacgacgacgaccccgcgcaggcgcagccggaccgggacatgccggacctcaacttgccgccgctggacgacggcagcggcggcggtagcggcgatggccaaggtccacaacagtcggattatgatcgcggctcggagcctcagctgcttaatctgcttgtatag

SEQ ID NO: 1149 - protein, 192 aa, Sorghum bicolor
  misc_feature (1)..(192): Ceres ANNOT ID no.6016061
  misc_feature (1)..(192): Bit score of 131.4 for HMM based on sequences of FIGURE 37.
  misc_feature (108)..(130): Pfam Name: zf-C2H2 Pfam Description: Zinc finger, C2H2 type
  misc_feature (1)..(192): Functional Homolog Of Ceres SEEDLINE ID no. ME13087 at SEQ ID NO: 1116
MTLTRHEAEESKEMEGLRAHAEALLTLSAPASSSSLGTGGTPPAPSSAAARRAMAAEGVFECKTCSKRFPSFQALGGHRTSHTRLQARMLSDPAAAAAAAERDRARVHECAVCGLEFSMGQALGGHMRRHRGEAPPAAHDDDPAQAQPDRDMPDLNLPPLDDGSGGGSGDGQGPQQSDYDRGSEPQLLNLLV

SEQ ID NO: 1150 - DNA, 552 bp, Sorghum bicolor
  misc_feature (1)..(552): Ceres ANNOT ID no.6020045
  misc_feature (1)..(552): Encodes the peptide sequence at SEQ ID NO 1151
atggccaccacgaccaccgaacgaccgacggcgacggcgagcaaccacacccagctgctgcggctgtacctgtcgctgtcgacgacggcgagcaaggtgatcgcgaagaagcagcacggcggcgtcatctgcagccaccaacagcagcagcaccgggccggcggcggcgcgttccggtgcaagacgtgcgggcgcgcgttcccgacgttccaggcgctgggcgggcaccggacgagccacaagcggccgctggtgcgcgcgcacggcctcgacctcctcctcggcgcgcgccccggcaagggcgccgccgccaccgacgtgcaccggtgcaccacctgcgccgccgtgttccccaccgggcaggcgctcggcggacacatgcgccggcacagggcagcggcggcggcggcggcgttcgacttcaatgtcgccgtgcacggcgagagcgagacggcggcaagggttgctgttgatgcctgcttgtctggagagatgcaggacgagagcgaggatgatgtcgcggggcccattaggttattcaagttcatatga

SEQ ID NO: 1151 - protein, 183 aa, Sorghum bicolor
  misc_feature (1)..(183): Ceres ANNOT ID no.6020045
  misc_feature (1)..(183): Bit score of 44.4 for HMM based on sequences of FIGURE 37.
  misc_feature (58)..(80): Pfam Name: zf-C2H2 Pfam Description: Zinc finger, C2H2 type
  misc_feature (1)..(183): Functional Homolog Of Ceres SEEDLINE ID no. ME13087 at SEQ ID NO: 1116
MATTTTERPTATASNHTQLLRLYLSLSTTASKVIAKKQHGGVICSHQQQQHRAGGGAFRCKTCGRAFPTFQALGGHRTSHKRPLVRAHGLDLLLGARPGKGAAATDVHRCTTCAAVFPTGQALGGHMRRHRAAAAAAAFDFNVAVHGESETAARVAVDACLSGEMQDESEDDVAGPIRLFKFI

SEQ ID NO: 1152 - DNA, 828 bp, Sorghum bicolor
  misc_feature (1)..(828): Ceres ANNOT ID no.6023798
  misc_feature (1)..(828): Encodes the peptide sequence at SEQ ID NO 1153
atgtcggtcccggactactccacctccaccggcggcgccatcatcgtctcctgcgcctccgtcgccaagctgaagccgcagcgcaacagcaagcgacgtcgacaccactgctcgtcgcccgctgcttcatcttcctcctcacacagtagcagcaccaccacacagaaagaggaggaggaagacgaggacatggctagatgcctcatcctcctcgcccagggcccccccgccgccgccgccgttgagccagcaagagtaatgccggcaccggcaccccccagcaggccaaagagcacgagccgcagagccgccgctgaggccggaggtggcgtgtgcgtgtcgtacgagtgcaagacgtgcaacaagtgcttcccctccttccaggccctcggcggccaccgcaccagccacaacaatgataagaagcagcagccgccgccgccgcgacggccggaggaggcggctgctgctgctgtcaccaccacgcttagcctgcgcacagctgcagcggcgacgaggccggcgcacgagtgctcgtcatgcggcgcggtgttcgcgtccgggcaggcgctcggtgggcacatgaggcgccaccggccgctcaccaccagctcgtcggccgcggcggcgcccgagagcgtggtcaccgccacggggacgacgggggaccaagacagtagcaagctgctgcaggagggcaacatcaacctggagctggacctcaacctgctgccggcgccgtcgacggagcaggaggtgacatccccggcaaagccgccgtgccatgcaccagcagttcagctgatgcatgctttgactcgccactag

SEQ ID NO: 1153 - protein, 275 aa, Sorghum bicolor
  misc_feature (1)..(275): Ceres ANNOT ID no.6023798
  misc_feature (1)..(275): Bit score of 83.2 for HMM based on sequences of FIGURE 37.
  misc_feature (176)..(198): Pfam Name: zf-C2H2 Pfam Description: Zinc finger, C2H2 type
  misc_feature (1)..(275): Functional Homolog Of Ceres SEEDLINE ID no. ME13087 at SEQ ID NO: 1116
MSVPDYSTSTGGAIIVSCASVAKLKPQRNSKRRRHHCSSPAASSSSSHSSSTTTQKEEEEDEDMARCLILLAQGPPAAAAVEPARVMPAPAPPSRPKSTSRRAAAEAGGGVCVSYECKTCNKCFPSFQALGGHRTSHNNDKKQQPPPPRRPEEAAAAAVTTTLSLRTAAAATRPAHECSSCGAVFASGQALGGHMRRHRPLTTSSSAAAAPESVVTATGTTGDQDSSKLLQEGNINLELDLNLLPAPSTEQEVTSPAKPPCHAPAVQLMHALTRH

SEQ ID NO: 1154 - DNA, 594 bp, Sorghum bicolor
  misc_feature (1)..(594): Ceres ANNOT ID no.6108658
  misc_feature (1)..(594): Encodes the peptide sequence at SEQ ID NO 1155
atggcgtatggcaagaggacacggcagaaggccgaggagatggtctggctgcccgacggcgccgacgtcgcgcgcttcctgctgctcttctcgggagaccaccagcaccactaccacggcgccggcggcgtggcatccacggacgcggcctcctcggcgcccgagcgggtgttcgagtgcaagacctgcaacaggcagttcccgtctttccaggcgctcggcggccaccgggccagccacaagaagccccgcctcgcggacggcggcgtcgacgccgccgcggccgagccgcccaagcccaaggtacacggctgctccatctgcggtctcgagttcgccatcggccaggcgctcggcggccacatgcgccgccaccgggctgccgatcaggcggacggcggcagccccggactcgggcttggcctcagcctcggcaccgggctactcgccccgaaagacgacagcggcaagaagaccgcgccgccggccgagctcgtgctggaccttaacgccgtgccggagctggaggaggagcaggatcgcgccaggctctccatcgaattccccgtagcagtagttgacttcttacgttaa

SEQ ID NO: 1155 - protein, 197 aa, Sorghum bicolor
  misc_feature (1)..(197): Ceres ANNOT ID no.6108658
  misc_feature (1)..(197): Bit score of 222.0 for HMM based on sequences of FIGURE 37.
  misc_feature (58)..(80): Pfam Name: zf-C2H2 Pfam Description: Zinc finger, C2H2 type
  misc_feature (1)..(197): Functional Homolog Of Ceres SEEDLINE ID no. ME13087 at SEQ ID NO: 1116
MAYGKRTRQKAEEMVWLPDGADVARFLLLFSGDHQHHYHGAGGVASTDAASSAPERVFECKTCNRQFPSFQALGGHRASHKKPRLADGGVDAAAAEPPKPKVHGCSICGLEFAIGQALGGHMRRHRAADQADGGSPGLGLGLSLGTGLLAPKDDSGKKTAPPAELVLDLNAVPELEEEQDRARLSIEFPVAVVDFLR

SEQ ID NO: 1156 - DNA, 717 bp, Zea mays
  misc_feature (1)..(717): Ceres SEEDLINE ID no.ME13106
  misc_feature (1)..(717): Ceres CLONE ID no.986438
  misc_feature (1)..(717): Inplanta Sequence
  misc_feature (1)..(717): Encodes the peptide sequence at SEQ ID NO. 1157
agacacatggatatgagcatcgctcgttcgttgcttgccaatcaatagggcccgcaatccacattggcacctgaggcggccacacttatgcctgagcggttttggagcaagaagataacgggagtgcacatcacattgatgtcgtacaactgcgtcttggcgatgccgaccttgaaccgggccacggcggtgaccgtcacggtgaaagcagagctattgacgtcggcgccgttgatgaaggccatggccatcgatccccgagacaccgacactgtagcgtcgacagtcgccacgctcccacgggtctgccacccagccatgagcgacgtcgcgttcttcttcaggtcggccttggtccagatcgacgccggggtcaccaccgtgctgttgagcacgtcgacgaggatggtgttgtaccacactgccgcgcgctggctggtgttgttggcggcgagggtgaagggctcagcaggacggagaagacggtgacgacgaccgccacggcgaggatcgccatcagagctgccaggatgtagtgtttgagattcagggccttcaggccagtccgcggcggagccatgcgtatatgggtgtggcagcagcagcagctctagccagagcgtatggtggttcaaactagtgtgcgagtactgcctgctgccaccagtttataccgtgcatgccactataattttagtatgcaaattatttgtggtc

SEQ ID NO: 1157 - protein, 133 aa, Zea mays
  misc_feature (1)..(133): Ceres SEEDLINE ID no.ME13106
  misc_feature (1)..(133): Ceres CLONE ID no.986438
MPERFWSKKITGVHITLMSYNCVLAMPTLNRATAVTVTVKAELLTSAPLMKAMAIDPRDTDTVASTVATLPRVCHPAMSDVAFFFRSALVQIDAGVTTVLLSTSTRMVLYHTAARWLVLLAARVKGSAGRRRR

SEQ ID NO: 1158 - DNA, 908 bp, Zea mays
  misc_feature (1)..(908): Ceres SEEDLINE ID no.ME13107
  misc_feature (1)..(908): Ceres CLONE ID no.996227
  misc_feature (1)..(908): Inplanta Sequence
  misc_feature (1)..(908): Encodes the peptide sequence at SEQ ID NO. 1159
acctcctagattaataggtaatccatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagaccgagcggcctcctaccaacaacacatcattggtggtgccctcttttagattgcttattagttgtaattcaataataaagttttttggatgatgtatgtggccaaccagaaataagaagttacatttccagattttaatgtg

SEQ ID NO: 1159 - protein, 240 aa, Zea mays
  misc_feature (1)..(240): Ceres SEEDLINE ID no.ME13107
  misc_feature (1)..(240): Ceres CLONE ID no.996227
  misc_feature (1)..(240): Bit score of 500.3 for HMM based on sequences of FIGURE 38.
  misc_feature (1)..(240): Pfam Name: Zein Pfam Description: Zein seed storage protein
MATKIFSLLMLLALSACVANATIFPQCSQAPIASLLPPYLPSMIASVCENPALQPYRLQQAIAASNIPLSPLLFQQSPALSLVQSLVQTIRAQQLQQLVLPVINQVALANLSPYSQQQQFLPFNQLSTLNPAAYLQQQLLPFSQLATAYSQQQQLLPFNQLAALNPAAYLQQQILLPFSQLAAANRASFLTQQQLLPFYQQFAANPATLLQLQQLLPFVQLALTDRAASYQQHIIGGALF

SEQ ID NO: 1160 - DNA, 856 bp, Glycine max
  misc_feature (1)..(856): Ceres CLONE ID no.1371824
  misc_feature (1)..(856): Encodes the peptide sequence at SEQ ID NO 1161
atcacccatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggtgacagccgcgagatttgaatacccaactatacaatcctacaggctacaagaggccatcgcagcaagcatcttacggtcgttagcattgaccgtccaacaaccatatgccctattgcaacaaccatccttaatgaatctatatctccaaagaatcgcagcacaacaactacaacaacagttgcttccaacaatcaatcaagtagttgcagcgaaccttgctgcttacctccagcaacaacaatttcttccattcaatcaactagctggggtgaaccctgctgcttacttgcaggcacaacagctactaccattcaaccaacttgtcaggagccctgctgccttcttactgcagcaacagttgcttccattccatctacaagttgtggcaaacattgctgctttcttgcaacaacaacaacaattgctgccattttacccacaggttgtgggaaacattaacgccttcttgcaacagcaacagttgctaccattctacccacaggatgtggcaaacaatgtcgccttcttacaacaacaacaattgctgccatttaaccaacttgctttgacgaatcctaccaccttattgcagcagcccaccattggtggtgccatcttctagatttttttatgctttatactgtaataataaagttctcatactgatatgtgcaacttctcagt

SEQ ID NO: 1161 - protein, 241 aa, Glycine max
  misc_feature (1)..(241): Ceres CLONE ID no.1371824
  misc_feature (1)..(241): Bit score of 505.0 for HMM based on sequences of FIGURE 38.
  misc_feature (1)..(241): Pfam Name: Zein Pfam Description: Zein seed storage protein
  misc_feature (1)..(241): Functional Homolog Of Ceres SEEDLINE ID no. ME13107 at SEQ ID NO: 1159
MAAKIFAILALLALSASVATATIIPQCSQQYLSPVTAARFEYPTIQSYRLQEAIAASILRSLALTVQQPYALLQQPSLMNLYLQRIAAQQLQQQLLPTINQVVAANLAAYLQQQQFLPFNQLAGVNPAAYLQAQQLLPFNQLVRSPAAFLLQQQLLPFHLQVVANIAAFLQQQQQLLPFYPQVVGNINAFLQQQQLLPFYPQDVANNVAFLQQQQLLPFNQLALTNPTTLLQQPTIGGAIF

SEQ ID NO: 1162 - protein, 264 aa, Coix lacryma-jobi
  misc_feature (1)..(264): Public GI ID no.22585
  misc_feature (1)..(264): Bit score of 544.9 for HMM based on sequences of FIGURE 38.
  misc_feature (1)..(264): Pfam Name: Zein Pfam Description: Zein seed storage protein
  misc_feature (1)..(264): Functional Homolog Of Ceres SEEDLINE ID no. ME13107 at SEQ ID NO: 1159
MATKIFALLVLLALSASATTAVIIPQCSLAPTAAIIPRFLPPVSAIGFEHPAVQAYRLQQALAASILQQPLAQLQQQSSAHLTIQTIAAQQQQQFLPSLSQLAAANPTAYLQQQLLASNPLAVANAIAYQHQQQLQQLLPALSQLAVANPAAYLQSQLFPSNPLVANAAAYLQQQQLQQILPVLSQLAVADPNSYLQQQQLLPFNQVAVANNAVYEQQHQLLQVNPLAAAFLQQQQRQLLPFNQMSLMNPALSWQQPIVGGVGF

SEQ ID NO: 1163 - protein, 268 aa, Sorghum bicolor
  misc_feature (1)..(268): Public GI ID no.22208482
  misc_feature (1)..(268): Bit score of 556.7 for HMM based on sequences of FIGURE 38.
  misc_feature (1)..(268): Pfam Name: Zein Pfam Description: Zein seed storage protein
  misc_feature (1)..(268): Functional Homolog Of Ceres SEEDLINE ID no. ME13107 at SEQ ID NO: 1159
MATKIFVLLALLALSVSTTTAVIIPQCSLAPNAIISQFLPPLTLVGFEHPALQAYRLQQALANSILQQPFPQLQQQSSAHLTVQTIAAQQQQQQFLPALSQLALANPVAYLQQQLLASNPLALVNNAAYQQQQLQQVLPVISQVAMANPAAYLQQQQLAYNPLVAANAAAYLQQQQLQQILPALSQLALVNPAAYLQQQQLLPFNQLAVTNTAAYLQQQQLLRVNPVVAANPLAAAFLQQQQLLPFNQISLMNPAFSWQQPIVGSAIF

SEQ ID NO: 1164 - protein, 234 aa, Acetabularia acetabulum
  misc_feature (1)..(234): Public GI ID no.16073
  misc_feature (1)..(234): Bit score of 492.5 for HMM based on sequences of FIGURE 38.
  misc_feature (1)..(233): Pfam Name: Zein Pfam Description: Zein seed storage protein
  misc_feature (1)..(234): Functional Homolog Of Ceres SEEDLINE ID no. ME13107 at SEQ ID NO: 1159
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPRQFLPFNQLAALNSAAYLQQQQLLPFSQLADVSPAAFLTQQQLLPFYLHAMPNAGTLLQLQQLLPFNQLALTNSTVFYQQPIIGGALFQ

SEQ ID NO: 1165 - DNA, 1075 bp, Zea mays
  misc_feature (1)..(1075): Ceres SEEDLINE ID no.ME13108
  misc_feature (1)..(1075): Ceres CLONE ID no.996263
  misc_feature (1)..(1075): Genomic Sequence
  misc_feature (1)..(1075): Inplanta Sequence
  misc_feature (1)..(1075): Encodes the peptide sequence at SEQ ID NO. 1166
agtttagttggtgctggtgctggtggaggaagaagcagcgcagcaggtggcagggatgggtcgcggcggcgggatggggaacccagtcaacgtgggcatcgcggtgcaggcggactgggagaaccgcgagttcatctccaacatctccctcaacgtccgacgcctcttcgacttcctcctcagattcggtcagctcctcttccattccatttccccgcggcctgccctctctcgatctggatctccaacttttggatctggtccgccgccttcgtgcttcataccataccacgcggagcttaattgtccttgctacccgcatattaccttgccctgcccgagcttatgtttagtcattgtgggatggcagacaattgctcaaactacccatgagaccggatgctttaactagtcattgtgggataatcaatattccggcgacgtttgaattgatgtcagacaatacatcctaacagccatccatctacatagcctgcctacctactcgttcggcctgttgctacttaccagcctcatgctcgttgtcaattaggctcgggttttgcatggaatggctgtaacttgcggtcactaagtaccttttaaaaaatagttgatagttgaatcccacacagcaccaacatgggattcagacctcacaaccacttgttgatagttggatcttttgatggtatgtgaatccctttcgagttgctgtgggagaagcaattgttgtacatgaggatgcagcaagagctatgggaaggaaacgcttatgaacaatagatacctggtcgtcctaatttcatgaagctacgacgaagagcaagctggcaagtttgaacgagaagctggacatcctagagcggaagctggaggtgcttgaagtccaagtgggcagcgcgacgaccaacccttccgtcttcaactaggaatcgcgggtttatatgtttaaataaataaatgtaggtatgaatgttgcttgtaccaacgaattctggtcgctatcaatcatgtaatgtaatgtagtgtaatggattttgttattattattgtggtatgtgtaaagatgtgc

SEQ ID NO: 1166 - protein, 84 aa, Zea mays
  misc_feature (1)..(84): Ceres SEEDLINE ID no.ME13108
  misc_feature (1)..(84): Ceres CLONE ID no.996263
  misc_feature (1)..(84): Bit score of 203.9 for HMM based on sequences of FIGURE 39.
MGRGGGMGNPVNVGIAVQADWENREFISNISLNVRRLFDFLLRFEATTKSKLASLNEKLDILERKLEVLEVQVGSATTNPSVFN

SEQ ID NO: 1167 - protein, 79 aa, Physcomitrella patens
  misc_feature (1)..(79): Public GI ID no.99109436
  misc_feature (1)..(79): Bit score of 165.7 for HMM based on sequences of FIGURE 39.
  misc_feature (1)..(79): Functional Homolog Of Ceres SEEDLINE ID no. ME13108 at SEQ ID NO: 1166
MAKNGINNSVAVGIAVQSDWDNRHFSSSLSLNVRRLFEFLLQFESSTRSKLATLNEKLTVLERQLEFLEAQFSTAINPV

SEQ ID NO: 1168 - DNA, 518 bp, Papaver somniferum
  misc_feature (1)..(518): Ceres CLONE ID no.1627939
  misc_feature (1)..(518): Encodes the peptide sequence at SEQ ID NO 1169
atttttttgactcctgagtttcttcgttcatcatcagcttctgtctcactctgaaaagaaagaaaggtcttgtgaattctccaaaacaaaccagatctacaagcaatcaatccacgtattaaaactagaactgtatgtaatcctagaaaacgaattgagaattgagtagagagggagagagatgtcgagaggtggaggggttgggattacaaacgcagtaaacgttggaatagcagttcaagcagactgggagaatcgtgaattcatttctaatatctcaatcaatgttcgtcgtctcttcgatttcctcatcaattttgaggcaacgacaaaaagcaagctagcctccttgaatgagaagctcgataccctggagcggcgtctggaacttctggaagtccaagttggcacagcatcagccaacccatctctttttacatgatgtaattcatgacaatgcaattcactatttgtaaaaaagaacggagcataaatacatgagtatcccttcaatttgc

SEQ ID NO: 1169 - protein, 86 aa, Papaver somniferum
  misc_feature (1)..(86): Ceres CLONE ID no.1627939
  misc_feature (1)..(86): Bit score of 201.4 for HMM based on sequences of FIGURE 39.
  misc_feature (1)..(86): Functional Homolog Of Ceres SEEDLINE ID no. ME13108 at SEQ ID NO: 1166
MSRGGGVGITNAVNVGIAVQADWENREFISNISINVRRLFDFLINFEATTKSKLASLNEKLDTLERRLELLEVQVGTASANPSLFT

SEQ ID NO: 1170 - DNA, 608 bp, Gossypium hirsutum
  misc_feature (1)..(608): Ceres CLONE ID no.1840433
  misc_feature (1)..(608): Encodes the peptide sequence at SEQ ID NO 1171
tttattattatttttcttaaaagaaatttaaaggaaaaagccagaaataggcgaggcaaagaagatctgtaaaaatcggcatctctttaggggaaaaaaggggaagaaatggcaagagcaggagggataacgaacgccgttaacgtagggatagcagtccaagccgattgggagaatcgcgaattcatctctcacatttccctcaatgttcgtcgcctctttgaatttctcctccaattcgaggctacaacaaagagcaaattagcatccttgaacgagaaactggacaccctggaacgtcgtttggagcttcttgaagttcaagttggaactgcttccgctaacccttctcttttcagtacgtgattcatatttaaaagttgtatttgtttccatatctttgtcgtgattttgttcctctcctagttttcggcgttgtaggaaaacaaagttttcttctttttctttttgtctatataataaccttggcgattagtgaacttttgctcttcgtttctttcgaatctgtcatatttgtaagacattagcatcttgctgttgaatttttctttcattcatcctttccttgattgtatattttttgtcag

SEQ ID NO: 1171 - protein, 85 aa, Gossypium hirsutum
  misc_feature (1)..(85): Ceres CLONE ID no.1840433
  misc_feature (1)..(85): Bit score of 214.6 for HMM based on sequences of FIGURE 39.
  misc_feature (1)..(85): Functional Homolog Of Ceres SEEDLINE ID no. ME13108 at SEQ ID NO: 1166
MARAGGITNAVNVGIAVQADWENREFISHISLNVRRLFEFLLQFEATTKSKLASLNEKLDTLERRLELLEVQVGTASANPSLFST

SEQ ID NO: 1172 - DNA, 297 bp, Populus balsamifera subsp. trichocarpa
  misc_feature (1)..(297): Ceres ANNOT ID no.1524198
  misc_feature (1)..(297): Encodes the peptide sequence at SEQ ID NO 1173
atggcgagagcaggcggaggaggaggaggcggaggagggataacaaacgcggtgaacgtagggatagcagtacaagcagattgggagaacagagaattcatatctcacatatctctcaacatccgtcgtctcttcgatttcctcatccaatttgagtccaccaccaagtccaaattgtcttctctcaatctcaagcttgatactttggagcgtcgtttacagcttctcgaactccaagtttccacggccacttcaaatccttctcttttcacttccaccactaccaccaccgcttga

SEQ ID NO: 1173 - protein, 98 aa, Populus balsamifera subsp. trichocarpa
  misc_feature (1)..(98): Ceres ANNOT ID no.1524198
  misc_feature (1)..(98): Bit score of 203.8 for HMM based on sequences of FIGURE 39.
  misc_feature (1)..(98): Functional Homolog Of Ceres SEEDLINE ID no. ME13108 at SEQ ID NO: 1166
MARAGGGGGGGGGITNAVNVGIAVQADWENREFISHISLNIRRLFDFLIQFESTTKSKLSSLNLKLDTLERRLQLLELQVSTATSNPSLFTSTTTTTA

SEQ ID NO: 1174 - DNA, 698 bp, Arabidopsis thaliana
  misc_feature (1)..(698): Ceres CLONE ID no.1650
  misc_feature (1)..(698): Encodes the peptide sequence at SEQ ID NO 1175
aaaaaaggaaggtgaccctccttctctaatcgattgcttaatcatttctgccgttggattgaatcgaaaaagggcgaattatttaaaaagcttcagaatttgaaatcgaaatctgtgagtactgttgtgtttgtggaagagagagttttggggtttaataatggcgaaagctggagggatcacgaacgcagtaaacgtaggaatcgctgttcaagcagattgggagaatcgagaatttatctcacatatctctcttaatgttcgtcgtctcttcgaattccttgttcaatttgaatcaaccacaaagagcaagttggcttctttgaatgagaagttggatctgttggaacgtcgcttggaaatgctggaggtgcaagtaagtaccgcgacagcaaatccttctctgtttgcgacgtgaaacaccgtagacgatatcgaaatcgaaaccgagcctgagcctttggctttaacagaagaagtctgttgttgaatgtgtaccattgaatgattctttctttcttcacatagctgtggtagtaagtaaactagtagcttaaaatatgaatctattcataaatatgtgtatcttttttctgtccataaagatctcttttgaatgacaagtcatttcgttgaactcttgaagtttttgctttcttctgctgttgatttataaactttgcagaggtacccttttc

SEQ ID NO: 1175 - protein, 85 aa, Arabidopsis thaliana
  misc_feature (1)..(85): Ceres CLONE ID no.1650
  misc_feature (1)..(85): Bit score of 215.2 for HMM based on sequences of FIGURE 39.
  misc_feature (1)..(85): Functional Homolog Of Ceres SEEDLINE ID no. ME13108 at SEQ ID NO: 1166
MAKAGGITNAVNVGIAVQADWENREFISHISLNVRRLFEFLVQFESTTKSKLASLNEKLDLLERRLEMLEVQVSTATANPSLFAT

SEQ ID NO: 1176 - DNA, 478 bp, Glycine max
  misc_feature (1)..(478): Ceres CLONE ID no.691979
  misc_feature (1)..(478): Encodes the peptide sequence at SEQ ID NO 1177
agtcaaaattaaactcagaaaatatatattcagtgaagagaaagagaggtgtgggaagtaaactgtgcattctaatctgcagagtgcatcagcattggatctggaaacgcgtggaagaagaagaaatggctcgcgcaggagggataacaaacgcagtgaacgtgggaatcgcagtgcaagccgattgggagaaccgcgaattcatctctcacatttctctcaacgttcgtcgcctcttcgacttcctcgtccaattcgaggctacgacgaagagcaagttggcgtctttaaatgagaagctggatgtgttggagcggagattggagctgcttgaagttcaagtgggcaatgcttcggccaacccttctctttttgccacatgatttttgtgttgtaagcactctccacctataatgtaaaatctaaatggaattctttatatgtaagtcgtttataaagcaaaagtgaagtgtttgat

SEQ ID NO: 1177 - protein, 85 aa, Glycine max
  misc_feature (1)..(85): Ceres CLONE ID no.691979
  misc_feature (1)..(85): Bit score of 214.3 for HMM based on sequences of FIGURE 39.
  misc_feature (1)..(85): Functional Homolog Of Ceres SEEDLINE ID no. ME13108 at SEQ ID NO: 1166
MARAGGITNAVNVGIAVQADWENREFISHISLNVRRLFDFLVQFEATTKSKLASLNEKLDVLERRLELLEVQVGNASANPSLFAT

SEQ ID NO: 1178 - DNA, 623 bp, Glycine max
  misc_feature (1)..(623): Ceres CLONE ID no.1020372
  misc_feature (1)..(623): Encodes the peptide sequence at SEQ ID NO 1179
ttccactgggaataaattgggcattctaatctgctgcagagtgcagagtgcagagtgcatcagcattggatctggaaacgcgtgaaagaagacatggctcgcgcgggagggataacaaacgcagtgaacgcgggaatcgcggtgcaagccgattgggagaaccgcgaattcatctctcacatttctctcaacgttcatcgcctcttcgacttccttgtccaattcgaggctacgacgaagagcaagttggcgtctttgaatgagaagctggatgtgttggagcggaggttggagctgcttgaagttcaagtgggcaatgcttcggctaatccttctctttttgccacttgaatttgtgttgtgagcattctccacctataatgtaaaatgaaaatctaaatggaattcttgatatgcaagtcatttataaagcaaaagtgaagtgtttgattagtatcatgctttgttttgtaaccctagctctcttggtttttcaatttattgcgtgatcatatagttaactgcatatttgcaactttggagtaagaaatcatgttgaaattatcagatttttaccctgtttgccttgtgtaaatgccttaaaagtttaacttagtcccttt

SEQ ID NO: 1179 - protein, 85 aa, Glycine max
  misc_feature (1)..(85): Ceres CLONE ID no.1020372
  misc_feature (1)..(85): Bit score of 207.3 for HMM based on sequences of FIGURE 39.
  misc_feature (1)..(85): Functional Homolog Of Ceres SEEDLINE ID no. ME13108 at SEQ ID NO: 1166
MARAGGITNAVNAGIAVQADWENREFISHISLNVHRLFDFLVQFEATTKSKLASLNEKLDVLERRLELLEVQVGNASANPSLFAT

SEQ ID NO: 1180 - protein, 85 aa, Medicago truncatula; identical to SEQ ID NO: 1177
  misc_feature (1)..(85): Public GI ID no.92876897
  misc_feature (1)..(85): Bit score of 214.3 for HMM based on sequences of FIGURE 39.
  misc_feature (1)..(85): Functional Homolog Of Ceres SEEDLINE ID no. ME13108 at SEQ ID NO: 1166

SEQ ID NO: 1181 - DNA, 463 bp, Panicum virgatum
  misc_feature (1)..(463): Ceres CLONE ID no.1774130
  misc_feature (1)..(463): Encodes the peptide sequence at SEQ ID NO 1182
aaagcttacaggagaagagaagaagacaaggcggcggcggcggcgcggggatgggtcgcggtggcgggatggggaaccccgtcaacgtgggcatcgccgtgcaggcggactgggggaaccgcgagttcatctccaacatctccctcaacgtccgccgactcttcgacttcctcctcagattcgaagctaccacgaagagcaagctggcatctttgaacgagaagctagacatcctagagaggaagctggaggtgcttgaagtccaagtgagcagcgcaacgaccaatccttcggtcttcaactagaagacacggtggtgtgctgcgtgaacgtgtatcatgtacgtacgtaagtaagagtggcatgtaaaacacactgctgctagtatcatgtgttttgtacaattgtaaaacacttgtgcatcgaagttgacttgcaagcagcttcgcgtttgcgtggaggc

SEQ ID NO: 1182 - protein, 84 aa, Panicum virgatum
  misc_feature (1)..(84): Ceres CLONE ID no.1774130
  misc_feature (1)..(84): Bit score of 202.1 for HMM based on sequences of FIGURE 39.
  misc_feature (1)..(84): Functional Homolog Of Ceres SEEDLINE ID no. ME13108 at SEQ ID NO: 1166
MGRGGGMGNPVNVGIAVQADWGNREFISNISLNVRRLFDFLLRFEATTKSKLASLNEKLDILERKLEVLEVQVSSATTNPSVFN

SEQ ID NO: 1183 - protein, 86 aa, Oryza sativa subsp. japonica
  misc_feature (1)..(86): Public GI ID no.115450018
  misc_feature (1)..(86): Bit score of 202.8 for HMM based on sequences of FIGURE 39.
  misc_feature (1)..(86): Functional Homolog Of Ceres SEEDLINE ID no. ME13108 at SEQ ID NO: 1166
MARAGGHGMGNPVNVGIAVQADWENREFISNISLNVRRLFDFLLRFEATTKSKLASLNEKLDILERKLEVLEVQVSSATTNPSVFN

SEQ ID NO: 1184 - DNA, 647 bp, Zea mays
  misc_feature (1)..(647): Ceres SEEDLINE ID no.ME13110
  misc_feature (1)..(647): Ceres CLONE ID no.988083
  misc_feature (1)..(647): Inplanta Sequence
  misc_feature (1)..(647): Encodes the peptide sequence at SEQ ID NO. 1185
caaagacctccgcggcgtctcggctagtcgcctttccatttttaccctcttctctctcctctccggccgttgccgttgctccgcgccgctctcctgtcagtagccgctgccgccgacgctgcaagtgtgggtctgtcgccgcggccatgttcgcctggatcctccgcggctgccgcgacgagtgctccgcctccgaccagctcaagcaggctcacgatgtcttcaaggcgaaagaggtggtcctgcaaaagaagatctctcaagaggtggaacgggccaaggagttcacaaagtcgggaaacaagcaggcagcaatgcagtgcctgaagaggaagaggtactacgagagtcaaatgaaccaagttggaagcgttcagctgcgcattaacaccaaggagagaatgatcgctgatcacacgggcaacaaataacacaaaagtaaatgatggcagtttgtatatctgagcagctacgttaacctgtaaaacagcaagccggcaagccgactctataatgtatttaacatagagatagccttgtccttttcttatcgttcagtaaactacattgtaaacactctcctgccattttgctcctgattttcctgaactttctgttctgcgtaatgacatttgtgtgaatgtttt

SEQ ID NO: 1185 - protein, 94 aa, Zea mays
  misc_feature (1)..(94): Ceres SEEDLINE ID no.ME13110
  misc_feature (1)..(94): Ceres CLONE ID no.988083
  misc_feature (1)..(94): Bit score of 270.7 for HMM based on sequences of FIGURE 40.
  misc_feature (14)..(81): Pfam Name: Snf7 Pfam Description: Snf7
MFAWILRGCRDECSASDQLKQAHDVFKAKEVVLQKKISQEVERAKEFTKSGNKQAAMQCLKRKRYYESQMNQVGSVQLRINTKERMIADHTGNK

SEQ ID NO: 1186 - DNA, 627 bp, Triticum aestivum
  misc_feature (1)..(627): Ceres CLONE ID no.737317
  misc_feature (1)..(627): Encodes the peptide sequence at SEQ ID NO 1187
  misc_feature (252)..(252): m is a or c
aaaaaactgccgctttattattttcattttcattttcggaagccgtttttacctttcctccgagtagccgctgccgccgccgctgacagggtagaaccaccgcatccgcgatgttctcgtggatcctccgtggctgccgcgacgagtgctcagccactgaccagctcaagcaggctcgtgatgtctttgtggcaaaagaggcagtcttgcaaaagaagatatcacaagagatggaacgtgccaaggagttcmcaaaatcaggaaacaagcaagcagcaatgcagtgtttgaagaggaaaaggtactacgagagccaaatgaaccaggttggaagtgtccggttacgcattgataccaaggaaaagatgatcgctgataacatggtgaacaaataagacaagtgagaccatagctctgcactatatctctttccataaatcatttttgccttgctcagatatgtaatcttgtgaaaagagcattgttgctgtcatcagagtaacattatgattctctataatgtacataacactaacgggccatttcttagtgtaagagattattgaattagatcttgaagagtgtgtaatgtcacaaattagataagagctgcgttgtctttttacc

SEQ ID NO: 1187 - protein, 94 aa, Triticum aestivum
  misc_feature (1)..(94): Ceres CLONE ID no.737317
  misc_feature (1)..(94): Bit score of 267.3 for HMM based on sequences of FIGURE 40.
  misc_feature (14)..(81): Pfam Name: Snf7 Pfam Description: Snf7
  misc_feature (1)..(94): Functional Homolog Of Ceres SEEDLINE ID no. ME13110 at SEQ ID NO: 1185
  misc_feature (48)..(48): Xaa is any aa, unknown or other
MFSWILRGCRDECSATDQLKQARDVFVAKEAVLQKKISQEMERAKEFXKSGNKQAAMQCLKRKRYYESQMNQVGSVRLRIDTKEKMIADNMVNK

SEQ ID NO: 1188 - DNA, 579 bp, Panicum virgatum
  misc_feature (1)..(579): Ceres CLONE ID no.1880853
  misc_feature (1)..(579): Encodes the peptide sequence at SEQ ID NO 1189
aactcggcttttacatttctgcccttttctctctccgtcccggcggcgttgccgttgctctgcgccgctctcctgtctccccaccagtagccgctgcgagagtagagtagcagaccccgccgccgcggccatgttctcctggatcctccgcggctgccgcgacgagtgctccgcctccgatcagctcaagcaggctcgtgatgtcttcatggcaaaagaggcagtcttgcaaaagaagatttctcaagagatggaaagggccaaggagttcacaaagtcaggaaacaaacaagcagcaatgcagtgcttgaagaggaaaaagtactatgagagccaaatgagccaggttggaagtgtccagttacgcattaataccaaggagaaaatgatcgctgatcacatgggaaacaaataacacaaagtgagatcgcggctcttgaactaatgtctcaactcacctttgttttgttcagatacgtagtcttcaaatcttgtgaaaagtcaattgttgctgttctctgccacactgacaccaagcttaacattaatgtgcccttaacataagatggtacatttcag

SEQ ID NO: 1189 - protein, 94 aa, Panicum virgatum
  misc_feature (1)..(94): Ceres CLONE ID no.1880853
  misc_feature (1)..(94): Bit score of 271.4 for HMM based on sequences of FIGURE 40.
  misc_feature (14)..(81): Pfam Name: Snf7 Pfam Description: Snf7
  misc_feature (1)..(94): Functional Homolog Of Ceres SEEDLINE ID no. ME13110 at SEQ ID NO: 1185
MFSWILRGCRDECSASDQLKQARDVFMAKEAVLQKKISQEMERAKEFTKSGNKQAAMQCLKRKKYYESQMSQVGSVQLRINTKEKMIADHMGNK

SEQ ID NO: 1190 - protein, 115 aa, Oryza sativa subsp. indica
  misc_feature (1)..(115): Public GI ID no.125558381
  misc_feature (1)..(115): Bit score of 262.0 for HMM based on sequences of FIGURE 40.
  misc_feature (47)..(99): Pfam Name: Snf7 Pfam Description: Snf7
  misc_feature (1)..(115): Functional Homolog Of Ceres SEEDLINE ID no. ME13110 at SEQ ID NO: 1185
MFAWLLRGCRDECSASDQLKQGVVKEKNRCWFWGAFSVNARDVFVAKEAVLQKKISQEMERAKEFTKSGNKQAAMQCLKRKKYYESQMNQVGSVQLRINTKEKMIADHSGNKEDK

SEQ ID NO: 1191 - protein, 97 aa, Oryza sativa subsp. japonica
  misc_feature (1)..(97): Public GI ID no.115472157
  misc_feature (1)..(97): Bit score of 270.9 for HMM based on sequences of FIGURE 40.
  misc_feature (14)..(81): Pfam Name: Snf7 Pfam Description: Snf7
  misc_feature (1)..(97): Functional Homolog Of Ceres SEEDLINE ID no. ME13110 at SEQ ID NO: 1185
MFAWLLRGCRDECSASDQLKQARDVFVAKEAVLQKKISQEMERAKEFTKSGNKQAAMQCLKRKKYYESQMNQVGSVQLRINTKEKMIADHSGNKEDK

SEQ ID NO: 1192 - protein, 85 aa, Oryza sativa subsp. japonica
  misc_feature (1)..(85): Public GI ID no.125600283
  misc_feature (1)..(85): Bit score of 180.3 for HMM based on sequences of FIGURE 40.
  misc_feature (17)..(69): Pfam Name: Snf7 Pfam Description: Snf7
  misc_feature (1)..(85): Functional Homolog Of Ceres SEEDLINE ID no. ME13110 at SEQ ID NO: 1185
MPNYNVKSTARDVFVAKEAVLQKKISQEMERAKEFTKSGNKQAAMQCLKRKKYYESQMNQVGSVQLRINTKEKMIADHSGNKEDK

SEQ ID NO: 1193 - DNA, 1098 bp, Arabidopsis thaliana
  misc_feature (1)..(1098): Ceres SEEDLINE ID no.ME13125
  misc_feature (1)..(1098): Ceres CLONE ID no.732
  misc_feature (1)..(1098): Inplanta Sequence
  misc_feature (1)..(1098): Encodes the peptide sequence at SEQ ID NO. 1194
acaattaacaaactcggccgtcgtcatgtctctccgtaaaaccctaaccgccgtgaatcaatcttcgttaccgccggattctttaatctccgccggtaatctcactgtttcagaggtctctggttcatcttctagaatcagatttcgtcctcgtaaaatcaggaaagtttcgtcagatccgtcgccgaggatcattatcaccgcgtctcctcctctatcaacaaaatcgactgttgatatcgctctacgtcacttacaaagctccgatgaacttctcggagcattaatcacaacgcacaacgatcctccagtgttcgactctagtaatactccgtttctctccttagcgagatcaatcctataccaacaactcgcgacgaaagcagcgaaatgtatctacgatcgattcatctctctattcaacggtggagaagcaggtgtttttcctgaatctgtgatctcactctccgccgttgatcttcgtaagatcggtgtctccgggagaaaagctagttacctccacgatctagctgataaatacaacaacggtgtgctttctgatgaattgattctgaaaatgagtgatgaagagttgattgataggttaactttggttaaaggaattggagtgtggactgttcatatgtttatgatcttctcgttgcatagacctgatgtgttgcctgtgggagatcttggtgtgaggaaaggtgtgaaagatctttatggtttgaaaaatcttccaggtccattgcaaatggagcagctttgtgagaaatggcgtccttataggtctgttggttcatggtacatgtggagactaatcgagtctcgtaagaccaaatagcacctgcctgtaatcgggcagctaatatgatcctgtgacgaagaagcttttccatgcccatcacttcctttccaagtttcacttgctggtaatctgagttattttgtgtctgtaaattatggagcacgtaagaaaaatccttcttgtattttaactgtattccacggattatatttctgtgactgttgtaaacatgtatcatgtatggggtttcatttgacttggatattgagaagcatggcttatttacc

SEQ ID NO: 1194 - protein, 273 aa, Arabidopsis thaliana
  misc_feature (1)..(273): Ceres SEEDLINE ID no.ME13125
  misc_feature (1)..(273): Ceres CLONE ID no.732
  misc_feature (1)..(273): Bit score of 697.0 for HMM based on sequences of FIGURE 41.
  misc_feature (108)..(254): Pfam Name: HhH-GPD Pfam Description: HhH-GPD superfamily base excision DNA repair protein
MSLRKTLTAVNQSSLPPDSLISAGNLTVSEVSGSSSRIRFRPRKIRKVSSDPSPRIIITASPPLSTKSTVDIALRHLQSSDELLGALITTHNDPPVFDSSNTPFLSLARSILYQQLATKAAKCIYDRFISLFNGGEAGVFPESVISLSAVDLRKIGVSGRKASYLHDLADKYNNGVLSDELILKMSDEELIDRLTLVKGIGVWTVHMFMIFSLHRPDVLPVGDLGVRKGVKDLYGLKNLPGPLQMEQLCEKWRPYRSVGSWYMWRLIESRKTK

SEQ ID NO: 1195 - DNA, 1548 bp, Gossypium hirsutum
  misc_feature (1)..(1548): Ceres CLONE ID no.1938817
  misc_feature (1)..(1548): Encodes the peptide sequence at SEQ ID NO 1196
aatacctccactcgctcatctattttccttccactacttcgacccttaaccccgctgcccatcgtcaacgtcaacgccaacgccaacgccaacgccgctttcattctccaaagatttttaaattatatctcaaattttgatcgatttcaaatgggcgaacaaaccccgtcgcagcctcagccgcaggttcaatctcagccacctaatgactcctctactacgactcaagcccaagttcaaaaccaatctggagacccgagtaatacctccacggccgctgtttccaccgttaccaccgcctgtaccgctattgtagcatgtggtccgacggagctagtcaatgttcctctcccaacctcgtctcctccttcgaaaatcccttcccgccctcgaaaaatccggaaactctcccctgacctgagcttcgaccctaatgcctcccaacaagcaacgacctcctcctccacatccctgaccgaacagcgtaaaactgtcggcagaacttccaaaacaaaactcagtcaacatcgagccctagcggttgtggctccacgaatcattgctcggtccctctcttgcgagggcgaggtcgaaaccgccatccgccaccttcgcgacgccgatcccctcctcgcttccttaatcgacctccatccacctccgaccttcgacactttccatgcccctttcctcgcgctcactcggagcattctctaccaacagctcgctttcaaagccggaacctccatctacacccgcttcatctctctctgcggaggcgaaaacggggttgttcctgaaactgttctttctttaacctctcaacagctgcgacaaattggtgtctcgggacgaaaagcgagttaccttcatgatctcgcgagaaaataccagacggggatattatcggactcggcgattgtaaatatggatgacaaatcacttttcaccatgcttacgatggtcaatgggattggttcttggtcggttcatatgttcatgattttttcgcttcatagacccgatgttttgccaattaatgatctcggggttcgaaaaggggttcaattgctctacaatttggaggagttgccaaggccttcgcagatggatcaattgtgtgagaaatggaggccatacaggtcggttgcttcctggtatctttggaggtatgtggaggccaaaggagcgccttcgagtgctgccgcggttgctgctggtgctagtcttccaccgctgcagcaacaagaggagccgcaacaacatcagcaacagcccccgcttatggaccccattaatagcattctcaaccttggggcctgtgcctgggggcaatgattgtcattggagatggaatgtttggcgtttgtcacaatccatggatctgaaaggcaggcacttgaaaggaaaaatgtttgcgtgaaaattattgttctgaaagccattaaaattataagccttaagagtaaagtctttttaactttggtctcctaaatctgctttgagattgaataaacacactgcccggttctttggtcttcttatttt

SEQ ID NO: 1196 - protein, 395 aa, Gossypium hirsutum
  misc_feature (1)..(395): Ceres CLONE ID no.1938817
  misc_feature (1)..(395): Bit score of 975.6 for HMM based on sequences of FIGURE 41.
  misc_feature (184)..(329): Pfam Name: HhH-GPD Pfam Description: HhH-GPD superfamily base excision DNA repair protein
  misc_feature (1)..(395): Functional Homolog Of Ceres SEEDLINE ID no. ME13125 at SEQ ID NO: 1194
MGEQTPSQPQPQVQSQPPNDSSTTTQAQVQNQSGDPSNTSTAAVSTVTTACTAIVACGPTELVNVPLPTSSPPSKIPSRPRKIRKLSPDLSFDPNASQQATTSSSTSLTEQRKTVGRTSKTKLSQHRALAVVAPRIIARSLSCEGEVETAIRHLRDADPLLASLIDLHPPPTFDTFHAPFLALTRSILYQQLAFKAGTSIYTRFISLCGGENGVVPETVLSLTSQQLRQIGVSGRKASYLHDLARKYQTGILSDSAIVNMDDKSLFTMLTMVNGIGSWSVHMFMIFSLHRPDVLPINDLGVRKGVQLLYNLEELPRPSQMDQLCEKWRPYRSVASWYLWRYVEAKGAPSSAAAVAAGASLPPLQQQEEPQQHQQQPPLMDPINSILNLGACAWGQ

SEQ ID NO: 1197 - DNA, 1645 bp, Gossypium hirsutum
  misc_feature (1)..(1645): Ceres CLONE ID no.1919427
  misc_feature (1)..(1645): Encodes the peptide sequence at SEQ ID NO 1198
gacaattttaaggattaaataataaaaaaaggggtcagtcactcctccactaatctatgtttggagtcattggacttgctctcataacagctccactcgctcatctattttccttccactactcctccccttaaccccgccgcccatcgtcatcgtcaacgtcaacgtcaacgccaacgccaacgccaacgccaacgccgctttcattctccaaaggtttttaaattatatctcagattttgatcgatttcacatgggcgaacaaaccccgtcgcagcctcagccgcaggttcaatctcagccaccgaatgactcctctactacgactcaagcccaagttcaaacccaatctggagacccgagtaattcctccacggcccctttttccaccgttaccaccgcctgtaccgccattgtagcatgtggtccgacggagctagtcaatgttcctctcccaacctcgtctcctccttcgaaaatcccttcccgccctagaaaaatccggaaactctcccctgacctgagcttcgaccccaatgcctcccaacaagcaacgacctcctcctccacatccctgaccgaacagcgtaaaaccgtcggcagaacttccaaaacaaaactcagtcaacatcgagccctagcggtggtggctccacgaatcatttctcggtccctctcttgcgagggcgaggtcgaaaacgccatccaccaccttcgcgacgccgatcccctcctcgcttccttaatcgacctccatccacctccaaccttcgacactttccatgcccctttcctcgcgctcactcggagcattctctaccaacagctcgctttcaaagccggaacctccatctacacccgcttcatctctctctgcggaggcgaaaacggggttgttcctgaaactgttctttctttaacctctcaacagctgcgacaaattggtgtctcgggacgaaaagcgagttaccttcatgatctcgcaagaaaataccagacggggatattatcggactcggcgattgtaaatatggatgacaaatcacttttcaccatgcttacgatggtcaatgggatcggttcttggtcggttcatatgttcatgattttttcgcttcatagacccgatgttttgccaattaatgatctcggggttcgaaaaggggttcaattgctctacaatttggaggagttgccaaggccgtcgcagatggatcaattgtgtgagaaatggaggccatacaggtcggttgcttcctggtatctttggaggtatgtggaggccaaaggagcgccttcgagtgctgccgcggttgctgctggtgctagtcttccaccgctgcagcaacaagaggagccgcaacaacatcagcaacagccccagcttatggaccccattaatagcattctcaaccttggggcctgtgcctgggggcaatgattgtcattggagatggaatgtttggcatttgtcacaatccatggatctgaaaggcaggcacttgaaaggaaaaatgtttgcgtgaaaattattgttctgaaagccattaaaaaattataagccttaagagtaaagtctttttaactatggtctcctaaatctgctttgagattgaataaacacactgcccggttctttggtctt

SEQ ID NO: 1198 - protein, 395 aa, Gossypium hirsutum
  misc_feature (1)..(395): Ceres CLONE ID no.1919427
  misc_feature (1)..(395): Bit score of 968.6 for HMM based on sequences of FIGURE 41.
  misc_feature (184)..(329): Pfam Name: HhH-GPD Pfam Description: HhH-GPD superfamily base excision DNA repair protein
  misc_feature (1)..(395): Functional Homolog Of Ceres SEEDLINE ID no. ME13125 at SEQ ID NO: 1194
MGEQTPSQPQPQVQSQPPNDSSTTTQAQVQTQSGDPSNSSTAPFSTVTTACTAIVACGPTELVNVPLPTSSPPSKIPSRPRKIRKLSPDLSFDPNASQQATTSSSTSLTEQRKTVGRTSKTKLSQHRALAVVAPRIISRSLSCEGEVENAIHHLRDADPLLASLIDLHPPPTFDTFHAPFLALTRSILYQQLAFKAGTSIYTRFISLCGGENGVVPETVLSLTSQQLRQIGVSGRKASYLHDLARKYQTGILSDSAIVNMDDKSLFTMLTMVNGIGSWSVHMFMIFSLHRPDVLPINDLGVRKGVQLLYNLEELPRPSQMDQLCEKWRPYRSVASWYLWRYVEAKGAPSSAAAVAAGASLPPLQQQEEPQQHQQQPQLMDPINSILNLGACAWGQ

SEQ ID NO: 1199 - DNA, 831 bp, Populus balsamifera subsp. trichocarpa
  misc_feature (1)..(831): Ceres ANNOT ID no.1457245
  misc_feature (1)..(831): Encodes the peptide sequence at SEQ ID NO 1200
atgggcaaacccgttacccgatcccactctctacttctccacgaaccctcttctcctccactatccaccaccacctcctccaaaatctcatttcaatctagaaaaatcagaaaactttcaaccaacaaaacaaccaccactaccaccgctataacctccacttccatcccccctctcaaacccttatctcacaaaggcgaaatagaactggcacttgatcatttaagcaaatcagatcctcttcttgcacctctattaaacagccatgaaccaccagcactgaatccttgtacctcaccgtttctttctttaacaaaatccatcctttttcaacaactagcaacaaacgcagccaaatcaatctacacacgttttctcactctctgtgacggagaatctcaagtaaacccagatactgtactctcattatctgcccccaaactcagagaaatcggggtttctggtcgaaaagcgagttatttacatgacttagcagagaaatatcgaaatgggtctttatctgactcctcaattcttgaaatgaatgatgatatgttattgaataggttgactgaagttaagggaattggggtttggtctgtgcatatgtttatgctattttcgttgcacagaccggatgttttgcctgttggtgatctgggtgtgagaaaaggggtgcaaagtttgtatgggttgaaggatttgccacaggcattggagatggagcagatttgtgagaaatggaagccttataggtcagttgggtcgtggtatatgtggaggttaatggaagctaaggctttggcgaataaagcagctaaaaaagcataa

SEQ ID NO: 1200 - protein, 276 aa, Populus balsamifera subsp. trichocarpa
  misc_feature (1)..(276): Ceres ANNOT ID no.1457245
  misc_feature (1)..(276): Bit score of 709.1 for HMM based on sequences of FIGURE 41.
  misc_feature (105)..(250): Pfam Name: HhH-GPD Pfam Description: HhH-GPD superfamily base excision DNA repair protein
  misc_feature (1)..(276): Functional Homolog Of Ceres SEEDLINE ID no. ME13125 at SEQ ID NO: 1194
MGKPVTRSHSLLLHEPSSPPLSTTTSSKISFQSRKIRKLSTNKTTTTTTAITSTSIPPLKPLSHKGEIELALDHLSKSDPLLAPLLNSHEPPALNPCTSPFLSLTKSILFQQLATNAAKSIYTRFLTLCDGESQVNPDTVLSLSAPKLREIGVSGRKASYLHDLAEKYRNGSLSDSSILEMNDDMLLNRLTEVKGIGVWSVHMFMLFSLHRPDVLPVGDLGVRKGVQSLYGLKDLPQALEMEQICEKWKPYRSVGSWYMWRLMEAKALANKAAKKA

SEQ ID NO: 1201 - DNA, 1770 bp, Glycine max
  misc_feature (1)..(1770): Ceres CLONE ID no.577910
  misc_feature (1)..(1770): Encodes the peptide sequence at SEQ ID NO 1202
  misc_feature (1513)..(1513): r is g or a
aagatcgaacgacgaagaccaagacgaagaagaagaaacaagagcagcgagaaactgagtgaggaaaggatgaagaaagcagagtgagtcccgttccattccgtatcgttcatcacattatattgattcctctccaaaaaaccctctcaattgcacgttcctcaatctcacttatgggcgaacagacgctaggtcaagcacaatccctaatcgaacctcaacctctccccgccccctcctcaactgccgtccccgacggtgccacggtggactccgaactaaacaatgtccctcggccgacaacatccccagccacgaaaatccccctccgtccccgcaagatccggaaggtctctccggacccctccacctccgaatcccaaaccgaaacccccaaacccgccaaaaccgggggccgcaacaccaccaaggctgctccgccgcgagcccttacggtggtccctcgtatagtggcgcgctcactctcctgcgacggtgaagtcgagatcgcgctccggtacctccgcaacgcggacccagtcctctcccctctcatcgacattcaccaacccccaaccttcgacaatttccacactcccttcctcgccctaacccgcagcatcttgtaccagcaactcgcgtacaaagccggcacctccatctacacgcgcttcatcgcgctctgcgggggcgaaaacggtgtcgttcccgaaaccgttctcgccctaacaccccaacagcttcgccagattggggtttctgggcggaaggcgagttaccttcatgatttggcgaggaagtatcagaacgggatactctccgattccgccattgtgaacatggatgataagtcgctccttaccatgctcaccatggtcaatggcattggctcttggtctgttcacatgttcatgattttctcactccacagacccgatgttctccccatcaatgaccttggcgtcaggaaaggagttcagcttctctacaacctcgaggacttaccccggccctcgcagatggaccagttgtgtgacaagtggaggccttaccggtccgttgcttcgtggtacatgtggagatttgttgaagccaagggaactccttcgagtgcggtggcggtagcgaccggtgctggcttgcagcagcagcagcaccaccagcaccatcaccagcaccaacaacaggaacaacaacagcagcagcagcagcaacagcagcatcctccacagccacagcttctggatcccatcaatagcatgtttaatctcggggccgcctgtgcttggggacaatgatcgctgtcaaaatttgtatcagacttggttagcggtcgctcacgcgtgaagctgcaaaaccacgctgtgaagtgtaatgatagatcgtagtactgaaacttggacattggggagttgaggaactagtgtattatgactgccttgtgttcaataaaaccagtgcaagattaataaaggccactccttaattttgttttatttatcggttattgtarctgttggaggcctattatgtcaagttgtcaagtcgtcatttagtaggacaagacttattataggagggcagtgtcactgcctttgctgcatcataatggtttggacttttggacaatgtaattaatgtatggagtccttgtcttgcgtcctgctagtggactggcctttgagttaagattcgtctagtgtaaaaacgtaaaagatgtgtaattcctatccgtaatagaattgtcgtctactatatttgagcaatgcg

SEQ ID NO: 1202 - protein, 374 aa, Glycine max
  misc_feature (1)..(374): Ceres CLONE ID no.577910
  misc_feature (1)..(374): Bit score of 1001.8 for HMM based on sequences of FIGURE 41.
  misc_feature (147)..(292): Pfam Name: HhH-GPD Pfam Description: HhH-GPD superfamily base excision DNA repair protein
  misc_feature (1)..(374): Functional Homolog Of Ceres SEEDLINE ID no. ME13125 at SEQ ID NO: 1194
MGEQTLGQAQSLIEPQPLPAPSSTAVPDGATVDSELNNVPRPTTSPATKIPLRPRKIRKVSPDPSTSESQTETPKPAKTGGRNTTKAAPPRALTVVPRIVARSLSCDGEVEIALRYLRNADPVLSPLIDIHQPPTFDNFHTPFLALTRSILYQQLAYKAGTSIYTRFIALCGGENGVVPETVLALTPQQLRQIGVSGRKASYLHDLARKYQNGILSDSAIVNMDDKSLLTMLTMVNGIGSWSVHMFMIFSLHRPDVLPINDLGVRKGVQLLYNLEDLPRPSQMDQLCDKWRPYRSVASWYMWRFVEAKGTPSSAVAVATGAGLQQQQHHQHHHQHQQQEQQQQQQQQQQHPPQPQLLDPINSMFNLGAACAWGQ

SEQ ID NO: 1203 - protein, 335 aa, Zea mays
  misc_feature (1)..(335): Ceres CLONE ID no.100736184
  misc_feature (1)..(335): Bit score of 871.6 for HMM based on sequences of FIGURE 41.
  misc_feature (125)..(270): Pfam Name: HhH-GPD Pfam Description: HhH-GPD superfamily base excision DNA repair protein
  misc_feature (1)..(335): Functional Homolog Of Ceres SEEDLINE ID no. ME13125 at SEQ ID NO: 1194
MGEQSLSQPKPQPLSPFPSPPASAALPPPASASASASASAASTSRTTSAAASRPKKKVTNPSPDRNPAKKPRLTFSIPGRPLSAVGEVGVAIRYLRAADPALAAVIDAHEPPVFQCPHRPFHSLVRSILYQQLAFKAAASVYSRFLALLGGESCVAPDAVLALTPHQLRQIGVSPRKASYLHDLARKYASGILSDAAIVNMDDRSLAAMLTMVKGIGSWSVHMFMIFSLARPDVLPSADLGVRKGVQMLYALEDVPRPSQMDKLCERWRPYRSVGAWYMWRLIESKVPQPAPAIPVGSLAFPSPDGQSMLQQQEQQQQQTVIQMIDPLQMLPGMG

SEQ ID NO: 1204 - protein, 289 aa, Oryza sativa subsp. indica
  misc_feature (1)..(289): Public GI ID no.125553355
  misc_feature (1)..(289): Bit score of 682.1 for HMM based on sequences of FIGURE 41.
  misc_feature (104)..(254): Pfam Name: HhH-GPD Pfam Description: HhH-GPD superfamily base excision DNA repair protein
  misc_feature (1)..(289): Functional Homolog Of Ceres SEEDLINE ID no. ME13125 at SEQ ID NO: 1194
MVKTRAAATPRPSGGGGAGAADITAGKISFRSRKIVKSTPAKGKSVATTTTAVLSPPPLSSPGELAAALSHLRTADPLLSEVIASTGAPAFISSPSRPAFHSLAHSILHQQLAPSAAAAIYARFLALIPAAADPDAAVVNPAAVLALSAADLRAIGVSARKAAYLHDLAGRFAAGELSESAVAAMDEAALLAELTKVKGVGEWTVHMFMIFSLHRPDVLPSGDLGVRKGVQELYGLPALPKPEEMAALCERWRPYRSVGAWYMWRLMESKGAAAKKAKSNAIATLPSSC

SEQ ID NO: 1205 - protein, 334 aa, Oryza sativa subsp. japonica
  misc_feature (1)..(334): Public GI ID no.5091600
  misc_feature (1)..(334): Bit score of 841.8 for HMM based on sequences of FIGURE 41.
  misc_feature (122)..(267): Pfam Name: HhH-GPD Pfam Description: HhH-GPD superfamily base excision DNA repair protein
  misc_feature (1)..(334): Functional Homolog Of Ceres SEEDLINE ID no. ME13125 at SEQ ID NO: 1194
MESPNPQQVNSMGDQSPLSPNLHPLSPSPSAAAAAAATPTPAAAAASSRSSRSKKPPHSSDPNQSKKPRLTLTVPGRPLSADGEVAAAIQHLRAADPALATVIDAHDPPAFQCPHRPFHSLVRSILYQQLAFKAAASVYSRFLSLLGGEHNVLPEAVLALTTQDLRQIGVSPRKASYLHDLARKYASGILSDAAVVNMDDRSLAAMLTMVKGIGAWSVHMFMIFSLNRPDVLPAADLGVRKGVQHLYGLDAVPRPSQMEKLCEQWRPYRSVGAWYMWRLIESKAPPPPPAIPVGPPALTEHGDELMLQQQQHQQQQQQSVIQMIDPLQMLPGMG

SEQ ID NO: 1206 - protein, 323 aa, Oryza sativa subsp. japonica
  misc_feature (1)..(323): Public GI ID no.115465635
  misc_feature (1)..(323): Bit score of 841.8 for HMM based on sequences of FIGURE 41.
  misc_feature (111)..(256): Pfam Name: HhH-GPD Pfam Description: HhH-GPD superfamily base excision DNA repair protein
  misc_feature (1)..(323): Functional Homolog Of Ceres SEEDLINE ID no. ME13125 at SEQ ID NO: 1194
MGDQSPLSPNLHPLSPSPSAAAAAAATPTPAAAAASSRSSRSKKPPHSSDPNQSKKPRLTLTVPGRPLSADGEVAAAIQHLRAADPALATVIDAHDPPAFQCPHRPFHSLVRSILYQQLAFKAAASVYSRFLSLLGGEHNVLPEAVLALTTQDLRQIGVSPRKASYLHDLARKYASGILSDAAVVNMDDRSLAAMLTMVKGIGAWSVHMFMIFSLNRPDVLPAADLGVRKGVQHLYGLDAVPRPSQMEKLCEQWRPYRSVGAWYMWRLIESKAPPPPPAIPVGPPALTEHGDELMLQQQQHQQQQQQSVIQMIDPLQMLPGMG

SEQ ID NO: 1207 - protein, 328 aa, Oryza sativa subsp. japonica
  misc_feature (1)..(328): Public GI ID no.125595334
  misc_feature (1)..(328): Bit score of 819.3 for HMM based on sequences of FIGURE 41.
  misc_feature (116)..(261): Pfam Name: HhH-GPD Pfam Description: HhH-GPD superfamily base excision DNA repair protein
  misc_feature (1)..(328): Functional Homolog Of Ceres SEEDLINE ID no. ME13125 at SEQ ID NO: 1194
MESIPWATNPPSPPTSTPSPRRPSAAAAAAATPTPAAAAASSRSSRSKKPPHSSDPNQSKKPRLTLTVPGRPLSADGEVAAAIQHLRAADPALATVIDAHDPPAFQCPHRPFHSLVRSILYQQLAFKAAASVYSRFLSLLGGEHNVLPEAVLALTTQDLRQIGVSPRKASYLHDLARKYASGILSDAAVVNMDDRSLAAMLTMVKGIGAWSVHMFMIFSLNRPDVLPAADLGVRKGVQHLYGLDAVPRPSQMEKLCEQWRPYRSVGAWYMWRLIESKAPPPPPAIPVGPPALTEHGDELMLQQQQHQQQQQQSVIQMIDPLQMLPGMG

SEQ ID NO: 1208 - protein, 290 aa, Oryza sativa subsp. japonica
  misc_feature (1)..(290): Public GI ID no.115465503
  misc_feature (1)..(290): Bit score of 679.7 for HMM based on sequences of FIGURE 41.
  misc_feature (105)..(255): Pfam Name: HhH-GPD Pfam Description: HhH-GPD superfamily base excision DNA repair protein
  misc_feature (1)..(290): Functional Homolog Of Ceres SEEDLINE ID no. ME13125 at SEQ ID NO: 1194
MVKTRAAATPRPSGGGGGAGAADITAGKISFRSRKIVKSTPAKGKSVATTTTAVLSPPPLSSPGELAAALSHLRTADPLLSEVISSTGAPAFISSPSRPAFHSLAHSILHQQLAPSAAAAIYARFLALIPAAADPDAAVVNPAAVLALSAADLRAIGVSARKAAYLHDLAGRFAAGELSESAVAAMDEAALLAELTKVKGVGEWTVHMFMIFSLHRPDVLPSGDLGVRKGVQELYGLPALPKPEEMAALCERWRPYRSVGAWYMWRLMESKGAAAKKAKSNAIATLPSSC

SEQ ID NO: 1209 - DNA, 1013 bp, Arabidopsis thaliana
  misc_feature (1)..(1013): Ceres SEEDLINE ID no.ME13149
  misc_feature (1)..(1013): Ceres CLONE ID no.2267
  misc_feature (1)..(1013): Inplanta Sequence
  misc_feature (1)..(1013): Encodes the peptide sequence at SEQ ID NO. 1210
ataagaaagaaagtcgtgaagatgagaggcgtaacaccaaactattaccattcttacactttcttcttcttcttcttcgttgtcttattagctctgtttcttcatgttttctcgataaacactttgtcatctacagaaactctaacaatctcaagcaaccgaaccattgtgtctcccggtaacatcttcgagctaggtttctgtagatgacaaagtgtttatcgagaaaagaagaagaaaagatctgagaggtggtcgaatgatccaagagaagaagaacaatctctcttagatcgtttgatctgatccaatcgaagaagaagaagaagatgggaatcttgttcacgcggatgttctcttccgtctttggtaacaaagaagctcgaatcctcgtcctcggtctcgacaatgctggaaaaaccacaatcctctatcggcttcagatgggggaagttgtctctacgattccgactattggatttaacgttgagactgtgcagtacaacaatatcaagtttcaggtctgggatttaggtggacaaacaagcatcaggccatactggcgatgctatttcccgaatacacaagcagtgatctatgttgttgactcgagtgatacagatagaatcggggtggcgaaagaggagtttcatgcaattttagaggaagatgaattgaaaggtgcggtggttctgatatttgcaaacaagcaggatcttcctggtgcactcgatgatgcggctgttacagaagccttggagttgcataagataaagagtcgtcaatgggcaatcttcaaaacttgtgctgtgaaaggcgagggacttttcgagggattggactggttgagtaatacattgaagtcgggaagtggctaaaatcatcgtcatacaccaatctgtcacatttctcaagagtgtaactttgatcatttttacttattggtttgtttagtatttttttttgtcttagttcttcatcttaaagagttaatatcaatgacatgttcactc

SEQ ID NO: 1210 - protein, 182 aa, Arabidopsis thaliana
  misc_feature (1)..(182): Ceres SEEDLINE ID no.ME13149
  misc_feature (1)..(182): Ceres CLONE ID no.2267
  misc_feature (1)..(182): Bit score of 444.3 for HMM based on sequences of FIGURE 42.
  misc_feature (5)..(177): Pfam Name: Arf Pfam Description: ADP-ribosylation factor family
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEDELKGAVVLIFANKQDLPGALDDAAVTEALELHKIKSRQWAIFKTCAVKGEGLFEGLDWLSNTLKSGSG

SEQ ID NO: 1211 - protein, 181 aa, Chlamydomonas reinhardtii
  misc_feature (1)..(181): Public GI ID no.1703374
  misc_feature (1)..(181): Bit score of 442.7 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLRFTKALSRLFGKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNLANKT

SEQ ID NO: 1212 - DNA, 1019 bp, Gossypium hirsutum
  misc_feature (1)..(1019): Ceres CLONE ID no.1846330
  misc_feature (1)..(1019): Encodes the peptide sequence at SEQ ID NO 1213
atttcgatcgaatcccaggaaataaattagaaaagcgccaaaagaaagagaagaatttacagtctttgcaattattcaccctgtctatttctcgagttttcaatttcaccgcactcgggatctcaactcttcttgcaagcaggccctctccttttgtacagggaggaaaaataaggggtgctgctttgcagatcggatccaaatttcatgcactgagagacctatttttctatatttaacgatatgggtatactgtttacaaaaatgttctctaatctgtttggaaacagggaggctcggatccttgttctcggccttgacaatgctggcaaaaccaccattctctatcgactccagatgggtgaagttgtctcgacaattccaacaattggatttaatgtcgaaacagtgcagtacaataacatcaaatttcaagtgtgggatttaggtggacagacaagtatcaggccatattggagatgctactttccaaatactcaagctataatctatgttgttgattcaagtgacacagataggctggtgatagctaaagaagaatttcatgcaatcttggaggaagaggagctgagaggagcagcagttcttatttttgcaaataagcaggatcttccaggtgcacttgatgacgctgcagttacagagtctttggagttacacaagataaaaaaccgacaatgggctatttttaaaacttcagcaataaaaggggaaggtctttttgaaggcttggattggttgagtaatacacttaaatccggaagcggctaactcttagcatgaagaatttgaagcattgctgctatgtgatccagatggagtggggaacgggcaatggtgttttgcttagtattatgatctgatagaaatttgagccatgagaaaagttgtgtcaattgaccttattaaatttctgcttttattattattttttgggggtaaacatctggtatacatgtaaaatttttgttaaacatttaaccatttccttttgtttt

SEQ ID NO: 1213 - protein, 182 aa, Gossypium hirsutum
  misc_feature (1)..(182): Ceres CLONE ID no.1846330
  misc_feature (1)..(182): Bit score of 441.3 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGILFTKMFSNLFGNREARILVLGLDNAGKTTILYRLQMGEVVSTIPTIGFNVETVQYNNIKFQVWDLGGQTSIRPYWRCYFPNTQAIIYVVDSSDTDRLVIAKEEFHAILEEEELRGAAVLIFANKQDLPGALDDAAVTESLELHKIKNRQWAIFKTSAIKGEGLFEGLDWLSNTLKSGSG

SEQ ID NO: 1214 - DNA, 996 bp, Gossypium hirsutum
  misc_feature (1)..(996): Ceres CLONE ID no.1919508
  misc_feature (1)..(996): Encodes the peptide sequence at SEQ ID NO 1215
aggagaaaatcagaaaagaaaaaaagccacccaaaaaatatatatactggcattgcatttcagacccgtttacttttgaattatcaattttacccttattgaaatctcaactcctcttgcaagcaggcactctccttttgtacaggggtgctgctttggagatctgatccaaaattcatgcactgatagagagtgatttttccattttttttacgagatgggtgttctgtttacaaaattgttctcttctctattgggaaacaaggaggctcggatccttgttctcggtcttgacaatgctggcaaaaccactattctttatcggcttcagatgggtgaagttgtctccacaattccaacaattggatttaatgtcgaaacagtacagtacaataacatcaaatttcaagtttgggatttaggcggacagacaagtatcagaccatattggagatgctactttccaaatactcaggccataatctatgttgttgattcaagtgacacagataggctggtgatagctaaagaagaatttcatgcaatcttggaggaggaggagctaagaggagcagtagttcttatttttgcaaataagcaggatcttcctggtgcacttgatactgctgctgtgacagaggctttggagttgcacaagttaaaaagccgccaatgggctatttttaaaacatcggcaattaaaggggaaggtctatttgaaggtttggactggttgagtaatacacttaaatccggaagtggctaatccttaggtctgaagaattagaagcttgcttctatgtgggtcaggctggagccaggaacgatgtttgcttcttataatctattagaaatttagagtcatcagcgaagatgtcaattttctgcattgatttttgtttttgatttttctttctcgagaaagcttctagtatacatgtaaaatattttgttaaagattaaccattttattcttaaattgtttctacattttgc

SEQ ID NO: 1215 - protein, 182 aa, Gossypium hirsutum
  misc_feature (1)..(182): Ceres CLONE ID no.1919508
  misc_feature (1)..(182): Bit score of 440.2 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGVLFTKLFSSLLGNKEARILVLGLDNAGKTTILYRLQMGEVVSTIPTIGFNVETVQYNNIKFQVWDLGGQTSIRPYWRCYFPNTQAIIYVVDSSDTDRLVIAKEEFHAILEEEELRGAVVLIFANKQDLPGALDTAAVTEALELHKLKSRQWAIFKTSAIKGEGLFEGLDWLSNTLKSGSG

SEQ ID NO: 1216 - protein, 181 aa, Populus tremuloides
  misc_feature (1)..(181): Public GI ID no.29124979
  misc_feature (1)..(181): Bit score of 443.1 for HMM based on sequences of FIGURE 42.
  misc_feature (1)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLLGRLFSEKEMRILMVGLDAAGKTTILYKLKLGEIVTTIPTIGFNVETVEYKNISFTVWDVGGQDKIRPLWRHYFQNTQGLIFVVDSNDRDRVGEAREELHRMLNEDELRDAVLLVFANKQDLPNAMNAAEITDKLGLHSLRQRHWYIQSTCATSGEGLYEGLDWLSNNIASKA

SEQ ID NO: 1217 - DNA, 549 bp, Populus balsamifera subsp. trichocarpa
  misc_feature (1)..(549): Ceres ANNOT ID no.1531725
  misc_feature (1)..(549): Encodes the peptide sequence at SEQ ID NO 1218
atgggaattttgttttccaaaatgttctcttcagtatttggcaacaaagaggctcggatccttgttcttggtcttgataatgctggcaaaactacaatcctctatcggcttcagatgggcgaagttgtatccaccattccaacaattggatttaatgtggaaacagttcagtacaacaatatcaaatttcaagtatgggatcttggtgggcagacaagcatcagaccatattggagatgttattttcccaacacacaggccattatttatgttgtcgattcaagtgacgttgataggctcgtgatagctaaagatgagtttcatgcaatcctggaggaggaagagttaagaggtgctattgttcttatttttgcgaacaagcaggatcttcctggtgcacttgatgatgcggcagtgactgaggctttggagttgcacaagatcaagaatcgacaatgggcaatttttaaaacgtctgccattaaaggagaaggtctttttgaaggtttggactggttgagtaatacactgaagtctgggggtggctaa

SEQ ID NO: 1218 - protein, 182 aa, Populus balsamifera subsp. trichocarpa
  misc_feature (1)..(182): Ceres ANNOT ID no.1531725
  misc_feature (1)..(182): Bit score of 440.8 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGILFSKMFSSVFGNKEARILVLGLDNAGKTTILYRLQMGEVVSTIPTIGFNVETVQYNNIKFQVWDLGGQTSIRPYWRCYFPNTQAIIYVVDSSDVDRLVIAKDEFHAILEEEELRGAIVLIFANKQDLPGALDDAAVTEALELHKIKNRQWAIFKTSAIKGEGLFEGLDWLSNTLKSGGG

SEQ ID NO: 1219 - DNA, 549 bp, Populus balsamifera subsp. trichocarpa
  misc_feature (1)..(549): Ceres ANNOT ID no.1482544
  misc_feature (1)..(549): Encodes the peptide sequence at SEQ ID NO 1220
atgggaatcttcttttctaaaatgttctcctcagtatttggcaacaaagaggctcggatccttgttcttggtcttgacaatgctggcaaaactacaattctctatcggcttcagatgggtgaagttgtatccactattccaacaattggatttaatgtcgaaacagttcagtacaacaatatcaaatttcaagtttgggatctcggtgggcagacaagcatcagaccatactggagatgctattttcccaacacacaagccattatttatgttgtcgattcaagtgatactgacaggctcgtgatagctaaagatgagtttcatgcaatcttagaggaggaagagttaagaggtgctgttgttcttatctatgcaaacaagcaggatcttcctggtgcacttgatgatgcggctgtgactgaggctttggagttgcacaagattaagaatcgacaatgggcgatttttaaaacttctgccattaaaggagaaggtctttttgaaggtttggactggttgagtaatacacttaagtctggaggtggctaa

SEQ ID NO: 1220 - protein, 182 aa, Populus balsamifera subsp. trichocarpa
  misc_feature (1)..(182): Ceres ANNOT ID no.1482544
  misc_feature (1)..(182): Bit score of 442.1 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGIFFSKMFSSVFGNKEARILVLGLDNAGKTTILYRLQMGEVVSTIPTIGFNVETVQYNNIKFQVWDLGGQTSIRPYWRCYFPNTQAIIYVVDSSDTDRLVIAKDEFHAILEEEELRGAVVLIYANKQDLPGALDDAAVTEALELHKIKNRQWAIFKTSAIKGEGLFEGLDWLSNTLKSGGG

SEQ ID NO: 1221 - DNA, 576 bp, Populus balsamifera subsp. trichocarpa
  misc_feature (1)..(576): Ceres ANNOT ID no.1478226
  misc_feature (1)..(576): Encodes the peptide sequence at SEQ ID NO 1222
atgggaattttgttttccaaaatgttctcttcagtatttggcaacaaagaggctcggatccttgttcttggtcttgataatgctggcaaaactacaatcctctatcggcttcagatgggcgaagttgtatccaccattccaacaattggatttaatgtggaaacagttcagtacaacaatatcaaatttcaagtatgggatcttggtgggcagacaagcatcagctcactggctgcttatgtttgcaacagaccatattggagatgttattttcccaacacacaggccattatttatgttgtcgattcaagtgacgttgataggctcgtgatagctaaagatgagtttcatgcaatcctggaggaggaagagttaagaggtgctattgttcttatttttgcgaacaagcaggatcttcctggtgcacttgatgatgcggcagtgactgaggctttggagttgcacaagatcaagaatcgacaatgggcaatttttaaaacgtctgccattaaaggagaaggtctttttgaaggtttggactggttgagtaatacactgaagtctgggggtggctaa

SEQ ID NO: 1222 - protein, 191 aa, Populus balsamifera subsp. trichocarpa
  misc_feature (1)..(191): Ceres ANNOT ID no.1478226
  misc_feature (1)..(191): Bit score of 423.7 for HMM based on sequences of FIGURE 42.
  misc_feature (5)..(186): Pfam Name: Arf Pfam Description: ADP-ribosylation factor family
  misc_feature (1)..(191): Functional Homolog Of Ceres SEEDLINE ID no. ME13149 at SEQ ID NO: 1210
MGILFSKMFSSVFGNKEARILVLGLDNAGKTTILYRLQMGEVVSTIPTIGFNVETVQYNNIKFQVWDLGGQTSISSLAAYVCNRPYWRCYFPNTQAIIYVVDSSDVDRLVIAKDEFHAILEEEELRGAIVLIFANKQDLPGALDDAAVTEALELHKIKNRQWAIFKTSAIKGEGLFEGLDWLSNTLKSGGG

SEQ ID NO: 1223 - DNA, 696 bp, Populus balsamifera subsp. trichocarpa
  misc_feature (1)..(696): Ceres ANNOT ID no.1531332
  misc_feature (1)..(696): Encodes the peptide sequence at SEQ ID NO 1224
atgggccttttgtttagtagaatgttctcttctttatttggtaatcaagaagctcgaatcctagtcctcggtctcgacaatgctggcaaaaccaccattctttatcggcttcaaatgggagaggtagtctccacgatcccaacaattgggttcaatgtggaaactgtacagtataacaacattaagttccaagtgtgggatttaggtggacaaacaagtatcaggccatattggaggtgttatttcccaaatactcaagctgtaatttatgtggtagattcaagtgacacggaaagaattggaatagccaaagaagaatttcattcaattttggaggaggaagagttgaaaggtgcagttgtcctcatttttgcaaacaagcaggatctccctggtgcacttgatgatgctgctgtgactgaggcattggagttgcacaaaataaaaagtcgccaatgggccatcttcaaagcttgcgccacaaagggtgaaggtctctttgagggtttggactgtgattggtttggaaatgaaacaaaagattggtttggcctaatggggtcgcaagcacacttttacatgctttcacacaatatccataacttggttaccgcgctctatagtgccaatgtatatgcgattgctttctctatggtgagggtaggttggccaagtcttaaatccaacaagttgtag

SEQ ID NO: 1224 - protein, 231 aa, Populus balsamifera subsp. trichocarpa
  misc_feature (1)..(231): Ceres ANNOT ID no.1531332
  misc_feature (1)..(231): Bit score of 409.7 for HMM based on sequences of FIGURE 42.
  misc_feature (5)..(171): Pfam Name: Arf Pfam Description: ADP-ribosylation factor family
  misc_feature (1)..(231): Functional Homolog Of Ceres SEEDLINE ID no. ME13149 at SEQ ID NO: 1210
MGLLFSRMFSSLFGNQEARILVLGLDNAGKTTILYRLQMGEVVSTIPTIGFNVETVQYNNIKFQVWDLGGQTSIRPYWRCYFPNTQAVIYVVDSSDTERIGIAKEEFHSILEEEELKGAVVLIFANKQDLPGALDDAAVTEALELHKIKSRQWAIFKACATKGEGLFEGLDCDWFGNETKDWFGLMGSQAHFYMLSHNIHNLVTALYSANVYAIAFSMVRVGWPSLKSNKL

SEQ ID NO: 1225 - DNA, 519 bp, Populus balsamifera subsp. trichocarpa
  misc_feature (1)..(519): Ceres ANNOT ID no.1508945
  misc_feature (1)..(519): Encodes the peptide sequence at SEQ ID NO 1226
atgggtcttttgtttagtagaatgttctcttctttatttggtaataaagaagctcgaatacttgtcctcggcctcgacaatgctggcaaaaccaccattctctatcggcttcaaatgggagaggtagtctccacgatcccaacgattggattcaatgtagaaactgtacagtacaacaacattaagtttcaagtctgggatttaggtggacaaacaagtatcaggccatattggaggtgttatttcccgaatactcaagctgtaatttatgtggtagattcaagtgacacggagagaattggaatagccaaagaagaatttcattcaattttggaggaggaagaattgaaaggtgcagttgtcctcatttttgcaaacaagcaggatctccctggtgcacttgatgctgctgctgtgactgaggcattggagttgcacaaaataaaaagtcgccaatgggccatcttcaaagcttgtgctactaagggtgacggcctctttgagggcttggactggtaa

SEQ ID NO: 1226 - protein, 172 aa, Populus balsamifera subsp. trichocarpa
  misc_feature (1)..(172): Ceres ANNOT ID no.1508945
  misc_feature (1)..(172): Bit score of 402.3 for HMM based on sequences of FIGURE 42.
  misc_feature (5)..(172): Pfam Name: Arf Pfam Description: ADP-ribosylation factor family
  misc_feature (1)..(172): Functional Homolog Of Ceres SEEDLINE ID no. ME13149 at SEQ ID NO: 1210
MGLLFSRMFSSLFGNKEARILVLGLDNAGKTTILYRLQMGEVVSTIPTIGFNVETVQYNNIKFQVWDLGGQTSIRPYWRCYFPNTQAVIYVVDSSDTERIGIAKEEFHSILEEEELKGAVVLIFANKQDLPGALDAAAVTEALELHKIKSRQWAIFKACATKGDGLFEGLDW

SEQ ID NO: 1227 - DNA, 549 bp, Populus balsamifera subsp. trichocarpa
  misc_feature (1)..(549): Ceres ANNOT ID no.1455743
  misc_feature (1)..(549): Encodes the peptide sequence at SEQ ID NO 1228
atgggtcttttgtttagtagaatgttctcttctttatttggtaataaagaagctcgaatacttgtcctcggcctcgacaatgctggcaaaaccaccattctctatcggcttcaaatgggagaggtagtctccacgatcccaacgattggattcaatgtagaaactgtacagtacaacaacattaagtttcaagtctgggatttaggtggacaaacaagtatcaggccatattggaggtgttatttcccgaatactcaagctgtaatttatgtggtagattcaagtgacacggagagaattggaatagccaaagaagaatttcattcaattttggagtgtgacagggggactgcattttatgggattgaggaagaattgaaaggtgcagttgtcctcatttttgcaaacaagcaggatctccctggtgcacttgatgctgctgctgtgactgaggcattggagttgcacaaaataaaaagtcgccaatgggccatcttcaaagcttgtgctactaagggtgacggcctctttgagggcttggactggtaa

SEQ ID NO: 1228 - protein, 182 aa, Populus balsamifera subsp. trichocarpa
  misc_feature (1)..(182): Ceres ANNOT ID no.1455743
  misc_feature (1)..(182): Bit score of 384.1 for HMM based on sequences of FIGURE 42.
  misc_feature (5)..(182): Pfam Name: Arf Pfam Description: ADP-ribosylation factor family
  misc_feature (1)..(182): Functional Homolog Of Ceres SEEDLINE ID no. ME13149 at SEQ ID NO: 1210
MGLLFSRMFSSLFGNKEARILVLGLDNAGKTTILYRLQMGEVVSTIPTIGFNVETVQYNNIKFQVWDLGGQTSIRPYWRCYFPNTQAVIYVVDSSDTERIGIAKEEFHSILECDRGTAFYGIEEELKGAVVLIFANKQDLPGALDAAAVTEALELHKIKSRQWAIFKACATKGDGLFEGLDW

SEQ ID NO: 1229 - protein, 193 aa, Brassica rapa
  misc_feature (1)..(193): Public GI ID no.3334321
  misc_feature (1)..(193): Bit score of 428.7 for HMM based on sequences of FIGURE 42.
  misc_feature (6)..(192): Pfam Name: Arf Pfam Description: ADP-ribosylation factor family
  misc_feature (1)..(193): Functional Homolog Of Ceres SEEDLINE ID no. ME13149 at SEQ ID NO: 1210
MFVIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLSNFTTGKGKVDLVGSNVRPLEVFMCSIVRKMGYGEGFKWLSQYIK

SEQ ID NO: 1230 - protein, 195 aa, Brassica rapa
  misc_feature (1)..(195): Public GI ID no.3334322
  misc_feature (1)..(195): Bit score of 400.7 for HMM based on sequences of FIGURE 42.
  misc_feature (6)..(194): Pfam Name: Arf Pfam Description: ADP-ribosylation factor family
  misc_feature (1)..(195): Functional Homolog Of Ceres SEEDLINE ID no. ME13149 at SEQ ID NO: 1210
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFSESKKELDALLSDDALATVPFLILGNKIDNPYAASEDELRYHLGLTNFTTGKGKVTTAGGDSGVRPLEVFMCSIVRKMGYGEGFKWLSQYIN

SEQ ID NO: 1231 - DNA, 1424 bp, Glycine max
  misc_feature (1)..(1424): Ceres CLONE ID no.571410
  misc_feature (1)..(1424): Encodes the peptide sequence at SEQ ID NO 1232
ataacatatagggagcgagatcccaaaaccaaaaggtggagggcgtgggcgagggatatctatcttcattttcgtcgtcgttcatttttttattttttttttttctgttttccattcgcttcttctctcagaaaagctcgccaatcgatcttgctctcttctacgcttttcgaattccttccattccattatggacgcagattagattcacgttcacattcacttctcttcgtttgcttcaaccactctgctctgctctgctctactctgagatccgatcgcattttcattcagaaaggaaactcgtgtgactgatttatgcgctaattgcaattgcactgcgagcgtccctgtgccgaatcggaagatgggattagtgtttaccaaattgttttcctctcttttcggtaacaaggaagctcgaatcctcgttctcggcctcgacaatgccggcaaaaccactattctctatcggcttcagatgggcgaagttgtctccaccattccaacaattgggtttaatgtcgaaacagtgcagtataacaacattaaatttcaagtctgggatttaggtgggcaaacaagtatcaggccatattggaggtgttactttccaaatactcaagcaataatctatgttgttgattcaagtgacgttgataggcttgtgatagctaaggaggagttccatgcaattttggaggaggaagaactaaaaggtgcagttgttctcattttcgcaaacaagcaggaccttcctggtgcacttgatgatgctgcagtgaccgaggctctagagttacacaagatcaaaaatcgccaatgggctatttttaaaacttctgccataaaaggagaaggactttttgagggccttgactggttgagcaatacactcaaatctggaggtggctaaaggtgtcagtttcaacgaattaaatggacgattgaattcagaaggaaggtggaaatgcgtattttggtatctctttcactgtgaatgatgctataataatatgattattaaagctcgtacacatgttttattccgttttgtgtttacagttaaaaaggtatgaacaatggtcattggttgtctttttcttggttcctttttatatttttaagttagtctcttggctcctctaatagcagtagctgaatggtttctaagaaaaaatttctagtctaatcttgtgtaattgagatacatgggtttactcttaatgtgcttgacgtatcgatgattacatgaggtagttttgtcaatgacataacggctgatgagggcaaaccttcaaagctctttggtgacatgatgaggactgagcagccattgttgttgacaatgtaaatcaaggtagcaaatttttcattaatgtaaaatgtatcgaagacaatatatgatattctttttggatttg

SEQ ID NO: 1232 - protein, 182 aa, Glycine max
  misc_feature (1)..(182): Ceres CLONE ID no.571410
  misc_feature (1)..(182): Bit score of 445.2 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGLVFTKLFSSLFGNKEARILVLGLDNAGKTTILYRLQMGEVVSTIPTIGFNVETVQYNNIKFQVWDLGGQTSIRPYWRCYFPNTQAIIYVVDSSDVDRLVIAKEEFHAILEEEELKGAVVLIFANKQDLPGALDDAAVTEALELHKIKNRQWAIFKTSAIKGEGLFEGLDWLSNTLKSGGG

SEQ ID NO: 1233 - protein, 181 aa, Medicago sativa
  misc_feature (1)..(181): Public GI ID no.39653273
  misc_feature (1)..(181): Bit score of 452.1 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 1234 - protein, 182 aa, Medicago truncatula
  misc_feature (1)..(182): Public GI ID no.92875403
  misc_feature (1)..(182): Bit score of 446.1 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGLVFTRLFSSVFGNKEARILVLGLDNAGKTTILYRLQMGEVVSTIPTIGFNVETVQYNNIKFQVWDLGGQTSIRPYWRCYFPNTQAIIYVVDSSDTDRLVIAREEFHAILEEEELKGAVVLIFANKQDLPGALDDAAVTESLELHKIKNRQWAIFKTSAIKGEGLFEGLDWLSNTLKSGGG

SEQ ID NO: 1235 - protein, 181 aa, Vigna unguiculata
  misc_feature (1)..(181): Public GI ID no.11131026
  misc_feature (1)..(181): Bit score of 450.6 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKA

SEQ ID NO: 1236 - protein, 181 aa, Daucus carota
  misc_feature (1)..(181): Public GI ID no.77812440
  misc_feature (1)..(181): Bit score of 452.0 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 1237 - protein, 181 aa, Daucus carota
  misc_feature (1)..(181): Public GI ID no.1703375
  misc_feature (1)..(181): Bit score of 447.9 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEIIDKLGLHSLRQRHWYIQSTCATSGEGLYEGLDWLSNNIASKS

SEQ ID NO: 1238 - protein, 181 aa, Panax ginseng
  misc_feature (1)..(181): Public GI ID no.89475524
  misc_feature (1)..(181): Bit score of 448.7 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNGDELRDAVLLVFANKQDLPNAMNAAEITDKLGLHSLRQRHWYIQSTCATSGEGLYEGLDWLSNNIANKA

SEQ ID NO: 1239 - protein, 181 aa, Catharanthus roseus
  misc_feature (1)..(181): Public GI ID no.3182919
  misc_feature (1)..(181): Bit score of 443.2 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYQLKLGEIVTTIPTIGFNVETVEYQYISFTVWDVGGQDKIRPLWRHYFQNTQGLIFVVDSNDRDRVVEARDELHRMLNEDELRDAVLLVFANKQDLPNAMNAAEITDKHGLHSLRQRHWYIQSTCATSGEGLYEGLDWLSNNIANKA

SEQ ID NO: 1240 - protein, 181 aa, Capsicum annuum
  misc_feature (1)..(181): Public GI ID no.7643794
  misc_feature (1)..(181): Bit score of 451.1 for HMM based on sequences of FIGURE 42.
  misc_feature (1)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 1241 - protein, 193 aa, Solanum lycopersicum
  misc_feature (1)..(193): Public GI ID no.1710851
  misc_feature (1)..(193): Bit score of 430.2 for HMM based on sequences of FIGURE 42.
  misc_feature (6)..(192): Pfam Name: Arf Pfam Description: ADP-ribosylation factor family
  misc_feature (1)..(193): Functional Homolog Of Ceres SEEDLINE ID no. ME13149 at SEQ ID NO: 1210
MFLVDWFYGVLASLGLWQKDAKILFLGLDNAGKTTLLHMLKDERLVQHQPTQYPTSEELSIGNIKFKAFDLGGHQIARRVWRDYYAKVDAVVYLVDANDRERFPEAKKELDGLLSDESLTNVPFLILGNKIDIPYAASEDELRYHLGLTGVTTGKGNINLAGTNVRPIEVFMCSIVRKMGYGEGFKWMSQYIK

SEQ ID NO: 1242 - protein, 181 aa, Nicotiana tabacum
  misc_feature (1)..(181): Public GI ID no.115501471
  misc_feature (1)..(181): Bit score of 449.5 for HMM based on sequences of FIGURE 42.
  misc_feature (1)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISNKA

SEQ ID NO: 1243 - protein, 181 aa, Solanum tuberosum
  misc_feature (1)..(181): Public GI ID no.77999251
  misc_feature (1)..(181): Bit score of 451.2 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 1244 - protein, 181 aa, Solanum tuberosum
  misc_feature (1)..(181): Public GI ID no.76160966
  misc_feature (1)..(181): Bit score of 449.0 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSACATSGEGLYEGLDWLSNNIANKA

SEQ ID NO: 1245 - protein, 181 aa, Solanum tuberosum
  misc_feature (1)..(181): Public GI ID no.76160984
  misc_feature (1)..(181): Bit score of 450.8 for HMM based on sequences of FIGURE 42.
  misc_feature (1)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 1246 - protein, 197 aa, Solanum tuberosum
  misc_feature (1)..(197): Public GI ID no.1703376
  misc_feature (1)..(197): Bit score of 430.7 for HMM based on sequences of FIGURE 42.
  misc_feature (5)..(177): Pfam Name: Arf Pfam Description: ADP-ribosylation factor family
  misc_feature (1)..(197): Functional Homolog Of Ceres SEEDLINE ID no. ME13149 at SEQ ID NO: 1210
MGLTISKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVNEAREELMRMLAEDELRDAVLLVFANKQDLPNAMNAAEITDKLGLHSLRQRHWYIQSTCATSGEGLYEGLDWLSNQIRNQKANCNGTMLLWLLYPEK

SEQ ID NO: 1247 - protein, 180 aa, Solanum tuberosum
  misc_feature (1)..(180): Public GI ID no.82621154
  misc_feature (1)..(180): Bit score of 390.7 for HMM based on sequences of FIGURE 42.
  misc_feature (5)..(180): Pfam Name: Arf Pfam Description: ADP-ribosylation factor family
  misc_feature (1)..(180): Functional Homolog Of Ceres SEEDLINE ID no. ME13149 at SEQ ID NO: 1210
MGLCFTKLIICLFAKKEMRILMIGLDDAGKTTILYKLKLGEIVTAIRTSGFNVETVEYKNIIFTVWDVGGQDRIRPLWRHYFQNTQGLIFVVDSNDRDRVDEARDELHRMLYEDELREAVLLVFANKQDLPNAMNAAEITDKLGLHSLHSLQQRHWHIQSTCATSGEGLYEGLDWLSNKA

SEQ ID NO: 1248 - protein, 179 aa, Solanum tuberosum
  misc_feature (1)..(179): Public GI ID no.82621126
  misc_feature (1)..(179): Bit score of 378.4 for HMM based on sequences of FIGURE 42.
  misc_feature (1)..(160): Pfam Name: Arf Pfam Description: ADP-ribosylation factor family
  misc_feature (1)..(179): Functional Homolog Of Ceres SEEDLINE ID no. ME13149 at SEQ ID NO: 1210
MRILMVGLDAAGKTTILYKLKLGEIVTTIPTIGFNVETVEYKNISFTVWDVGGQDKIRPLWRHYFQNTQGLIFVVDSNDIDRVVEARDELHRMLNEDELREAVLLVFANKQDLPNAMNAAEITDKLGLHSLRQRHWYIQSTCATSGEGLYEGLDWLSNNIRQQANANGTMLLVLLYPEK

SEQ ID NO: 1249 - protein, 193 aa, Avena fatua
  misc_feature (1)..(193): Public GI ID no.3450893
  misc_feature (1)..(193): Bit score of 428.1 for HMM based on sequences of FIGURE 42.
  misc_feature (6)..(192): Pfam Name: Arf Pfam Description: ADP-ribosylation factor family
  misc_feature (1)..(193): Functional Homolog Of Ceres SEEDLINE ID no. ME13149 at SEQ ID NO: 1210
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHLGLSSFTTGKGKVSLCDSNVRPLEVFMCSVVRKMGYGDGFKWVSQYIN

SEQ ID NO: 1250 - DNA, 1054 bp, Triticum aestivum
  misc_feature (1)..(1054): Ceres CLONE ID no.704589
  misc_feature (1)..(1054): Encodes the peptide sequence at SEQ ID NO 1251
tgacattttctcctcccgacctccgtaccaaacacagccaaccgctccaaatcgccgaagctactctctcctatcggcgagaagaagtgggggagatcttcgtcttcagcactcgcgcgcgcaagctcattcgctccagatcttcccttaccatcgtagatctcacgaccccaagccgccacgcccccaacgaaaccctagctcgcgcccctccgccgcgtaggggcgccgccatgggcatcgtgttcacgcggctcttctcgtcggtattcggaaaccgcgaggcccgcatcctcgtcctcggcctcgacaatgccggcaagactactatcctctatcggctgcagatgggggaggtcgtttccacgatcccaacgatcgggttcaacgtggagacggtgcagtacaataacatcaagttccaagtttgggatctcggtggtcaaacaagcatcaggccatactggagatgctactttccaaacactcaggctatcatatatgttgttgattcaagtgatactgataggctggtaactgcaaaagaagaatttcattccatccttgaggaggatgagctgaaaggtgcggttgtccttgtatatgcgaataaacaggaccttccaggtgcacttgatgatgctgccataactgaatcattagaacttcacaagattaagagccgccaatgggcaattttcaaaacatctgctataaaaggggaggggctttttgaaggcttgaactggctcagtaatgcactcaagtccggaggcagctaatgtaggaggcccagcctccattccgtgaatcattgcttgatggtaaggaacagtgacgatgacagccttctcgctagtctgcgtgaaaatcagaatctctttatttcaactccggaagttatacacaatcagttatctgtagagtgcttgttgaagtttccagatacaacactaggtgtaccatgtcgagagcaagaatatatttgtagaaaataccgagcaaacgattacggtttgaaatatgtggcttacaccgcgtaaaatttcaccac

SEQ ID NO: 1251 - protein, 182 aa, Triticum aestivum
  misc_feature (1)..(182): Ceres CLONE ID no.704589
  misc_feature (1)..(182): Bit score of 440.4 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGIVFTRLFSSVFGNREARILVLGLDNAGKTTILYRLQMGEVVSTIPTIGFNVETVQYNNIKFQVWDLGGQTSIRPYWRCYFPNTQAIIYVVDSSDTDRLVTAKEEFHSILEEDELKGAVVLVYANKQDLPGALDDAAITESLELHKIKSRQWAIFKTSAIKGEGLFEGLNWLSNALKSGGS

SEQ ID NO: 1252 - DNA, 817 bp, Zea mays
  misc_feature (1)..(817): Ceres CLONE ID no.1384151
  misc_feature (1)..(817): Encodes the peptide sequence at SEQ ID NO 1253
aagagacgaatctctctcttagatcgtatgatctgatccgaagagaagctcaggaagaagatgggaatcgtattcacgaagctgttttcctccgtgtttggaaacaaagaagctcgtatcctcgtcctcggcctcgacaatgccggaaaaaccaccatcctctatcggcttcagatgggagaggtcgtctccacgatcccgactattggatttaacgtggagactgtgcagtacaacaatatcaagtttcaggtctgggatttaggtggacaaacgagtatcaggccatattggagatgctattttccaaatacacaggcagtgatttacgttgttgattcgagtgatactgatagaattggagtggcgaaagaggagttccatgcaattttggaggaagaggaattgaaaggtgcaatggttcttatatttgcaaacaagcaggatctgccaggcgcacttgacgatgcggctgtgacagaggccttggagttgcacaagataaagagtcgtcaatgggcaatcttcaaaacttgtgctgtgaaaggcgaaggacttttcgaaggcctagactggttgagtaataccctcaaatcagggacgggttaacctcatcactcaccacaaagcagcagcgtgcgtgtatcacatcttttctactgttagctttgcattcttcgacaaagagttgatagcgtctcagttattaatctcttatgtttttgtccgaagaagataagacttgtggatttgttgttgtgacatttaagacaggatattgatttttaacatgaaatataacatattaagaatcacc

SEQ ID NO: 1253 - protein, 182 aa, Zea mays
  misc_feature (1)..(182): Ceres CLONE ID no.1384151
  misc_feature (1)..(182): Bit score of 444.4 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGIVFTKLFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEEELKGAMVLIFANKQDLPGALDDAAVTEALELHKIKSRQWAIFKTCAVKGEGLFEGLDWLSNTLKSGTG

SEQ ID NO: 1254 - DNA, 1101 bp, Zea mays
  misc_feature (1)..(1101): Ceres CLONE ID no.230679
  misc_feature (1)..(1101): Encodes the peptide sequence at SEQ ID NO 1255
aatcgcccttccggttttctccgcagcccccgccccggtcgcggagccgtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggtgcagtacaacaacatcaagttccaagtatgggatcttggtggtcaaacaagcatcaggccatactggcggtgctactttccaaacactcaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaagggagaggggctcttcgaaggtttggactggctcagtaacacgctcaaatctggaagcagctaaggagcctccgcctcgtcatgaatcatttgctggaggctaaagaatagccgatgcttgcaagtcagcgcgcaaatcccattctctttgttttaactccagaagtttctacaccgccatcaattatctgtaaagtgcgtgttaaattttttggatactacattagatgtaccctcaggttgagatcaagaataggtctgtggaaaatgacgagcaaactgtgccactgtctttacccgtaaatctcatggatcatgacaagtttttttttgtaccccaatatgattaaacttactccacatttctatgttttcgtatcagtgatcattacagaaactgctctt

SEQ ID NO: 1255 - protein, 182 aa, Zea mays
  misc_feature (1)..(182): Ceres CLONE ID no.230679
  misc_feature (1)..(182): Bit score of 444.7 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGIVFTRLFSSVFGNREARILVLGLDNAGKTTILYRLQMGEVVSTIPTIGFNVETVQYNNIKFQVWDLGGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDWLSNTLKSGSS

SEQ ID NO: 1256 - DNA, 423 bp, Zea mays
  misc_feature (1)..(423): Ceres CLONE ID no.997027
  misc_feature (1)..(423): Encodes the peptide sequence at SEQ ID NO 1257
aaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctgtggtcaaacaagcatcaggccatactggcggtgctactttccaaacacccaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaat

SEQ ID NO: 1257 - protein, 148 aa, Zea mays
  misc_feature (1)..(148): Ceres CLONE ID no.997027
  misc_feature (1)..(148): Bit score of 289.0 for HMM based on sequences of FIGURE 42.
  misc_feature (5)..(143): Pfam Name: Arf Pfam Description: ADP-ribosylation factor family
  misc_feature (1)..(148): Functional Homolog Of Ceres SEEDLINE ID no. ME13149 at SEQ ID NO: 1210
MGIVFTRLFSSVFGNREARILVLGLDNAGKTTILCGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDWLSNTLKSGSS

SEQ ID NO: 1258 - DNA, 796 bp, Musa acuminata
  misc_feature (1)..(796): Ceres CLONE ID no.1713894
  misc_feature (1)..(796): Encodes the peptide sequence at SEQ ID NO 1259
atcgagagaacgtgcaatcgaggagtcgtctcaccgtcgaatcgatctctccccgtggtttccgggagcgtaggaacgatggggctcaccttcacgaagctgttcagccggctctttgcgaagaaggagatgaggatcttgatggtgggtcttgacgctgctggtaagacgaccatcctctacaagctcaagctcggagaaattgtcaccaccattccaaccatcgggttcaatgtggagactgtggagtacaaaaatattagctttaccgtttgggatgttggtggtcaggacaagatcagacctctctggaggcattacttccagaacacacagggccttatttttgtggttgacagcaacgacagagatcgaattgttgaagcaaaggatgagcttcacagaatgcttaacgaggatgagttgcgggacgctgtattgcttgtttttgcaaacaaacaagatcttccaaatgcaatgaatgctgctgaaatcaccgacaagcttggtctgcattccttgcgccagcgacactggtacatccagagcacttgcgctacctctggtgagggtttgtatgaggggcttgattggctctcgaacaacattgccagcaaggcttaaatggccaggaagtgcttagtttaaatattcttacttcgtgccagtttgattgcttttgggacatgagaggtaacagaattttagtgtaatttatatggattgtattacctcagctttttgcattttaagacatcagatttcatgtattcagaaattagatgtgttagctgtc

SEQ ID NO: 1259 - protein, 181 aa, Musa acuminata
  misc_feature (1)..(181): Ceres CLONE ID no.1713894
  misc_feature (1)..(181): Bit score of 451.8 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEAKDELHRMLNEDELRDAVLLVFANKQDLPNAMNAAEITDKLGLHSLRQRHWYIQSTCATSGEGLYEGLDWLSNNIASKA

SEQ ID NO: 1260 - DNA, 893 bp, Musa acuminata
  misc_feature (1)..(893): Ceres CLONE ID no.1727351
  misc_feature (1)..(893): Encodes the peptide sequence at SEQ ID NO 1261
accgtcgccgagttcggagtacgagagaggcgaagcgggaggagacacccgccccaccgaatcggtctctctctctctgcctcccgtgtagatctccagcttaggaacaatggggctcaccttcacgaagttgttcagccgcctcttcgctaagaaggagatgaggatcttgatggtgggtcttgacgctgctggtaagacgaccatcctctacaagctcaagctcggagaaatcgtcaccacgattcccactatcgggttcaatgtggagactgtggagtacaaaaacattagcttcaccgtttgggatgttggtggtcaggacaagatcagacccctttggaggcattacttccagaacacccagggccttatttttgttgttgacagcaacgacagagatcgtgttgttgaggcaagggatgaactccacaggatgcttaatgaggacgaattgcgggatgctgttttacttgtttttgcaaacaaacaagatcttccaaatgcaatgaatgctgctgagatcaccgacaagcttggtctgcattccctgcgcctacgacactggtacatccagagcgcctgcgctacatctggtgagggtttgtacgaggggcttgattggttatccagcaacattgccagcaaagcttaaattggcaggaggtgcctcttgtcgagatattctccctttgtatcagtgctggaacatgagaaccatcagaactttcagagtaaattatgtgtattatttcacatcagcttcttgaattttaataccgtagattttgcacgtttgaaaatatagatttcaaggctacattgtgttttctaaatccactttttatcgctcattaatatcatctcaatagttactaagcctgcttttctct

SEQ ID NO: 1261 - protein, 181 aa, Musa acuminata
  misc_feature (1)..(181): Ceres CLONE ID no.1727351
  misc_feature (1)..(181): Bit score of 443.9 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRLRHWYIQSACATSGEGLYEGLDWLSSNIASKA

SEQ ID NO: 1262 - DNA, 726 bp, Musa acuminata
  misc_feature (1)..(726): Ceres CLONE ID no.1726988
  misc_feature (1)..(726): Encodes the peptide sequence at SEQ ID NO 1263
ccctctccgtgcggtttcgaaggaagggaagaagcggaggcctctctcgccccatccctctcgatctctccacctctttcgcgatctccagctgaaggaaagatggggttgtcgttcgcaaaactctttagccgcctgtttgcgaagaaggagatgaggatcctgatggtcgggcttgatgccgctggtaagaccacaattctttacaagctgaagcttggagagatcgtcaccaccattccaaccattgaattcaatgtggagaccgttgagtacaaaaacattagcttcactgtatgggatgttggtggtcaggacaagatcagacctctgtggaggcattacttccagaacacacagggccttattttcgttgttgacagcaatgaccgtgatcgtgttgttgaggcaagagatgaactccacaggatgctaaatgaggatgagttacgggatgctgtcttacttgtgtttgctaacaaacaagaccttccaaatgcaatgaatgctgctaaaatcactgataagcttggtctgcattccctgcgtcagcgacactggtacatacagagcacttgtgccacatctggtgagggcttatatgaggggctcgactggctttctagcaacattgccagcaagtaaccaaggttgcttggaggggcgcatgacagcatcagtattatggaattttccacattgttgcacgcttttgggacacatcgg

SEQ ID NO: 1263 - protein, 180 aa, Musa acuminata
  misc_feature (1)..(180): Ceres CLONE ID no.1726988
  misc_feature (1)..(180): Bit score of 437.7 for HMM based on sequences of FIGURE 42.
  misc_feature (1)..(177): Pfam Name: Arf Pfam Description: ADP-ribosylation factor family
  misc_feature (1)..(180): Functional Homolog Of Ceres SEEDLINE ID no. ME13149 at SEQ ID NO: 1210
MGLSFAKLFSRLFAKKEMRILMVGLDAAGKTTILYKLKLGEIVTTIPTIEFNVETVEYKNISFTVWDVGGQDKIRPLWRHYFQNTQGLIFVVDSNDRDRVVEARDELHRMLNEDELRDAVLLVFANKQDLPNAMNAAKITDKLGLHSLRQRHWYIQSTCATSGEGLYEGLDWLSSNIASK

SEQ ID NO: 1264 - protein, 244 aa, Oryza sativa subsp. indica
  misc_feature (1)..(244): Public GI ID no.125560752
  misc_feature (1)..(244): Bit score of 404.9 for HMM based on sequences of FIGURE 42.
  misc_feature (5)..(190): Pfam Name: Arf Pfam Description: ADP-ribosylation factor family
  misc_feature (1)..(244): Functional Homolog Of Ceres SEEDLINE ID no. ME13149 at SEQ ID NO: 1210
MGIVFTRLFSSVFGNREARILVLGLDNAGKTTILYRLQMGEVVSTIPSGFPAPDSLIFFLPFAIGFNVETVQYNNIKFQVWDLGGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDCSVLQHIILQFLPDECIWEYLMELTYKSLMYLHIEIKNRFVENDEQTVRTLGHWWLYP

SEQ ID NO: 1265 - protein, 182 aa, Oryza sativa subsp. japonica
  misc_feature (1)..(182): Public GI ID no.115475543
  misc_feature (1)..(182): Bit score of 445.2 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGIVFTRLFSSVFGNREARILVLGLDNAGKTTILYRLQMGEVVSTIPTIGFNVETVQYNNIKFQVWDLGGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDWLSNALKSKSS

SEQ ID NO: 1266 - protein, 216 aa, Oryza sativa subsp. japonica
  misc_feature (1)..(216): Public GI ID no.125602725
  misc_feature (1)..(216): Bit score of 356.8 for HMM based on sequences of FIGURE 42.
  misc_feature (5)..(162): Pfam Name: Arf Pfam Description: ADP-ribosylation factor family
  misc_feature (1)..(216): Functional Homolog Of Ceres SEEDLINE ID no. ME13149 at SEQ ID NO: 1210
MGIVFTRLFSSVFGNREARILVLGLDNAGKTTILSIGFNVETVQYNNIKFQVWDLGGQTSIRPYWRCYFPNTQAIIYVVDSSDTDRLVTAKEEFHAILEEDELKGAVVLVYANKQDLPGALDDAAITESLELHKIKSRQWAIFKTSAIKGEGLFEGLDCSVLQHIILQFLPDECIWEYLMELTYKSLMYLHIEIKNRFVENDEQTVRTLGHWWLYP

SEQ ID NO: 1267 - protein, 182 aa, Brassica rapa subsp. pekinensis
  misc_feature (1)..(182): Public GI ID no.3182922
  misc_feature (1)..(182): Bit score of 443.7 for HMM based on sequences of FIGURE 42.
  misc_feature (5)..(177): Pfam Name: Arf Pfam Description: ADP-ribosylation factor family
  misc_feature (1)..(182): Functional Homolog Of Ceres SEEDLINE ID no. ME13149 at SEQ ID NO: 1210
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEEELKGAVVLIFANKQDLPGALDDAAVTEALELHKIKSRQWAIFKTCAVKGEGLFEGLDWLSNTLKSGSG

SEQ ID NO: 1268 - protein, 181 aa, Ostreococcus lucimarinus CCE9901
  misc_feature (1)..(181): Public GI ID no.145353078
  misc_feature (1)..(181): Bit score of 439.3 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGITFAKLFQRLFSKKEMRILMVGLDAAGKTTILYKLKLGEIVTTIPTIGFNVETVEYKNISFTVWDVGGQDKIRPLWRHYFQNTQGLIFVVDSNDRDRVSEARDELHRMLNEDELRDAVLLVFANKQDLPNAMSAAEITDKLGLHSLRQRHWFIQSTCATSGEGLYEGLDWLSSNISQRA

SEQ ID NO: 1269 - protein, 181 aa, Salix bakko
  misc_feature (1)..(181): Public GI ID no.11131023
  misc_feature (1)..(181): Bit score of 444.4 for HMM based on sequences of FIGURE 42.
  misc_feature (1)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 1270 - protein, 181 aa, Hyacinthus orientalis
  misc_feature (1)..(181): Public GI ID no.47026845
  misc_feature (1)..(181): Bit score of 452.2 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 1271 - protein, 181 aa, Hyacinthus orientalis
  misc_feature (1)..(181): Public GI ID no.47026876
  misc_feature (1)..(181): Bit score of 441.7 for HMM based on sequences of FIGURE 42.
  misc_feature (5)..(177): Pfam Name: Arf Pfam Description: ADP-ribosylation factor family
  misc_feature (1)..(181): Functional Homolog Of Ceres SEEDLINE ID no. ME13149 at SEQ ID NO: 1210
MGLAFGKIFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSSNISNKS

SEQ ID NO: 1272 - protein, 195 aa, Populus tomentosa
  misc_feature (1)..(195): Public GI ID no.38353642
  misc_feature (1)..(195): Bit score of 405.9 for HMM based on sequences of FIGURE 42.
  misc_feature (5)..(152): Pfam Name: Arf Pfam Description: ADP-ribosylation factor family
  misc_feature (1)..(195): Functional Homolog Of Ceres SEEDLINE ID no. ME13149 at SEQ ID NO: 1210
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRPNLWGLINSPKEVPLVANLFLGWKGVLLIGGGPKNLGLLSPKPK

SEQ ID NO: 1273 - DNA, 1811 bp, Arabidopsis thaliana
  misc_feature (1)..(1811): Ceres SEEDLINE ID no.ME13151
  misc_feature (1)..(1811): Ceres CLONE ID no.39358
  misc_feature (1)..(1811): Inplanta Sequence
  misc_feature (1)..(1811): Encodes the peptide sequence at SEQ ID NO. 1274
tttttttgttctcacgtcgctctctctttttttcgagattcagctgtaaaaccctaactagcgccatagccaaggaagctttcctcagatcgtctctccgaaattttccggttaatcgtcagttaaggggaaaattaggctatggcgatgttaggtgcacagcaagttccagcagcagcttgtactccagatatggttgggaatgcttttgtgcctcagtattatcacatattgcatcaatctcctgagcatgttcacagattttaccaagagattagcaagttaggtcgtcctgaagagaatggtttaatgagcatcacttctaccttgcaagctattgacaagaagataatggcgcttggttacggtgtaatcagtgcagagatagctactgtggacacacaagaatctcatggaggtggttatattgtactggtgactgggtatttgacgggaaaagacagtgtcaggaggacgtttagtcagaccttcttccttgctccacaggagacaggatactttgtcttgaatgatatgtttcgattcattgatgaaggcactgtcgtacatggaaatcagattccagtgaacaacgtccaagctcctgtcaacacttaccaggacacagctgctgcgaaggaaattccagatgactttgttcaggagaaatatgtccaagagaatcatgctgttaagcaaaccgaggtgttgtccaagagcattaatgagcctgaaaaagtgttcacgccctctgaagatgaacaagtatcagctgcagaagaagttctggtgactgaaacagttaatgaagcaccaattgaagtgcaaaaggttggagaatctgattctaggactggcgaaattccaaagagatcttatgcatcaattgtgaaggttatgaaagaaaatgctgcaccaatgtctgcttcgagaactccaacaaaggtggaaccaaagaaacaagaagatcaagccattcatatccctctaccaacaccattgtctgagaaatcagattcaggagcaaatgttgctgtaaatgagaacaatcaagagaatgaaagagctctaggtccatccatctatctaaagggcttaccccttgatgcaacaccagccttgcttgagaatgagttccagaaatttggacttattaggaccaatggaattcaagtgagaagccagaaaggattctgttttggttttgttgagtttgaatccgcaagttccatgcaaagcgctatcgaggcatcacctgtcatgctcaatgggcacaaagttgttgtggaggaaaagcgatctaccgcaagagggaattatagaggacgttcgacgtttggtgtaaacacaggctacagaaacgaaggaggaaggggtcgtgggagctttggaggtggaagaggaggatatggccggaccgatttcaacggatatggtaataacaggggaaacaatagaggcggatacgcaaaccgagcaaatggtgatggtggtgggttcccgagggccaatggtaacaacggacgagtaagacgtggtggcggaattgatgctaacagagctactaaacccgtggatgatgctccccatgtgtctgttactgcgtaaatgtgcttttgaaacaaaaagctctattggttttagagagtttaggcgtagagcaatggcaaaaaaacacacactattattctcttttcactgtgtcgccattttattaattggagtcaaaacttgagagcaagagagtttcgtcggttcttgcttgtctattttttcttcactgctaatgaaatctctttcttcatgtggcc

SEQ ID NO: 1274 - protein, 488 aa, Arabidopsis thaliana
  misc_feature (1)..(488): Ceres SEEDLINE ID no.ME13151
  misc_feature (1)..(488): Ceres CLONE ID no.39358
  misc_feature (1)..(488): Bit score of 1069.5 for HMM based on sequences of FIGURE 43.
  misc_feature (19)..(135): Pfam Name: NTF2 Pfam Description: Nuclear transport factor 2 (NTF2) domain
  misc_feature (314)..(382): Pfam Name: RRM_1 Pfam Description: RNA recognition motif (RRM, RBD, or RNP domain)
MAMLGAQQVPAAACTPDMVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEVLVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGIDANRATKPVDDAPHVSVTA

SEQ ID NO: 1275 - DNA, 2019 bp, Gossypium hirsutum
  misc_feature (1)..(2019): Ceres CLONE ID no.1884601
  misc_feature (1)..(2019): Encodes the peptide sequence at SEQ ID NO 1276
ctctcttggtcctcggtctgtctgcggctcttcaacctcataaaaaaccctaaaacccgccaaacaaccccctctccacaaaagaggggtgagagtgagagaaagattaatcagaacataagaagaagccatctgaattcaaatccaaataaggaaaatcataacctaatagtctcttctctctcacctctcttttctttttgttcttgcgataagaatctaaaagctcaggcttcaaatcggcaatggcatctgtagaacaacaagtccctgctggaattgctactcctacttccgatgttgtcggtaatgcctttgttcatcaatactaccttatcttacatcaatcccctgagttggttcaccggttttaccatgatagcagcaaacttggccgccctgaagaaaatggcggcatgagtattacaactacaatgcaagccatcaatgagaagatactctcacttggttatggagaattcactgcagaaataacaactgtagacgcacaagactctcacaatggaggagtacttgttcttgtgactgggtatttaactggaaaggacaaagtgaagaggaaattcactcagagtttcttcttggcacctcaagacaagggctatttcgttttaaatgatgtttttagattcgtcgatgatacgaaacatcaacctgggggccaggacccagttaatggttttgaggcttctcttactcatgagcaaggccattctcctgttccagagaatcacattgagcaaccggctgcattgcctgaagaatgtaatggaccagaagtgtacaattcttccgagaatggagatggctctattgaggaagaggaatcaccagtggctgaggttgttgatgagattcctgatgattcaaagatggtttctgattctaagcccgaaatggaggaactgccaaagaagtcatatgcgtctattttaaaggttttgaaagagaatgcagtccctgtatcagcacctacacaatcccctgtgaagtctgcagttaagagccaggggcatccacgaattgctgcaccaccttctgctccgatgcctgcctctgatgctcaggtttctagcaacaatgttactgaaaatgggaataatcaagatgcagaggctgagggtccctctatctatgtcaaaggtctgcctttgaatgctacacctagcatgctggaggttgaatttaagaagtttggacctattaagagtggtggtattcaagttcgaagtcagaaggggttctgttttggttttgtagaatttgaaatggcaagttctgtgcaaagtgctatagaggcttcgcctattaatattggtggacgcaaagcagttgttgaagaaaagcggtctacctcccgagggaacaaagggaagtcttcatctgtttctggggctggatatagaaatgagggagcaagggggcgtggaaactatggtggtggaaggggttatagccggggtgaatttggaaacaggagcagcaatagaggaggatattccagccgtggaggtgatggatatcagaggggtgagcacatggggggtaacggtggccgtgtgagccgctctggtgaagcaacttttaatgcatcaacaaagaatgtggcacctagggtatctgcccctgcttgaagaaagtaatccagaggggagtagtcaaaagatagcatgcagtttgtttgtagtagtgatgtatcaaattgttgcgtagcatttagtggaaagaactgactgcttggcagaggagtgcatctgagatttgtttaggttttttttttcaacttccccttttgtccattttgtcattctataaatatataatagggagagatttttactgaaaggtatggtctttgcctggataatagattaaattcatgtttttagtccaactgaaatgatttgtcattttggatcgttttttggaagatgtaggtgaattaataatagttcatgactgctttcctgggtttttggacttagaaagcgcatccat

SEQ ID NO: 1276 - protein, 469 aa, Gossypium hirsutum
  misc_feature (1)..(469): Ceres CLONE ID no.1884601
  misc_feature (1)..(469): Bit score of 1157.5 for HMM based on sequences of FIGURE 43.
  misc_feature (20)..(136): Pfam Name: NTF2 Pfam Description: Nuclear transport factor 2 (NTF2) domain
  misc_feature (303)..(371): Pfam Name: RRM_1 Pfam Description: RNA recognition motif (RRM, RBD, or RNP domain)
  misc_feature (1)..(469): Functional Homolog Of Ceres SEEDLINE ID no. ME13151 at SEQ ID NO: 1274
MASVEQQVPAGIATPTSDVVGNAFVHQYYLILHQSPELVHRFYHDSSKLGRPEENGGMSITTTMQAINEKILSLGYGEFTAEITTVDAQDSHNGGVLVLVTGYLTGKDKVKRKFTQSFFLAPQDKGYFVLNDVFRFVDDTKHQPGGQDPVNGFEASLTHEQGHSPVPENHIEQPAALPEECNGPEVYNSSENGDGSIEEEESPVAEVVDEIPDDSKMVSDSKPEMEELPKKSYASILKVLKENAVPVSAPTQSPVKSAVKSQGHPRIAAPPSAPMPASDAQVSSNNVTENGNNQDAEAEGPSIYVKGLPLNATPSMLEVEFKKFGPIKSGGIQVRSQKGFCFGFVEFEMASSVQSAIEASPINIGGRKAVVEEKRSTSRGNKGKSSSVSGAGYRNEGARGRGNYGGGRGYSRGEFGNRSSNRGGYSSRGGDGYQRGEHMGGNGGRVSRSGEATFNASTKNVAPRVSAPA

SEQ ID NO: 1277 - DNA, 1966 bp, Gossypium hirsutum
  misc_feature (1)..(1966): Ceres CLONE ID no.1924320
  misc_feature (1)..(1966): Encodes the peptide sequence at SEQ ID NO 1278
cgagtcatctcacattcctccctcggtctcgcgcctcttcaagatccacaaaaaccctagaaagcgccaaacaacccattggaaaagggaggtcagtgaaaggccatcaacaaccaaaaaacgaagttcatataaatataaatactttgcgattcaaatctaaaagctcaggcaccaaattggcaatggcatctactgaacaacaagtcccatctggaattacagctcctactgctgatgttgtgggtaatgccttcgttcatcaatactaccttatattacaccaatcccctgcactggttcaccgattttaccatgataacagcaaactcggtcgccctgaagaaaatggcggcatgagtatcacaacaaccatgcaagccatcaatgagaagatactctcacttggttatggagaatttctggctgagataacaactgtagatgcacaagactcacacaatggtggagtaattgttcttgtgactgggcatttaactggaaaggacaaagtaaagcggaaattcactcagagtttctttttggcacctcaagacaagggctattttgttttaaatgatgtatttagatacattgatgaagccaaacatcaaagtggaagccaggaactagttagtaatattgaagcttctcttattaccgagaaggatccttctcctgctcctgaggatcacattgttgagcaactggctgcaatgcctgaagaagctaatgggccagaagtttataacccttctgaaaatggagatgcttctattgaagaagaggaagtaccggtggctgaggttgtagatgaaattcctgatgattcgcaaatgtttgatgactccaactccaaaattgaggaagtgccaaagaaatcatatgcgtctattgtgaagtttatgaaggagaacgcagttcctttatccacccctacgcattcccttgtgaagtctacagttaagagccatgaccaaccaggaactgtggcaccacctatttctccagccccagtgtctgatgcacagatatccaacaacagtattccagaaaatgggatcaatcaagatgtggaagctgagggcccctccatctatgtcaaaggtctgcccctgaatgccacacctagcatgctggagaatgagtttaagaagtttggacctattaagaacggtggtattcaagttcgaagtcagaagggattctgttttggttttgtggagtttgaacttgcaagttctgctcaaagtgccatagaggcttcacctataaatattggtgggcgcatgcaattgttgaagaaaagcggtctacctctcgagggaacaaaggatggccttctggttcaggggctggatacagaaatgatggagcaagagggaggggaaactatggtggtggtggtggcaggggctacagccggggtgagtttggaaacaggagcaacaaccgaggagggtattccaaccgcagaggtgatggatatcaaaggggtgacatggggagtaatggtggcagccgcatgaaccgcactggtggacttgctgttaatgcagcagcgaagaacatggcaccaagggtacctgcccctgcttgaagacattaatttggaaattggttgggagtgatcaaagataagttttttggtgtgtagtgtagtgatttattgacattgttgcatatcatttagaagaaagcgttgaaagcttagcagaggaaatttggctgtgagattaatttagggttttcgcttcctcattaagcccattttgtcttttgacaatgtaatactgcaaggttttgggtggtcgtggattgtagatccaattcttgtttgttcaccatacaattttagtgtttttaggcttctggatagggagcattctattttgggaaaatgtacctttatcaaggttttttgccttttgttgtagtctcaacttacatagtttggatttggttt

SEQ ID NO: 1278 - protein, 447 aa, Gossypium hirsutum
  misc_feature (1)..(447): Ceres CLONE ID no.1924320
  misc_feature (1)..(447): Bit score of 705.9 for HMM based on sequences of FIGURE 43.
  misc_feature (20)..(136): Pfam Name: NTF2 Pfam Description: Nuclear transport factor 2 (NTF2) domain
  misc_feature (304)..(360): Pfam Name: RRM_1 Pfam Description: RNA recognition motif (RRM, RBD, or RNP domain)
  misc_feature (1)..(447): Functional Homolog Of Ceres SEEDLINE ID no. ME13151 at SEQ ID NO: 1274
MASTEQQVPSGITAPTADVVGNAFVHQYYLILHQSPALVHRFYHDNSKLGRPEENGGMSITTTMQAINEKILSLGYGEFLAEITTVDAQDSHNGGVIVLVTGHLTGKDKVKRKFTQSFFLAPQDKGYFVLNDVFRYIDEAKHQSGSQELVSNIEASLITEKDPSPAPEDHIVEQLAAMPEEANGPEVYNPSENGDASIEEEEVPVAEVVDEIPDDSQMFDDSNSKIEEVPKKSYASIVKFMKENAVPLSTPTHSLVKSTVKSHDQPGTVAPPISPAPVSDAQISNNSIPENGINQDVEAEGPSIYVKGLPLNATPSMLENEFKKFGPIKNGGIQVRSQKGFCFGFVEFELASSAQSAIEASPINIGGRMQLLKKSGLPLEGTKDGLLVQGLDTEMMEQEGGETMVVVVAGATAGVSLETGATTEEGIPTAEVMDIKGVTWGVMVAAA

SEQ ID NO: 1279 - DNA, 1536 bp, Populus balsamifera subsp. trichocarpa
  misc_feature (1)..(1536): Ceres ANNOT ID no.1445717
  misc_feature (1)..(1536): Encodes the peptide sequence at SEQ ID NO 1280
atggcagcaccagtgacgcaactcccagttccaactgctgatgttgttggtaatgctttcgcgcatcagtactaccatatattgcagcaatccccggatcttgttcaccgattctaccaggatggtagtaagtttggacgtcctggagaggatggggtcatgagtaccactactaccatgaatgctattaatgagaagatactttcacttggatatggtcaagtcagggcagaaattgttacagttgattcacaagaatcttacaaaggtggagttcttgtgctagtgactgggtatttgaatggaaatgacaatttgcgacaaaaatttactcagagcttcttcctggctcctcaagacaaaggttattttgtgctgaatgatgtgtttcggtatgttgatgactccacacaccagaatggaaatcaagagcctgccagcaattttgaagccccagttgctcctgaccaggatactcctcacacacaggaaactcacatttctgagccaacagctgctttgtctgaggaagtcattggaggggaagtgtacaatccctctgaaagtggggatgtttcagttgaggtagaggaagaggaaagtggggatgtttcatttgaggaagaggaagaaccaatgcctgaggttgttgatgaaattcctcctgattcccagttagtggctgactcccaggttgtggtcgagtctagtgctaagattgaagacactccgaagaagtcgtatgcctccgttgtgaaagttcagaaggagtacactgcacctttttcgagtcctaccccttctcctctgaggtctgcaccaaaaatccaagaacaagtgactgctgcagtgtctcaacccccagcagctgagtcacatgtctccagctctaatacttttgaaaatgggaatgcccaagagagtgaagagggtccttctatctacgtgaaaggtctgcctttagatgcgacgactaccttgcttgaaaacgagttcaagaagtttggacctattaggaatggtggcgttcaagttagattccaaaagggattttgttttggctttgtggagtttgaggtggcgagtgctgtgcaaagtgcattagagcttatctatctctttctcttcaccacagggaacaataggggacgatttccatctggatcaggggctggatataaaagtgaaggaatgagagggcgtggtaatcttggaggaaaagtatatggcaggattgaaattggtatcagaacagagtttggaaacagaggtggcagtcgaggcggtggatattcaaaccgtggaggcgatggatattcaaaccgtggaggtggaggtggaggtggaggtgatgggtattctaaccgtggaggtggaggtggaggtgatgggtattctaaccgtggaggtggaggtgatggctatcggagagctgataagatggggaacaatggtggtcgggcaaaccgttctggtggtttaggtcttaacggcacagccaagactacagcgccacgagtatctgcaacagcttga

SEQ ID NO: 1280 - protein, 511 aa, Populus balsamifera subsp. trichocarpa
  misc_feature (1)..(511): Ceres ANNOT ID no.1445717
  misc_feature (1)..(511): Bit score of 1064.1 for HMM based on sequences of FIGURE 43.
  misc_feature (16)..(132): Pfam Name: NTF2 Pfam Description: Nuclear transport factor 2 (NTF2) domain
  misc_feature (314)..(369): Pfam Name: RRM_1 Pfam Description: RNA recognition motif (RRM, RBD, or RNP domain)
  misc_feature (1)..(511): Functional Homolog Of Ceres SEEDLINE ID no. ME13151 at SEQ ID NO: 1274
MAAPVTQLPVPTADVVGNAFAHQYYHILQQSPDLVHRFYQDGSKFGRPGEDGVMSTTTTMNAINEKILSLGYGQVRAEIVTVDSQESYKGGVLVLVTGYLNGNDNLRQKFTQSFFLAPQDKGYFVLNDVFRYVDDSTHQNGNQEPASNFEAPVAPDQDTPHTQETHISEPTAALSEEVIGGEVYNPSESGDVSVEVEEEESGDVSFEEEEEPMPEVVDEIPPDSQLVADSQVVVESSAKIEDTPKKSYASVVKVQKEYTAPFSSPTPSPLRSAPKIQEQVTAAVSQPPAAESHVSSSNTFENGNAQESEEGPSIYVKGLPLDATTTLLENEFKKFGPIRNGGVQVRFQKGFCFGFVEFEVASAVQSALELIYLFLFTTGNNRGRFPSGSGAGYKSEGMRGRGNLGGKVYGRIEIGIRTEFGNRGGSRGGGYSNRGGDGYSNRGGGGGGGGDGYSNRGGGGGGDGYSNRGGGGDGYRRADKMGNNGGRANRSGGLGLNGTAKTTAPRVSATA

SEQ ID NO: 1281 - protein, 488 aa, Arabidopsis thaliana
  misc_feature (1)..(488): Public GI ID no.30687772
  misc_feature (1)..(488): Bit score of 1065.2 for HMM based on sequences of FIGURE 43.
  misc_feature (19)..(135): Pfam Name: NTF2 Pfam Description: Nuclear transport factor 2 (NTF2) domain
  misc_feature (314)..(382): Pfam Name: RRM_1 Pfam Description: RNA recognition motif (RRM, RBD, or RNP domain)
  misc_feature (1)..(488): Functional Homolog Of Ceres SEEDLINE ID no. ME13151 at SEQ ID NO: 1274
MAMLGAQQVPAAACTPDMVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEALVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGNDANRATKPVDDAPRVSVAA

SEQ ID NO: 1282 - protein, 473 aa, Arabidopsis thaliana
  misc_feature (1)..(473): Public GI ID no.9294171
  misc_feature (1)..(473): Bit score of 1007.0 for HMM based on sequences of FIGURE 43.
  misc_feature (299)..(367): Pfam Name: RRM_1 Pfam Description: RNA recognition motif (RRM, RBD, or RNP domain)
  misc_feature (4)..(120): Pfam Name: NTF2 Pfam Description: Nuclear transport factor 2 (NTF2) domain
  misc_feature (1)..(473): Functional Homolog Of Ceres SEEDLINE ID no. ME13151 at SEQ ID NO: 1274
MIQVGNAFVPQYYHILHQSPEHVHRFYQEISKLGRPEENGLMSITSTLQAIDKKIMALGYGVISAEIATVDTQESHGGGYIVLVTGYLTGKDSVRRTFSQTFFLAPQETGYFVLNDMFRFIDEGTVVHGNQIPVNNVQAPVNTYQDTAAAKEIPDDFVQEKYVQENHAVKQTEVLSKSINEPEKVFTPSEDEQVSAAEEALVTETVNEAPIEVQKVGESDSRTGEIPKRSYASIVKVMKENAAPMSASRTPTKVEPKKQEDQAIHIPLPTPLSEKSDSGANVAVNENNQENERALGPSIYLKGLPLDATPALLENEFQKFGLIRTNGIQVRSQKGFCFGFVEFESASSMQSAIEASPVMLNGHKVVVEEKRSTARGNYRGRSTFGVNTGYRNEGGRGRGSFGGGRGGYGRTDFNGYGNNRGNNRGGYANRANGDGGGFPRANGNNGRVRRGGGNDANRATKPVDDAPRVSVAA

SEQ ID NO: 1283 - DNA, 1834 bp, Glycine max
  misc_feature (1)..(1834): Ceres CLONE ID no.527903
  misc_feature (1)..(1834): Encodes the peptide sequence at SEQ ID NO 1284
acagacacaggtagctttcgcacactcccttttttcgtgcgcaaactgttcccgttggtctctttccctctgcacttcacaatcctaccctctcactgtgctatctctcagcatcttcgcaatcacacccttcccagatggccttgcaaacagctactcctccaacaactcccagtgcccaagttgttggtaatgcatttgttgagcagtattaccatattcttcaccattcaccaggttcggtctatcggttttaccaggactctagtgtgataagccgtcctgattccagtggtgtgatgacatcagttacaaccatgaaaggcattaatgagaagattctttcactaaatttcaaggaatttaaagcagagataaagactgcagatgctcaaaaatcatacaaggaaggagtgactgtgttggtgactggatgcttgactggcaaggataacttgagaagaaaatttgcacagtcattctttcttgctccacaagacaatggctattttgttctgaatgatgtttttaggtatgtagaagaccatgaaccatcagaactgcctccagttactggagatggtgattcagctgctgttacagtaacaccagaactagaacccagtcatgttgctgattcttgtgcaccagagcccacaaattctcatgtgaacaaaggtcaaactgttgctgagaatgcttatgagctatctaataatcatgagagacagatacctgttgagaatgaaggcaatgtagaatcacattttcagtcaaatggtaatgatgattctcaggccacagaactggcttcatcagctcaagacgatgctccaaagaagtcttatgcatcaattgtgaaagtccaaaaagggagttcagttccaactaaagtctatgtgcctactaatacactaaagtctgggcctaacaaaactgagagcaaggtagttgagtcagtagaatctactgaagtgcctgaagcagctttggaaagtgttagcaaccctgaaagtagtgatgctcatgaggaagttgagggtcactccatatacattcgaaatttgcctttaaatgtgacggttgctcagttggaactggagtttaagaaatttgggcccatcaagccaggaggcatccaagtcagaaataataagcagcagggatactgttttggctttgttgagttcctatctctaaattccatgaatagtgcaattcaggcttcacctgttcctattggggggcgtcaagctgtagtcgagataaagagaaccactacccgagttggcagtggcattaatggtactggaagacctaggatcccatctggtaggggtgggttacgaaatgactctttcaggggtcgtgggaattatgttgggggtcggggatacggtcgaaatgattatgtaagccgtggcgggttttctggtaggggtcgtggtcatggagaaggttatcaccaagggagagggagaggcggccggtcaagtggacaaaaacaaaatgctgtttccaactgaaatactggatgatttttgggaggttgttctgagacccccctttttgggtcagttatgagcatggaattcaaccttctaaagtttctcatgtttctttcactgcaatttgcacagttgtagtatttctagttgttattgctatgattttagtgggttggtagtgatcactgatcaggaataggtatagtcttttcttttgaaaaattgaaacatgctatgactggaattagcagtaggttaaccatcagttctcttttatttgttgctatggtgcaacatttttatatctaagttgagattttaatttt

SEQ ID NO: 1284 - protein, 462 aa, Glycine max
  misc_feature (1)..(462): Ceres CLONE ID no.527903
  misc_feature (1)..(462): Bit score of 1048.3 for HMM based on sequences of FIGURE 43.
  misc_feature (17)..(133): Pfam Name: NTF2 Pfam Description: Nuclear transport factor 2 (NTF2) domain
  misc_feature (305)..(375): Pfam Name: RRM_1 Pfam Description: RNA recognition motif (RRM, RBD, or RNP domain)
  misc_feature (1)..(462): Functional Homolog Of Ceres SEEDLINE ID no. ME13151 at SEQ ID NO: 1274
MALQTATPPTTPSAQVVGNAFVEQYYHILHHSPGSVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDSAAVTVTPELEPSHVADSCAPEPTNSHVNKGQTVAENAYELSNNHERQIPVENEGNVESHFQSNGNDDSQATELASSAQDDAPKKSYASIVKVQKGSSVPTKVYVPTNTLKSGPNKTESKVVESVESTEVPEAALESVSNPESSDAHEEVEGHSIYIRNLPLNVTVAQLELEFKKFGPIKPGGIQVRNNKQQGYCFGFVEFLSLNSMNSAIQASPVPIGGRQAVVEIKRTTTRVGSGINGTGRPRIPSGRGGLRNDSFRGRGNYVGGRGYGRNDYVSRGGFSGRGRGHGEGYHQGRGRGGRSSGQKQNAVSN

SEQ ID NO: 1285 - protein, 455 aa, Medicago truncatula
  misc_feature (1)..(455): Public GI ID no.92891722
  misc_feature (1)..(455): Bit score of 936.4 for HMM based on sequences of FIGURE 43.
  misc_feature (2)..(118): Pfam Name: NTF2 Pfam Description: Nuclear transport factor 2 (NTF2) domain
  misc_feature (303)..(372): Pfam Name: RRM_1 Pfam Description: RNA recognition motif (RRM, RBD, or RNP domain)
  misc_feature (1)..(455): Functional Homolog Of Ceres SEEDLINE ID no. ME13151 at SEQ ID NO: 1274
MVGNAFVEQYYSILHRDPDQVHRFYHDSSVMSRPEEDGTMTTVTTTAEIDKKIQSLEYTSFRVEVLSADAQPSYNNGVMVVVTGCLTGTDNIKRKFAQSFFLAPQDKGFYVLNDVFRYVDAYKSIDIESVPANDADESAPSEAIITPEPEPVHVPEVIPPTQTVIPTAQTVIPPTQTVIADTETIISKEVSLPLENGKLSVTENVIPVNHVKESSHHVKEPEQPTSIEKVASNTQEDTPKKSFASIVNALKDNSAPFHLRASPAKPAVHPPRVHSVPAPEAPTPNMDIPLEKNNENAGRAHAIFVANLPMSATVEQLDRAFKKFGPIKRDGIQVRSNKGSCFGFVEFESAASMQSALEASPPVMLDNRRLSIEERRGRSGYRNDRNDNFRGRGNFGGGRGGGFNGRNDFERRGGEFSGRSRGGQNAGRSNGDAVPRSYQNGGGKVAARQPPVKVQ

SEQ ID NO: 1286 - DNA, 1861 bp, Triticum aestivum
  misc_feature (1)..(1861): Ceres CLONE ID no.790881
  misc_feature (1)..(1861): Encodes the peptide sequence at SEQ ID NO 1287
accactctcccattcccgtataacccccgcagccgccgccgctcctccccctctcttcctcccttggccaaattttgcgggaaacgcgacgccacccggagaaaccctcctcccgcacctcgcctcccaccctgccaaaaccctcgcccctcctcctcctcctcctcctacgatggccgcgccgacgcctccgcccgccgccgcccccgccgcggcgccaggaccgacgccgccggcgcaagtggtgggcaacgccttcgtgcagcagtactacaacatcctccaccagtcaccggagctcgtcttccgcttctaccaggaggccagccgcatcggccgccccgccaccaccggcgccgacatggacaccgtcaccaccatggaggcgattaacgagaagatcatgtccatggacatcgcgcgggcggagatcaggggggtggacgcgcaggagtcgctatgtggcggtgtgaccgtgctcgtcacgggccacctcacagggaaggacgacgtctgccgcgagttcgcgcagtccttcttcctcgcgccgcaggagaagggttacttcgtgctcaacgacatactacgttatgtcgggcagggtgaggccgacccgtcattgccgccacctcagcagcagccgccggcaccggagttggatgcagtggttgcccctgctgccgccttggcaaatggtactgttgcccctgtggagactgtgcctcgcgagcaggaggcttcgccgcagccagagctggatctctctgagtctgttcctcataccaacgaggaggaggatcccaaggaggaggtttacaacccaccgaatgacgtggaggtgcctgttgtggaggaaacactggttcctgaggtcatagatgaagtgccaaataatgtagcagcctccataccggtttcggctccccctgtaccacatgaggaggcccctaagaagtcgtacgcttcaattgtcaaagtcatgaaagcagttctgccaccaaattccacagttccttacaggcctgcaccaccaaaaccagagaagcaagctcctgctcctgcccagtctgtggctgttgatgctccaactttcagtcctaatcctgagagcagcaacattcaagaccaagaagttgatgcgcttgcggtgtatgtaaaaaatctgcccttacatgccacacctagccaattagaagaggagttcaaaagatttggtactattaaacatgatggtatccaagttagaagccacaagattcaagggttctgctatggcttcatagagtttgaggatgccagctcagttcaaagtgcactagcggcttctcctgtgacgattgatgaccggccatgccacgtcgaagaaaaaagaactcctggttcacgtggtagtagcaggggaaggtttccaccgggtagaggtggtaatttccgaggtgaaggcatgagaggccgtggtagttacactggagggagaggctatggaaggggcgagtacaacaactatcgatctgattttggaggcagaggcggtggtagaggcggctcaggtcgtggaggtgatgttggctaccagcgggttgatcactctggcaccggtggtcgtggtggtgcccgggcagctgcaaagtgagtttggtagctatgcgttggtagaagtttgctatttcattgtcgttgaacgtactaagattcacaaaaatggtgtgtcgtgagctgggttcctgtgcggtcgttgtcagcgtattcaggtcataaattggtgctctccttgttttgtggcaaggaaagcagtggtgatattggttactaattgtagaatattacaatctattcagatgcagtcctagtaagttttgac

SEQ ID NO: 1287 - protein, 486 aa, Triticum aestivum
  misc_feature (1)..(486): Ceres CLONE ID no.790881
  misc_feature (1)..(486): Bit score of 1189.7 for HMM based on sequences of FIGURE 43.
  misc_feature (25)..(140): Pfam Name: NTF2 Pfam Description: Nuclear transport factor 2 (NTF2) domain
  misc_feature (326)..(396): Pfam Name: RRM_1 Pfam Description: RNA recognition motif (RRM, RBD, or RNP domain)
  misc_feature (1)..(486): Functional Homolog Of Ceres SEEDLINE ID no. ME13151 at SEQ ID NO: 1274
MAAPTPPPAAAPAAAPGPTPPAQVVGNAFVQQYYNILHQSPELVFRFYQEASRIGRPATTGADMDTVTTMEAINEKIMSMDIARAEIRGVDAQESLCGGVTVLVTGHLTGKDDVCREFAQSFFLAPQEKGYFVLNDILRYVGQGEADPSLPPPQQQPPAPELDAVVAPAAALANGTVAPVETVPREQEASPQPELDLSESVPHTNEEEDPKEEVYNPPNDVEVPVVEETLVPEVIDEVPNNVAASIPVSAPPVPHEEAPKKSYASIVKVMKAVLPPNSTVPYRPAPPKPEKQAPAPAQSVAVDAPTFSPNPESSNIQDQEVDALAVYVKNLPLHATPSQLEEEFKRFGTIKHDGIQVRSHKIQGFCYGFIEFEDASSVQSALAASPVTIDDRPCHVEEKRTPGSRGSSRGRFPPGRGGNFRGEGMRGRGSYTGGRGYGRGEYNNYRSDFGGRGGGRGGSGRGGDVGYQRVDHSGTGGRGGARAAAK

SEQ ID NO: 1288 - DNA, 1815 bp, Zea mays
  misc_feature (1)..(1815): Ceres CLONE ID no.299417
  misc_feature (1)..(1815): Encodes the peptide sequence at SEQ ID NO 1289
ctctcctctctgtttcatctcgccagctttgcgggaaaagagacaccagggacaagccccgcctcctctcccgagtcctgacgtgccccttttgctccggccccacttcctcgcaaaaccctaacccctcgatctcccaagatggcgtcgcagccgccgccccctgccgcagccgcggcatctggagctccgccgccggcacaagtggtgggcaacgccttcgtgcatcagtactacaacatcttgcaccagtcgccggagctcgtctaccgcttctaccaggaggccagctgcctcgggcgccccgccggcaccggtgccgacggcatggacacggtcaccaccatggacgcgattaacgacaagatcgtgtccatgggtatcgaccgggcgaagatcaaggcggtggacgcgcaggaatcgctctgtggcggcgtcagcgtgctcgtcatgggtcatcttacggggaggaacagcgtcagccgccagttcgtgcagtccttcttcctcgcgccgcaggagaagggctactttgtgctcaacgacatactgcgctacgttggggaggggggaggggacgagggggctgagaagcagccagcacctgaggttgctgcggacgcggagaagaccacctctgcccctatcctggccaacggcactgtcggaggagacgccacgactgttcctcaggatgcttcgccgcagcctgagtgccaggtggccgagcctgcacttaatccaaaggaggaagttctgaacggggaggtttgtaactcgctaagtgatgtggagaagcctgttgctgaggaaacgccggttcctgatgtcataaatgaagtgccaaataatgttgcagtggctccaccaatttcatcccctcctgtaccattgaaggaggcaccaaagaagtcatatgcttcaattgtaaaagtcatgaaagaacatcggccattagcacctgcagttccttccagacctgcacccccaataacagagaagcaagcctctcctgcccccactccagttactgaggctccagctttctcccctaatcctcagagcggcggctttcaagatccagaagttgatgcacatgccatatatgtgcgaagtctgccattaaatgccacaccacaacaattagaggaagagttcaagagatttggaaccattaaacatgaaggcatccaagttagaagcaacaagatccaagggttttgctatggctttgtagaatttgaggatgccagtgcagttcaagctgcaatagaggcttctcctgttactattggtgagcggcaatgctttgtcgaagagaaaaggactactggttctcgtggcggtggtagcaggggaggaaggtttccaccaggtagaggtggtaatttccgaggtgaaggcattagaggccgtggtacatacaatggaggcagagggtacggaaggggcgagttcagttaccgatccgattatggaggccgaggtggcggcaggggtggctcattacacggaggtgatgttggctatcagcgggtcgactactctggcacatccagtggacgtggtgcccgggcaccatcagcggccgctgctatggcaaagtgagttcttggtagctatgagtcggtagtagtttagttttgtggccaccatcacggttgaccaaaagagtggtgtggtgattcgagttcatgtgaggattatgaacaaaagtcaggtcataaattgatgcttccttgttttgtggcaaggcaaagcagtggtgatatcggttactaattgtagaatatacgtctgttgagatgtcctagc

SEQ ID NO: 1289 - protein, 488 aa, Zea mays
  misc_feature (1)..(488): Ceres CLONE ID no.299417
  misc_feature (1)..(488): Bit score of 1173.4 for HMM based on sequences of FIGURE 43.
  misc_feature (23)..(139): Pfam Name: NTF2 Pfam Description: Nuclear transport factor 2 (NTF2) domain
  misc_feature (321)..(391): Pfam Name: RRM_1 Pfam Description: RNA recognition motif (RRM, RBD, or RNP domain)
  misc_feature (1)..(488): Functional Homolog Of Ceres SEEDLINE ID no. ME13151 at SEQ ID NO: 1274
MASQPPPPAAAAASGAPPPAQVVGNAFVHQYYNILHQSPELVYRFYQEASCLGRPAGTGADGMDTVTTMDAINDKIVSMGIDRAKIKAVDAQESLCGGVSVLVMGHLTGRNSVSRQFVQSFFLAPQEKGYFVLNDILRYVGEGGGDEGAEKQPAPEVAADAEKTTSAPILANGTVGGDATTVPQDASPQPECQVAEPALNPKEEVLNGEVCNSLSDVEKPVAEETPVPDVINEVPNNVAVAPPISSPPVPLKEAPKKSYASIVKVMKEHRPLAPAVPSRPAPPITEKQASPAPTPVTEAPAFSPNPQSGGFQDPEVDAHAIYVRSLPLNATPQQLEEEFKRFGTIKHEGIQVRSNKIQGFCYGFVEFEDASAVQAAIEASPVTIGERQCFVEEKRTTGSRGGGSRGGRFPPGRGGNFRGEGIRGRGTYNGGRGYGRGEFSYRSDYGGRGGGRGGSLHGGDVGYQRVDYSGTSSGRGARAPSAAAAMAK

SEQ ID NO: 1290 - DNA, 1996 bp, Panicum virgatum
  misc_feature (1)..(1996): Ceres CLONE ID no.1993894
  misc_feature (1)..(1996): Encodes the peptide sequence at SEQ ID NO 1291
  misc_feature (568)..(568): r is g or a
cccctgttctctccttaccttccccccggcccgctccctcgccagctttgcgggaaaccagagccgccagcagacaaacccctctctccgcctcgctccccctcctccccaaaaccataacccctccgcccccgatggcgtcgccgccgccgccgccgcccgccggagccgccgcgcccggatcgccgccgccggcgcaagtggtgggcaacgcgttcgtgaaccagtactacaacatcctgcaccagtcgccggagctcgtccaccggttctaccaggacgccagccgcctcggccggcccgccggcgccggcgccgacggcatggacaccgtcaccaccatggacgcgattagcgacaagatcgtgtccatgggcatcacgcgcgcggagatcaaggcggtggacgcgcaggagtcgctcggcggcggcgtcaccgtgctcgtcatgggccacctcacggggaggaccagcgtcggccgcgagttcgtgcagtccttcttcctcgcgccgcaggagaagggctacttcgtgctcaacgacatactgcgctacgtcggggacggggraggggaggagggagccgggcacccgccgccgccaccgcagcagccggtgcaggagacagtcacgggcgcggaggccgtccctgctcccatcctggccaatggcactgtcgggggagacaacgagaccctgccttgcgaacaggatgcttcaccgcagcctgagcagcctgcagctgagtccgcacctcctactccagaggaggaagatctctacggagaggaggtttacaacccgccgaatgatatggagaagcctgttgttcaggaaacaccggttgccgaggtcataaatgaagtgccgaataatgtagcagtggctgcgccaagttcgtctccctctataccgatcgaggaggccccaaagaagtcatatgcttcgattgtaaaagtcatgaaagaatatccaccaccagctcctgcagttccctccaggcctgcacccccaaaaccagagaaacaagcccctcctgcaccttctctggttgctgatgctccagctttcagtcctaacactcagggtggcagctttcaagatccagaagttgatgcacatgccatatatgtgcggaatctgcctttaaacgccacaccacaacaattagaagaagaattcaagcgatttggcaccattaagcatgaaggcatccaagttagaagcaacaagatccaagggttttgttatggctttgtagaatttgaggatgccaacgcagtccaaactgcaatagaggcttctcctgttatgattagtgaacggcaatgttatgttgaagagaaaagaactactggttctcgtggcagtaaccgaggaggaaggtttgcaccaggtagaggtggtaacttccgaggtgaaggccttaggggccgtggtacttacaatggaggcagaggctatgggaggggcgagttcagttaccgatctgattatggcggccgaggtggtggcaggggtggctcatcgcgcggagaagttggctatcagcgggttgaccactctggtacagccggtggccgtggcacccggccagcatctgctgctactgctgcaaagtgagttcttggtagctgtgcgtcagtaatagttcagagttctacggccaccatcatggttgaccaaaagcgtggcaggtgtgctgtatttgggttcatgtgaggtttatcagcaaaagttgggtcataaattgatgtttatccttgttttgtggcaaggtaaagcagtggttatatcggttactaattgtagaatatacgtctattgagcttcgttgagcagctgatttgtgttttcccgttttttaacttgttccgaaattagaggggttgatttgaggtgccagtgatttatagcttttattgactgttattaaaatagaagttatggtttagagcttgtaagattggtaagataagtttcttgtttctggaatc

SEQ ID NO: 1291 - protein, 495 aa, Panicum virgatum
  misc_feature (1)..(495): Ceres CLONE ID no.1993894
  misc_feature (1)..(495): Bit score of 1199.3 for HMM based on sequences of FIGURE 43.
  misc_feature (24)..(140): Pfam Name: NTF2 Pfam Description: Nuclear transport factor 2 (NTF2) domain
  misc_feature (331)..(401): Pfam Name: RRM_1 Pfam Description: RNA recognition motif (RRM, RBD, or RNP domain)
  misc_feature (1)..(495): Functional Homolog Of Ceres SEEDLINE ID no. ME13151 at SEQ ID NO: 1274
  misc_feature (145)..(145): Xaa is any aa, unknown or other
MASPPPPPPAGAAAPGSPPPAQVVGNAFVNQYYNILHQSPELVHRFYQDASRLGRPAGAGADGMDTVTTMDAISDKIVSMGITRAEIKAVDAQESLGGGVTVLVMGHLTGRTSVGREFVQSFFLAPQEKGYFVLNDILRYVGDGXGEEGAGHPPPPPQQPVQETVTGAEAVPAPILANGTVGGDNETLPCEQDASPQPEQPAAESAPPTPEEEDLYGEEVYNPPNDMEKPVVQETPVAEVINEVPNNVAVAAPSSSPSIPIEEAPKKSYASIVKVMKEYPPPAPAVPSRPAPPKPEKQAPPAPSLVADAPAFSPNTQGGSFQDPEVDAHAIYVRNLPLNATPQQLEEEFKRFGTIKHEGIQVRSNKIQGFCYGFVEFEDANAVQTAIEASPVMISERQCYVEEKRTTGSRGSNRGGRFAPGRGGNFRGEGLRGRGTYNGGRGYGRGEFSYRSDYGGRGGGRGGSSRGEVGYQRVDHSGTAGGRGTRPASAATAAK

SEQ ID NO: 1292 - DNA, 1914 bp, Panicum virgatum
  misc_feature (1)..(1914): Ceres CLONE ID no.1864033
  misc_feature (1)..(1914): Encodes the peptide sequence at SEQ ID NO 1293
accttccccccggcccgctccctcgccagctttgcgggaaaccagagccgccagcagacaaacccctctctccgcctcgctccccctcctccccaaaaccataacccctccgcccccgatggcgtcgccgccgccgccgccgccgccgccgcccgccggagccgccgcgcccggatcgccgccgccggcgcaagtggtgggcaacgcgttcgtgaaccagtactacaacatcctgcaccagtcgccggagctcgtccaccggttctaccaggacgccagccgcctcggccggcccgccggcgccggcgccgacggcatggacaccgtcaccaccatggacgcgattagcgacaagatcgtgtccatgggcatcacgcgcgcggagatcaaggcggtggacgcgcaggagtcgctcggcggcggcgtcaccgtgctcgtcatgggccacctcacggggaggaccggcgtcggccgcgagttcgtgcagtccttcttcctcgcgccgcaggagaagggctacttcgtgctcaacgacatactgcgctacgtcggggacggggaaggggaggagggagccgggcacccgccgccgccaccgcagcagccggtgcaggagacagtcacgggcgcggaggccgtccctgctcccatcctggccaatggcactgtcgggggagacaacgagaccctgccttgcgaacaggatgcttcaccgcagcctgagcagcctgcagctgagtccgcacctcctactccagaggaggaagatctctacggagaggaggtttacaacccgccgaatgatatggagaagcctgttgttcaggaaacaccggttgccgaggtcataaatgaagtgccgaataatgtagcagtggctgcgccaagttcgtctccctctataccgatcgaggaggccccaaagaagtcatatgcttcgattgtaaaagtcatgaaagaatatccaccaccagctcctgcagttccctccaggcctgcacccccaaaaccagagaaacaagcccctcctgcaccttctctggttgctgatgctccagctttcagtcctaacactcagggtggcagctttcaagatccagaagttgatgcacatgccatatatgtgcggaatctgcctttaaacgccacaccacaacaattagaagaagaattcaagcgatttggcaccattaagcatgaaggcatccaagttagaagcaacaagatccaagggttttgttatggctttgtagaatttgaggatgccaacgcagtccaaactgcaatagaggcttctcctgttatgattagtgaacggcaatgttatgttgaagagaaaagaactactggttctcgtggcagtaaccgaggaggaaggtttgcaccaggtagaggtggtaacttccgaggtgaaggccttaggggccgtggtacttacaatggaggcagaggctatgggaggggcgagttcagttaccgatctgattatggcggccgaggtggtggcaggggtggctcatcgcgcggagaagttggctatcagcgggttgaccactctggtacagccggtggccgtggcacccggccagcatctgctgctactgctgcaaagtgagttcttggtagctgtgcgtcagtaatagttcagagttctacggccaccatcatggttgaccaaaagcgtggcaggtgtggtgtatttgggttcatgtgaggtttatcagcaaaagttgggtcataaattgatgcttatccttgttttgtggcaaggtaaagcagtggttatatcggttactaattgtagaatatacgtctattgagcttcgttgagcagctgatttgtgttttcccgtttttttaacttgttccgaaattagaggggttgatttgaggtgccagtgatttatagctttc

SEQ ID NO: 1293 - protein, 498 aa, Panicum virgatum
  misc_feature (1)..(498): Ceres CLONE ID no.1864033
  misc_feature (1)..(498): Bit score of 1191.4 for HMM based on sequences of FIGURE 43.
  misc_feature (27)..(143): Pfam Name: NTF2 Pfam Description: Nuclear transport factor 2 (NTF2) domain
  misc_feature (334)..(404): Pfam Name: RRM_1 Pfam Description: RNA recognition motif (RRM, RBD, or RNP domain)
  misc_feature (1)..(498): Functional Homolog Of Ceres SEEDLINE ID no. ME13151 at SEQ ID NO: 1274
MASPPPPPPPPPAGAAAPGSPPPAQVVGNAFVNQYYNILHQSPELVHRFYQDASRLGRPAGAGADGMDTVTTMDAISDKIVSMGITRAEIKAVDAQESLGGGVTVLVMGHLTGRTGVGREFVQSFFLAPQEKGYFVLNDILRYVGDGEGEEGAGHPPPPPQQPVQETVTGAEAVPAPILANGTVGGDNETLPCEQDASPQPEQPAAESAPPTPEEEDLYGEEVYNPPNDMEKPVVQETPVAEVINEVPNNVAVAAPSSSPSIPIEEAPKKSYASIVKVMKEYPPPAPAVPSRPAPPKPEKQAPPAPSLVADAPAFSPNTQGGSFQDPEVDAHAIYVRNLPLNATPQQLEEEFKRFGTIKHEGIQVRSNKIQGFCYGFVEFEDANAVQTAIEASPVMISERQCYVEEKRTTGSRGSNRGGRFAPGRGGNFRGEGLRGRGTYNGGRGYGRGEFSYRSDYGGRGGGRGGSSRGEVGYQRVDHSGTAGGRGTRPASAATAAK

SEQ ID NO: 1294 - protein, 482 aa, Oryza sativa subsp. indica
  misc_feature (1)..(482): Public GI ID no.125539547
  misc_feature (1)..(482): Bit score of 1159.1 for HMM based on sequences of FIGURE 43.
  misc_feature (15)..(131): Pfam Name: NTF2 Pfam Description: Nuclear transport factor 2 (NTF2) domain
  misc_feature (320)..(390): Pfam Name: RRM_1 Pfam Description: RNA recognition motif (RRM, RBD, or RNP domain)
  misc_feature (1)..(482): Functional Homolog Of Ceres SEEDLINE ID no. ME13151 at SEQ ID NO: 1274
MAAPQASPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAAVEVQPEADAVAPPLANGTATAPLQPAAPDYDGMPQEEPDVVEHAAVPPEEEEEVYNPPLEEVEGGAVEEEQSVPEVINEVPNNVVPVVAPAAAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 1295 - protein, 480 aa, Oryza sativa subsp. japonica
  misc_feature (1)..(480): Public GI ID no.48716424
  misc_feature (1)..(480): Bit score of 1158.7 for HMM based on sequences of FIGURE 43.
  misc_feature (15)..(131): Pfam Name: NTF2 Pfam Description: Nuclear transport factor 2 (NTF2) domain
  misc_feature (318)..(388): Pfam Name: RRM_1 Pfam Description: RNA recognition motif (RRM, RBD, or RNP domain)
  misc_feature (1)..(480): Functional Homolog Of Ceres SEEDLINE ID no. ME13151 at SEQ ID NO: 1274
MAAPQASPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAEVQPEADAVAPPLANGTATAPLQPAAPDYDAMPHEEPDVVENVAVPPEEEEEVYNPPLEEVEGGAVEEEQSVPEVINEVPNNVVPVVAPADAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 1296 - protein, 480 aa, Oryza sativa subsp. japonica
  misc_feature (1)..(480): Public GI ID no.125582201
  misc_feature (1)..(480): Bit score of 1154.9 for HMM based on sequences of FIGURE 43.
  misc_feature (15)..(131): Pfam Name: NTF2 Pfam Description: Nuclear transport factor 2 (NTF2) domain
  misc_feature (318)..(388): Pfam Name: RRM_1 Pfam Description: RNA recognition motif (RRM, RBD, or RNP domain)
  misc_feature (1)..(480): Functional Homolog Of Ceres SEEDLINE ID no. ME13151 at SEQ ID NO: 1274
MAAPQVSPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAEVQPEADAVAPPLANGTATAPLQPAAPDYDAMPHEEPDVVENVAVPPEEEEEVYNPPLEEVEGGAVEEEQSVPEVINEVPNNVVPVVAPADAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 1297 - protein, 447 aa, Trifolium pratense
  misc_feature (1)..(447): Public GI ID no.84468278
  misc_feature (1)..(447): Bit score of 987.8 for HMM based on sequences of FIGURE 43.
  misc_feature (15)..(131): Pfam Name: NTF2 Pfam Description: Nuclear transport factor 2 (NTF2) domain
  misc_feature (297)..(366): Pfam Name: RRM_1 Pfam Description: RNA recognition motif (RRM, RBD, or RNP domain)
  misc_feature (1)..(447): Functional Homolog Of Ceres SEEDLINE ID no. ME13151 at SEQ ID NO: 1274
MAVSDGVQTPTPQVVGNAFVEQYYSILHQDPDQVHKFYHESSVLSRPEEDGTMTTVTTTAEIDKKIQSFDYTSYRVEVLSADAQPSYNSGVVVVVTGCLTGTDNVKRKFAQSFFLAPQDKGFYVLNDVFRYVDAYKSVDIETVPANDADESAPSEAFTPDPEPIHVAEDIPTIQPVIADTDTNISKEVSLPLENGKLSVTENVIPVNHVKESSHQEQMASIEKVPSNTQEDTPKKSFASIVSAYKDNSAPFLSRTSPAKPAVQPPRVHSVPAPEAPAPNMDIPSEKNNENGGRAHAIFVANLPMTATVEQLDRVFKKFGTIKRDGIQVRSNKGSCFGFVEFESAASLQSALEASPPVMLDNRRLSIEERRGRGGYRNDRNDNFRGRGNFGGGRGGGFNGRNDFDRRGEFSGRPRGGNNTGRSNGDAAPRSYQNGGGKVARQPPVKAQ

SEQ ID NO: 1298 - protein, 447 aa, Trifolium pratense
  misc_feature (1)..(447): Public GI ID no.84468454
  misc_feature (1)..(447): Bit score of 982.6 for HMM based on sequences of FIGURE 43.
  misc_feature (15)..(131): Pfam Name: NTF2 Pfam Description: Nuclear transport factor 2 (NTF2) domain
  misc_feature (297)..(366): Pfam Name: RRM_1 Pfam Description: RNA recognition motif (RRM, RBD, or RNP domain)
  misc_feature (1)..(447): Functional Homolog Of Ceres SEEDLINE ID no. ME13151 at SEQ ID NO: 1274
MAVSDGVQTPTPQVVGNAFVEQYYSILHQDPDQVHKFYHESSVLSRPEEDGTMTTVTTTAEIDKKIQSFDYTSYRVEVLSADAQPSYNSGVVVVVTGCLTGTDNVKRKFAQSFFLAPQDKGFYVLNDVFRYVDAYKSVDIETVTANDADESAPSEAFTPDPEPIHVAEDIPTIQPVIADTDTNISKEVSLPLENGKLSVTENVIPVNHVKESSHQEQMASIEKVPSNTQEDTPKKSFASIVSAYKDNSAPFLSRTSPAKPAVQPPRVHSVPAPEAPPPNMDIPSEKNNENGGRAHAIFVANLPMTATVEQLDRVFKKFGTIKRDGIQVRSNKGSCFGFVEFESAASLQSALEASPPVMLDNRRLSIEERRGRGGYRNDRNDNFRGRGNFGGGRGGGFNGRNDFDRRGEFSGRPRGGNNTGRSNGDAAPRSYQNGGGKVARQPPVKAQ

SEQ ID NO: 1299 - DNA, 1446 bp, Sorghum bicolor
  misc_feature (1)..(1446): Ceres ANNOT ID no.6036303
  misc_feature (1)..(1446): Encodes the peptide sequence at SEQ ID NO 1300
atggccgcgccgcagcctgccgcccccgcccccgaggcgccgccgtctgcgcaagtggtgggcaacgcgttcgtgcagcagtactacctcgtgctgcaccagtcgccggatctggtgtaccgcttctaccaggacgccagccgcctcgcccgccccgcatccgccgccggagccgccggcatggactccgtcaccaccatggaggcgatcagcgagaagataatggagatggacgtgtcgaaagcggagatcaggacggtggactcgcaggagtcgctaggcggcggcgtcactgtgctcgtcactggccacctcaccggtcgtgatggagtgcgccgcgagttctcgcagtccttcttcctcgcgccgcaggagaagggctacttcgtgctcaacgacatcttccgcttcgtcggggacatccctgcccctaccgccgttgaggcgcagccggaggcggatgctgtagtcccgcctgtggctgctccacttgccaacggcacagctactcctgctgtggagcctgccattcctgatgatcatgatgctgtgccacagcaggaaaatcatgttgtggaccgatcaccgcctcaacctgaggaggaggatgaggctgaggtttacaatccgccaccagaggaagtagtggatgaggaacaacctgttcctgaagtgataaatgaagttccaaacaatgtggcacctgtggcggctactacagttgccccagttttgcaggaggaggcaccaaagaagtcatatgcctcaattgtcaaagtcatgaaagaagttccattgcctgctcctgcacctcctactaggcctgcaccgcccaaaccagagaagcagtctccacctgctcctactcctgtcacagatgtaccgcctttcagttctaaccctgacaacagcaatatccaagagcctgaagttgatgctcatgcaatatatgtgaggaatttacctttaaatgccactgaaactcaactggaggatgagttcaagaagtttggtaccattaagcaaaatggcattcaagtcagaagcaacaagattcaaggcttctgttacggattcgttgagtttgaggattctacttctgtccagagtgctatagaggcttcccctgtaacaattggcggtcgtcaatgttatgttgaggaaaagaggacaccaggttcacggggctccagcagaggtggcaggtttgcaccaggcaggggcaacaacttcagaagtgaaggtaccagaggccgtggtaactacggtggaggaaggggctacgggaggggtgagttcagttacaggtcggattatggtggcagaagtggtggcagaggtggcccagcacgtggagctgatgtcggctaccagagggttgaccatgctggatatgctggtggtcgtggtggccgcacagcagctgctggtgcccctgcaaaatga

SEQ ID NO: 1300 - protein, 481 aa, Sorghum bicolor
  misc_feature (1)..(481): Ceres ANNOT ID no.6036303
  misc_feature (1)..(481): Bit score of 1186.2 for HMM based on sequences of FIGURE 43.
  misc_feature (20)..(137): Pfam Name: NTF2 Pfam Description: Nuclear transport factor 2 (NTF2) domain
  misc_feature (316)..(386): Pfam Name: RRM_1 Pfam Description: RNA recognition motif (RRM, RBD, or RNP domain)
  misc_feature (1)..(481): Functional Homolog Of Ceres SEEDLINE ID no. ME13151 at SEQ ID NO: 1274
MAAPQPAAPAPEAPPSAQVVGNAFVQQYYLVLHQSPDLVYRFYQDASRLARPASAAGAAGMDSVTTMEAISEKIMEMDVSKAEIRTVDSQESLGGGVTVLVTGHLTGRDGVRREFSQSFFLAPQEKGYFVLNDIFRFVGDIPAPTAVEAQPEADAVVPPVAAPLANGTATPAVEPAIPDDHDAVPQQENHVVDRSPPQPEEEDEAEVYNPPPEEVVDEEQPVPEVINEVPNNVAPVAATTVAPVLQEEAPKKSYASIVKVMKEVPLPAPAPPTRPAPPKPEKQSPPAPTPVTDVPPFSSNPDNSNIQEPEVDAHAIYVRNLPLNATETQLEDEFKKFGTIKQNGIQVRSNKIQGFCYGFVEFEDSTSVQSAIEASPVTIGGRQCYVEEKRTPGSRGSSRGGRFAPGRGNNFRSEGTRGRGNYGGGRGYGRGEFSYRSDYGGRSGGRGGPARGADVGYQRVDHAGYAGGRGGRTAAAGAPAK

SEQ ID NO: 1301 - DNA, 1605 bp, Arabidopsis thaliana
  misc_feature (1)..(1605): Ceres SEEDLINE ID no.ME13153
  misc_feature (1)..(1605): Ceres CLONE ID no.115046
  misc_feature (1)..(1605): Inplanta Sequence
  misc_feature (1)..(1605): Encodes the peptide sequence at SEQ ID NO. 1302
atatttttatgttcaacaattcagcataactcaaacacaatggtactcgcaaccaactctgactccgacgagcatttgcattccacttttgcttctagatatgtccgtgctgttgttcccaggttcaagatgcctgaccattgcatgcccaaagatgctgcttatcaagtgatcaatgatgagttgatgcttgatggtaatcccaggcttaacctagcctcctttgtcaccacttggatggaacctgagtgtgacaaactcatcatggattctgtcaataagaactatgttgatatggatgaatatcctgtcaccactgagctccagaaccggtgtgtaaatatgatagcaaactttttccatgctcccgttggagaagacgaggctgctattgggtgtggaactgttggttcatctgaggctataatgcttgctggtttggctttcaaaaggaaatggcaacataggagaaaagctcagggtctacctattgataagcctaacattgtcactggagccaatgttcaggtgtgctgggagaagtttgcaaggtactttgaggtagagctcaaagaggtgaaactaagtgaagactactatgttatggatccagctaaagctgtagagatggtggatgagaataccatctgtgttgcagcaattctaggatctacacttactggagagtttgaggacgttaagcaattgaacgatctcttagctgagaaaaacgcagagacaggatgggaaactcctattcatgttgatgcagccagtggaggattcattgctcctttcctctaccctgatcttgaatgggactttaggcttccatgggtgaagagtattaacgtcagtggtcacaagtatggacttgtgtatgcaggagttggttgggttgtctggagaacaaaagatgatttgccagaggaacttgtcttccacatcaactacttgggagctgatcaacccactttcactctcaacttctcaaaagggtcgagccaaatcattgctcagtactatcagtttatccgactaggctttgagggatacaagaacataatggaaaactgcatggataacgcaaggaggctaagagaaggaatagagatgacagggaagttcaacattgtgtccaaagatattggcgtgccactagtggcattctctctcaaagacagtagcaagcacacggtgtttgagatcgcagagtctttgagaaaattcgggtggatcataccggcttacactatgcctgcagatgcacagcacattgctgtgctcagagttgtgataagagaagactttagccgaggccttgcagatagactcatcacacatatcattcaggtgctgaaagagattgaagggcttcctagcaggattgcacatcttgctgcggctgcagcggttagtggtgatgatgaagaagttaaagtgaagactgccaagatgtccttggaggatatcactaagtattggaaacgccttgtggaacacaagagaaatattgtctgctaagcgcaagtcttattctttgcacttatatggtaataaggttttgatttagaccatttggcggtaataaggttttaatttttt

SEQ ID NO: 1302 - protein, 494 aa, Arabidopsis thaliana
  misc_feature (1)..(494): Ceres SEEDLINE ID no.ME13153
  misc_feature (1)..(494): Ceres CLONE ID no.115046
  misc_feature (1)..(494): Bit score of 1246.9 for HMM based on sequences of FIGURE 44.
  misc_feature (32)..(380): Pfam Name: Pyridoxal_deC Pfam Description: Pyridoxal-dependent decarboxylase conserved domain
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANFFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 1303 - protein, 494 aa, Citrus sinensis
  misc_feature (1)..(494): Public GI ID no.70609690
  misc_feature (1)..(494): Bit score of 1289.0 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(494): Functional Homolog Of Ceres SEEDLINE ID no. ME13153 at SEQ ID NO: 1302
MVLSKTFSESDESIHSTFASRYVRNSLPRFTMPENSIPKEAAYQIINDELMLDGNPRLNLASFVTTWMEPECDKLMMAAINKNYVDMDEYPVTTELQNRCVNIIARLFNAPLEDSETAVGVGTVGSSEAIMLAGLAFKRKWQNKRKAEGKPFDKPNIVTGANVQVCWEKFARYFEVELKEVKLSEGYYVMDPAKAVEMVDENTICVAAILGSTLNGEFEDVKLLNDLLTEKNKETGWDTPIHVDAASGGFIAPFLYPELEWDFRLPLVKSINVSGHKYGLVYAGIGWVVWRNKEDLPEELIFHINYLGADQPTFTLNFSKGSSQVIAQYYQLIRLGFEGYRNVMENCHENAMVLKEGLEKTGRFNIVSKDEGVPLVAFSLKDNKRHDEFEVAELLRRFGWIVPAYTMPADAQHITVLRVVIREDFSRTLAERLVLDITKVLHELDSLPSKVLVPASEQNGRNGKKTEIETQREVTTYWRKFVSERKANNKNKIC

SEQ ID NO: 1304 - DNA, 1696 bp, Gossypium hirsutum
  misc_feature (1)..(1696): Ceres CLONE ID no.1927524
  misc_feature (1)..(1696): Encodes the peptide sequence at SEQ ID NO 1305
acacgttcaactgcaaaaaaagaaacaatgttggcagctacaaacccaacagaggagcatgtgcactccacttttgcttctagatatgttcgcgctcctgttccaaggttcaagatgccggagaagtcgattccaaaggacgcggcgtatcaagtaatacatgatgagcttatgctggatggaaatccgaggttgaacttggcttcatttgttacaacatggatggaacctgagtgtgataagcttatgatggctgcaattaataagaactatgttgacatggatgaataccctgtcaccactgaactccagaatcgatgtgtaaacatgattgcaaacctgttccatgctccggtcggggaagaagagacagcagtaggtgtgggaacagttggttcctctgaggctataatgctggctggattagcttttaaaaggaggtggcaacataagagaaaaacagagggaaagcccactgataatcccaacatagtcacgggagctaacgtgcaggtttgctgggagaagtttgcaaggtattttgaggtagggctgaaggaagtaaagctgaaagagggatattacgttatggacccagaacaagcggttgagctagtagatgagaacaccatatgtgtagcagctattctgggatcaacgctgacaggagagtttgaggacgtgaagacgttgaatgacctccttatgaagaaaaatgaggagaccggttggggaacccccattcatgtagacgctgccagcggaggatttattgctccttttctttacccggatctcgagtgggatttccggctgcctttagtgaagagcatcaatgtgagtggccacaaatatggcctcgtctatgctggtgttggttgggttgtttggaggaacaaagaggatttgcctgatgatcttgtctttcacatcaactaccttggctccgatcaacccactttcaccctcaacttctccaaaggctctagtcaaataattgctcagtattaccagtttctacgccttggttttgaggggtacaagaacataattgagaactgcatggagaatatgaaagtgcttaaacaaggcatagagaacaccgggaggtttaacatattatcaaaggatataggagtaccgctagtggccttctctctaaaagatagcagcaaacatacagtgttcgagatagccgagaacttgcgaaggttcggatggatccttccggcttatacaatgcctgccaatgcacagcacgtggctgtcctccgagcagtgatccgagaagatttcagccatgggctggcgaaaagactggtggcacacattgagcaagtcctcaaggaaatggatggcctcccgagtggccttcaacataagaaggccgaaagagaaactcaggaagaggtctttaggtgctggaaacgccttgttgatcgcaagatagctggagtctgttgattttttcatctgggtttcccaacaccacgggccttcttcaacaattttttagctttccataacaattacgctactctttaaataaacattttatagtatctcggctattatgtaggtttcccaggcgatgggtggattcgtggggtcttgaaatggagcatcatcactccattaaaaggcacattaatttctccattgtttaaataaacatttactttagatttttctccct

SEQ ID NO: 1305 - protein, 478 aa, Gossypium hirsutum
  misc_feature (1)..(478): Ceres CLONE ID no.1927524
  misc_feature (1)..(478): Bit score of 1241.0 for HMM based on sequences of FIGURE 44.
  misc_feature (31)..(379): Pfam Name: Pyridoxal_deC Pfam Description: Pyridoxal-dependent decarboxylase conserved domain
  misc_feature (31)..(379): Pfam Name: Pyridoxal_deC Pfam Description: Pyridoxal-dependent decarboxylase conserved domain
  misc_feature (1)..(478): Functional Homolog Of Ceres SEEDLINE ID no. ME13153 at SEQ ID NO: 1302
MLAATNPTEEHVHSTFASRYVRAPVPRFKMPEKSIPKDAAYQVIHDELMLDGNPRLNLASFVTTWMEPECDKLMMAAINKNYVDMDEYPVTTELQNRCVNMIANLFHAPVGEEETAVGVGTVGSSEAIMLAGLAFKRRWQHKRKTEGKPTDNPNIVTGANVQVCWEKFARYFEVGLKEVKLKEGYYVMDPEQAVELVDENTICVAAILGSTLTGEFEDVKTLNDLLMKKNEETGWGTPIHVDAASGGFIAPFLYPDLEWDFRLPLVKSINVSGHKYGLVYAGVGWVVWRNKEDLPDDLVFHINYLGSDQPTFTLNFSKGSSQIIAQYYQFLRLGFEGYKNIIENCMENMKVLKQGIENTGRFNILSKDIGVPLVAFSLKDSSKHTVFEIAENLRRFGWILPAYTMPANAQHVAVLRAVIREDFSHGLAKRLVAHIEQVLKEMDGLPSGLQHKKAERETQEEVFRCWKRLVDRKIAGVC

SEQ ID NO: 1306 - DNA, 1811 bp, Gossypium hirsutum
  misc_feature (1)..(1811): Ceres CLONE ID no.1856973
  misc_feature (1)..(1811): Encodes the peptide sequence at SEQ ID NO 1307
atcactctttgcttaacttcactccattcccaattcacactatttactatttagaataaattactaaaataaaaatcccctttccaaacccaaaaaagctcgtagtaaacgaaacagcagcaaaaatggtgctcacaaccacgaacccggcgccgaagcagtttgttgaatccagtacctttgcttccagatatgtccgccaacctcttcccaggttccagatgccagaaaattcaatgcccaaggaagcagcctatcaagtaataactgatgaactgatgcttgatggaaatcccaggttgaacttagcatcatttgtgaccacatggatggaacccgagtgcgataaactcatgatggcttcgataaacaagaactacgtcgacatggacgaataccctgtcaccactgagcttcagaatcgatgtgtaaacatgatagcaaacttatttaatgctcctatcgggagcggtgaagccgcggttggtgtcgggacagttggttcctctgaggcaataatgctggcaggattagcctttaaaaggaagtggcaacaaaagatgaaatcacagggaaaaccgtatgataagcctaacatagtcaccggagcgaatgtgcaggtttgttgggagaagtttgcgaggtatttcgaggttgaattgaaggaagtgaagttgaaagagggatactatgtgatggaccctgtgaaagcgtttgaaatggttgacgagaataccatatgtgttgcagcaattctcggatccaccctaacaggggagtttgagaatgtgaagctccttaatgaacttctcaccaagaagaataaggaaaccggttgggataccccaatacatgtggatgctgctagtggagggttcattgctccctttgtttacccgaaaatcgaatgggatttccgcctgccgttagtaaaaagcatcaatgtcagtgggcacaagtatggccttgtatatgctggtatcggttgggtcgtgtggagaagcaaggaggatttgccagacgatctcgtatttcacatcaactaccttggatccgatcagcccacattcaccttaaacttctctaaaggctctagtcaaatcatagctcaatattatcagcttattcggctcggttttgagggatacaagagtatcatggaaaactgcatcgggaatgcaagaatcctgaaggaagggatagaaaaaacgggacgattcgaagtcgtctccaaagacgtgggcgttcccctcgtggcttttgctctaaaagacagcactaaatacacggtgtttcaaatatccgatgccttgaggaagttcgggtggatcgtccctgcatacacgatgcctgcagatgccgaacacatcgcagtcctgcgcgtggttgttagggaagacttcagttgtagcttggccgagaggcttatctcgcacattcaagaggtgttgaaggaactcgactcgcttccgagtcaaatcgtgaaagattctcacgttgtcaccgttgcgaaagaagtggtaggggagaacaaagatgcggaggcagctaaaatgggtgatagaaagattcaagaaaaggttactaagcaatggaggcattttgtgaaaactaagaagacgggtgtgtgttaaaagactcctacaaaatctatgttctatcgtataatgtttgtagctatatttccaaactgcagcataattgacctattacatgttaataatctcgttgtgtcatgcatctgtaacatatgttgtgtttgaggaacattgtgttcaatttaagcattatatgtatgtttttatttatcg

SEQ ID NO: 1307 - protein, 502 aa, Gossypium hirsutum
  misc_feature (1)..(502): Ceres CLONE ID no.1856973
  misc_feature (1)..(502): Bit score of 1214.5 for HMM based on sequences of FIGURE 44.
  misc_feature (34)..(382): Pfam Name: Pyridoxal_deC Pfam Description: Pyridoxal-dependent decarboxylase conserved domain
  misc_feature (1)..(502): Functional Homolog Of Ceres SEEDLINE ID no. ME13153 at SEQ ID NO: 1302
MVLTTTNPAPKQFVESSTFASRYVRQPLPRFQMPENSMPKEAAYQVITDELMLDGNPRLNLASFVTTWMEPECDKLMMASINKNYVDMDEYPVTTELQNRCVNMIANLFNAPIGSGEAAVGVGTVGSSEAIMLAGLAFKRKWQQKMKSQGKPYDKPNIVTGANVQVCWEKFARYFEVELKEVKLKEGYYVMDPVKAFEMVDENTICVAAILGSTLTGEFENVKLLNELLTKKNKETGWDTPIHVDAASGGFIAPFVYPKIEWDFRLPLVKSINVSGHKYGLVYAGIGWVVWRSKEDLPDDLVFHINYLGSDQPTFTLNFSKGSSQIIAQYYQLIRLGFEGYKSIMENCIGNARILKEGIEKTGRFEVVSKDVGVPLVAFALKDSTKYTVFQISDALRKFGWIVPAYTMPADAEHIAVLRVVVREDFSCSLAERLISHIQEVLKELDSLPSQIVKDSHVVTVAKEVVGENKDAEAAKMGDRKIQEKVTKQWRHFVKTKKTGVC

SEQ ID NO: 1308 - DNA, 1857 bp, Gossypium hirsutum
  misc_feature (1)..(1857): Ceres CLONE ID no.1927594
  misc_feature (1)..(1857): Encodes the peptide sequence at SEQ ID NO 1309
  misc_feature (1349)..(1349): k is g or t/u
  misc_feature (1350)..(1350): k is g or t/u
aaaaaacccagcaacagcggtttttagctttatacagatctttcatttcattcaaattttacagtttttttcgtgtttcttgacacatcaaccatggtgctatccaagacagcttctcaatctgatgtctcagttcactccacttttgcctctcgttatgtccgagaccaacttcctaggttcaggatgccagagaactcaataccaaaagacgctgcatatcagatcatcaacgatgaactgatgcttgatgggaacccgaggttgaaccttgcctcttttgtcactacctggatggagcctgaatgtaataagcttattatggatgccattaacaagaactatgtcgacatggatgagtaccctgtcaccaccgagcttcagaatcggtgtgtgaacatgatagcacatttgttcaatgcaccacttggggactcggagactgccgttggagtgggaaccgttggttcatccgaggcaatcatgttggctggccttgccttcaagaggaagtggcaaaacaagcgtaaagctgaaggcaaaccatatgacaagcccaacatcgtaaccggagccaatgttcaagtgtgctgggagaaattcgccaggtactttgaagtggagttgaaggaagtgaagctaagggaaggttactatgtaatggaccctgccaaagctgtggaaatggttgatgaaaacaccatctgtgtagcagccatattgggttcaaccctcaatggtgaatttgaagacgtcaagcttttaaacgatctcttggtagaaaagaacaaggaaactggatgggataccccaattcatgttgatgcagctagtggtggattcattgcaccatttttgtacccagagcttgagtgggactttaggcttccacttgtgaagagcatcaatgttagtggccacaaatatggtcttgtttatgctggaattggttgggttatctggaggaacaaggaagacttgcctgaagaacttattttccacattaactaccttggagctgatcaacccactttcactctcaatttctccaaaggttctagccaagtcattgctcagtattaccagctaattcgtttgggttatgagggatacagaaatataatggagaactgtcatgaaaacgctatggtcctaaaagaagggttggagaaaacaggtcgcttcaacattgtgtcaaaggacgaaggggttccactcgtggccttctctctcaaggacaacaagcgccatgatgaattcgagatatccgaaatgctgcgccgatttggatggatcgtgccggcctacaccatgccggcggatgctcaacacatcacggtgctgcgtgkkgtgatcagggaagactttctcccgcaccttggcggagcgtcttgtgattgacatccaaaaggtgcttcatgaactggatacactcccagcaaaggttaatgccaaactggctatggctgaggaagaaaatagcaaaaatggcacagtgaagaagactgccattgaaacccagagggaaataacttcttactggaagaaatttgtgagcgagaggaagactaacaagaataaaatctgttagaacttatcgtaacaccaactttccctttttacttttagtttgccactttgtttccaccatttaattttcaagcttcggcgtattttctgagttcaaccattaatgtaatcgaagaattatagccccatttccgtaatttaatgatccaaattgccagtaaaaatagttagcacttttataaatattctcaacaaatagtaaattatgtattaaaatgtccctttttacccggagtgtgttttggcattacatgctaatactgtaat

SEQ ID NO: 1309 - protein, 435 aa, Gossypium hirsutum
  misc_feature (1)..(435): Ceres CLONE ID no.1927594
  misc_feature (1)..(435): Bit score of 1144.2 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(435): Functional Homolog Of Ceres SEEDLINE ID no. ME13153 at SEQ ID NO: 1302
  misc_feature (419)..(419): Xaa is any aa, unknown or other
MVLSKTASQSDVSVHSTFASRYVRDQLPRFRMPENSIPKDAAYQIINDELMLDGNPRLNLASFVTTWMEPECNKLIMDAINKNYVDMDEYPVTTELQNRCVNMIAHLFNAPLGDSETAVGVGTVGSSEAIMLAGLAFKRKWQNKRKAEGKPYDKPNIVTGANVQVCWEKFARYFEVELKEVKLREGYYVMDPAKAVEMVDENTICVAAILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGYEGYRNIMENCHENAMVLKEGLEKTGRFNIVSKDEGVPLVAFSLKDNKRHDEFEISEMLRRFGWIVPAYTMPADAQHITVLRXVIREDFLPHLGGASCD

SEQ ID NO: 1310 - DNA, 1506 bp, Populus balsamifera subsp. trichocarpa
  misc_feature (1)..(1506): Ceres ANNOT ID no.1467310
  misc_feature (1)..(1506): Encodes the peptide sequence at SEQ ID NO 1311
atggtgatctctactgccgcaacagattccgatgagaatttgtactccacttttgcttccagatatgtacgcactgcacttcccaggttcaagatgccagagaattcaatgccaaaggatgcagcgtaccaagtgataaatgatgagctgatgctggatgggaatccaaggctcaacttggcatcttttgtgacaacatggatggagcctgagtgtaatgatctcatcatggcttccattaacaagaattatgtcgacatggatgagtaccctgttaccacagagctccagaatcgatgtgtaaatataatagcccacctgttcaatgctcctgttggagaaaaagaaactgcagttggtgtcgggactgtgggatcatcagaggcaataatgctggctggattagcttttaaaaggaagtggcagaataagaggaaagcagagggcaaaccgtacgataagcccaacatagtcacaggagctaatgtgcaggtttgctgggagaaatttgcaaggtacttcgaagttgagctgaaggaggtgaagctgacagaagggtattatgtgatggacccagtcaaagcggttgagatggtggacgagaacacaatctgtgtggcagccattttgggatcaacacttactggagagttcgaagatgtgaagcttctcaatgacctcctctccaaaaagaacaaggagactggttggaatacgccaattcatgttgatgctgccagtggagggttcattgctcctttcatttggcctgatcttgaatgggactttcgtttgccattggtgaagagcatcaatgttagcggtcacaaatatggccttgtttatgctggtgttggttgggttgtgtggaggaccaaggaggacttgccagatgagctaatatttcacatcaactaccttggatctgatcaacctactttcaccctcaacttttcgaaaggttcaggtcagataattgctcagtattatcagtttatacggcttggctttgagggttacaaaagaataatggagaactgcctggagaatgcgagagtgctgagagaaggattagaaaaaacagggcggtttgacattgtctccaaggataagggggtgcctcttgtggccttttctttgaaggacagtagcaagcatactgtgtttgaaatagctgagagtttgagaaggttcgggtggataatcccagcctatacaatgcctgctaatgcccaacacattgctgtcctccgtgtggtggtcagggaagacttcaatcggagtctggcggagagacttgtctcgcacatcgatcaagtcatgaaggaaacagactcgcttcctagccgtgtcgctgttcaagcatcgcgcattgttactgttgacgaaacacaagataacatggatggcaagaagactgttaaaaagagttcaagggagatacaggaggaagtcaccctgtactggaggcggcttgccagtgagaagagaactggagcgtgctag

SEQ ID NO: 1311 - protein, 501 aa, Populus balsamifera subsp. trichocarpa
  misc_feature (1)..(501): Ceres ANNOT ID no.1467310
  misc_feature (1)..(501): Bit score of 1267.5 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(501): Functional Homolog Of Ceres SEEDLINE ID no. ME13153 at SEQ ID NO: 1302
MVISTAATDSDENLYSTFASRYVRTALPRFKMPENSMPKDAAYQVINDELMLDGNPRLNLASFVTTWMEPECNDLIMASINKNYVDMDEYPVTTELQNRCVNIIAHLFNAPVGEKETAVGVGTVGSSEAIMLAGLAFKRKWQNKRKAEGKPYDKPNIVTGANVQVCWEKFARYFEVELKEVKLTEGYYVMDPVKAVEMVDENTICVAAILGSTLTGEFEDVKLLNDLLSKKNKETGWNTPIHVDAASGGFIAPFIWPDLEWDFRLPLVKSINVSGHKYGLVYAGVGWVVWRTKEDLPDELIFHINYLGSDQPTFTLNFSKGSGQIIAQYYQFIRLGFEGYKRIMENCLENARVLREGLEKTGRFDIVSKDKGVPLVAFSLKDSSKHTVFEIAESLRRFGWIIPAYTMPANAQHIAVLRVVVREDFNRSLAERLVSHIDQVMKETDSLPSRVAVQASRIVTVDETQDNMDGKKTVKKSSREIQEEVTLYWRRLASEKRTGAC

SEQ ID NO: 1312 - protein, 494 aa, Arabidopsis thaliana
  misc_feature (1)..(494): Public GI ID no.15229517
  misc_feature (1)..(494): Bit score of 1248.6 for HMM based on sequences of FIGURE 44.
  misc_feature (32)..(380): Pfam Name: Pyridoxal_deC Pfam Description: Pyridoxal-dependent decarboxylase conserved domain
  misc_feature (1)..(494): Functional Homolog Of Ceres SEEDLINE ID no. ME13153 at SEQ ID NO: 1302
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANLFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 1313 - protein, 493 aa, Brassica juncea
  misc_feature (1)..(493): Public GI ID no.45935270
  misc_feature (1)..(493): Bit score of 1278.5 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(493): Functional Homolog Of Ceres SEEDLINE ID no. ME13153 at SEQ ID NO: 1302
MVLSKTASESDVSIHSTFASRYVRTSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGIHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHDEFEVAETLRRFGWIVPAYTMPADAQHVTVLRVVIREDFSRTLAERLVADFEKVLHELDTLPARVQAKMANGNANGVKKTEEETTREVTAYWKKFVEAKKSNKNRIC

SEQ ID NO: 1314 - protein, 493 aa, Brassica juncea
  misc_feature (1)..(493): Public GI ID no.45935272
  misc_feature (1)..(493): Bit score of 1261.5 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(493): Functional Homolog Of Ceres SEEDLINE ID no. ME13153 at SEQ ID NO: 1302
MVLSKTASGTDVSVHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVKLREGYYVMDPEKAVEMVDENTICVAAILGSTLTGEFEDVKLLNDLLVEKNKQTGWDTGNHVDAASGGFIAPFLYPELEWDFRLPLVKSINVSGHKYGLVYAGIGWVVWRTKSDLPDELIFHINYLGADQPTFTLNFSKGSSQVIAQYYQLIRLGFEGYRNVMDNCRENMMVLREGLEKTGRFNIVSKENGVPLVAFSLKDSSRHNEFEVAETLRRFGWIVPAYTVPADAEHVTVLRVVIREDFSRTLAERLVADFEKVLHELDTLPARVRAKMANGKAKVVKQTEEETTREVTAYWKKFVETKKTNQNKIC

SEQ ID NO: 1315 - protein, 494 aa, Brassica juncea
  misc_feature (1)..(494): Public GI ID no.45935268
  misc_feature (1)..(494): Bit score of 1235.3 for HMM based on sequences of FIGURE 44.
  misc_feature (34)..(381): Pfam Name: Pyridoxal_deC Pfam Description: Pyridoxal-dependent decarboxylase conserved domain
  misc_feature (1)..(494): Functional Homolog Of Ceres SEEDLINE ID no. ME13153 at SEQ ID NO: 1302
MVLSRAATESGENVCSTFGSRYVRTALPKHKIGESSIPKEAAYQIIKDELMLDGNPRLNLASFVTTWMEPECDKLIMESINKNYVDMDEYPVTTELQNRCVNMIARLFNAPLEETETAMGVGTVGSSEAIMLAGLAFKRNWQNKRKAEGKPYDKPNIVTGANVQVCWEKFARYFEVELKEVKLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRTQQDLPDELIFHINYLGADQPTFTLNFSKGSSQIIAQYYQLIRLGFEGYKNVMENCRENMVVLREGIEKTERFNIVSKEVGVPLVAFSLKDHSFHNEFEISEMLRRFGWIVPAYTMPADAQHITVLRVVIREDFSRTLAERLVADIVKVLHELDTLPSKISKKMGAEDFGNVKGKKVDRDVLMEVIVGWRKFVKDRKKMNGVC

SEQ ID NO: 1316 - DNA, 1677 bp, Glycine max
  misc_feature (1)..(1677): Ceres CLONE ID no.718446
  misc_feature (1)..(1677): Encodes the peptide sequence at SEQ ID NO 1317
agcgtttcacacctagacaattggctcagaagaaaagaaaagcaaccaaaaatggttctcacatccactgccacacacccagatgaacaagatcagagcctaaactatacttttgcttccagatatgtgcgtgaacctattccaaagttcaagatgccggagaaatccataccaaaagatgctgcttatcagataataaacgatgagttgatgttggatggtgcaccaaggctcaacttggcctcgtttgtgaccacttggatggagcctgagtgtgacaagctcataatggcttcacttaacaagaactacgttgacatggatgagtatcctgtcaccactgagctccagaaccggtgtgttaatatcatagcaaatctattccatgctcctataagtgatgatgagactgcagtaggtgtgggaactgtggggtcatcggaggcaataatgttggcaggtctagcttttaaaaggaaatggcagacaaagagaaaagcagaaggcaaaccatatgataagcccaacatagtaactggggctaatgtgcaggtttgttgggaaaaatttgcaaggtactttgaggtagagctcaaggaagtgaaactcaaagaaggatactatgtgatggaccctgcgaaagcagttgaaatggtagatgagaacaccatctgtgttgcagccattttggggtcaactatgaccggagagtttgaggatgtgaagcttctcgatgaacttcttactaaaaagaacaatgagacaggttgggataccccaattcatgtagatgctgccagtggggggtttattgccccatttctatatcctgatttagagtgggacttccgtttgccgttggtgaaaagcatcaatgttagttgtcacaagtatggtcttgtctaccctggtgttggttgggttgtatggaggagcaaagatgacttgccagatgaacttgtttttcacataaattatcttggatctgatcagcccactttcacattgaatttctccaaaggatctagtcaaattattgctcaatattatcaattgattcggcttggctttgagggttacaaaaatatcatggaaaattgctgggagaatgcaagagttctgaaggaaggaatcgagagaacaggtcggtttaacatcatctccaaggatatcggtgtgccacttgtagccttctccttgcaagacagtagtcaacacacagtgtttgagatagcagaccatctgagaaaattcgggtggatagttcctgcctatacaatgccaccagatgctcaacacattgctgtccttcgggtggtgatcagggaggatttcagccgcggcttggccgagagactcgccgctgacatagagaaagttgtgaagctcttggacacacttcctagccccctcactaccaaagctgttcatatcacagctatcactagtgagactggtgagaagattaagaaagctgcaatagagactcagaaagagattgctttctactggaagcgacttgtggatggcaagagacttggagcatgctaggcttaccaaatcttggccttttggccaccttgctatgagttatggtgctttgtttcttatctttgaggatatgtgagtgtgtaatggctttgtagcaataagcaatgccaatgcatgatggattct

SEQ ID NO: 1317 - protein, 499 aa, Glycine max
  misc_feature (1)..(499): Ceres CLONE ID no.718446
  misc_feature (1)..(499): Bit score of 1250.7 for HMM based on sequences of FIGURE 44.
  misc_feature (36)..(384): Pfam Name: Pyridoxal_deC Pfam Description: Pyridoxal-dependent decarboxylase conserved domain
  misc_feature (1)..(499): Functional Homolog Of Ceres SEEDLINE ID no. ME13153 at SEQ ID NO: 1302
MVLTSTATHPDEQDQSLNYTFASRYVREPIPKFKMPEKSIPKDAAYQIINDELMLDGAPRLNLASFVTTWMEPECDKLIMASLNKNYVDMDEYPVTTELQNRCVNIIANLFHAPISDDETAVGVGTVGSSEAIMLAGLAFKRKWQTKRKAEGKPYDKPNIVTGANVQVCWEKFARYFEVELKEVKLKEGYYVMDPAKAVEMVDENTICVAAILGSTMTGEFEDVKLLDELLTKKNNETGWDTPIHVDAASGGFIAPFLYPDLEWDFRLPLVKSINVSCHKYGLVYPGVGWVVWRSKDDLPDELVFHINYLGSDQPTFTLNFSKGSSQIIAQYYQLIRLGFEGYKNIMENCWENARVLKEGIERTGRFNIISKDIGVPLVAFSLQDSSQHTVFEIADHLRKFGWIVPAYTMPPDAQHIAVLRVVIREDFSRGLAERLAADIEKVVKLLDTLPSPLTTKAVHITAITSETGEKIKKAAIETQKEIAFYWKRLVDGKRLGAC

SEQ ID NO: 1318 - protein, 504 aa, Medicago truncatula
  misc_feature (1)..(504): Public GI ID no.92875133
  misc_feature (1)..(504): Bit score of 1253.3 for HMM based on sequences of FIGURE 44.
  misc_feature (34)..(381): Pfam Name: Pyridoxal_deC Pfam Description: Pyridoxal-dependent decarboxylase conserved domain
  misc_feature (1)..(504): Functional Homolog Of Ceres SEEDLINE ID no. ME13153 at SEQ ID NO: 1302
MVLSETATHMDASVHSTFASRYVRTSLPRFKMGENSIPKEAAYQIINDELMLDGNPRLNLASFVTTWMEPECDKLIMASINKNYVDMDEYPVTTELQNRCVNMIAHLFNAPLEDSEPAVGVGTVGSSEAIMLAGLAFKRKWQNRRKSEGKSCENPNIVTGANVQVCWEKFARYFEVELKEVKLRDGYYVMDPEKAAEMVDENTICVAAILGSTLNGEFEDVKRLNDLLVEKNAETGWDTPIHVDAASGGFIAPFLYPELVWDFRLSLVKSINVSGHKYGLVYAGIGWIIWRSKEDLPEELIFHINYLGADQPTFTLNFSKGSSQVIAQYYQLIRLGYEGYRNVMENCRDNMMVLKDGLEKTERFEIVSKDEGVPLVAFTLKDHNNFNEFQISDMLKRHGWIIPAYTMPPDAEHVTVLRVVIREDFSRTFAERLVIDITRVIHELDLVPSRVVSTNTITVTGGEEDADNDGTVTIANQSVLETQRKITTAWKKFVMNRKKTNGVC

SEQ ID NO: 1319 - protein, 502 aa, Solanum lycopersicum
  misc_feature (1)..(502): Public GI ID no.1706318
  misc_feature (1)..(502): Bit score of 1249.1 for HMM based on sequences of FIGURE 44.
  misc_feature (34)..(382): Pfam Name: Pyridoxal_deC Pfam Description: Pyridoxal-dependent decarboxylase conserved domain
  misc_feature (1)..(502): Functional Homolog Of Ceres SEEDLINE ID no. ME13153 at SEQ ID NO: 1302
MVLTTTSIRDSEESLHCTFASRYVQEPLPKFKMPKKSMPKEAAYQIVNDELMLDGNPRLNLASFVSTWMEPECDKLIMSSINKNYVDMDEYPVTTELQNRCVNMLAHLFHAPVGDDETAVGVGTVGSSEAIMLAGLAFKRKWQSKRKAEGKPFDKPNIVTGANVQVCWEKFARYFEVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPRLPTKAVRVTAEEVRDDKGDGLHHFHMDTVETQKDIIKHWRKIAGKKTSGVC

SEQ ID NO: 1320 - protein, 496 aa, Nicotiana tabacum
  misc_feature (1)..(496): Public GI ID no.3252856
  misc_feature (1)..(496): Bit score of 1289.8 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(496): Functional Homolog Of Ceres SEEDLINE ID no. ME13153 at SEQ ID NO: 1302
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 1321 - protein, 496 aa, Nicotiana tabacum
  misc_feature (1)..(496): Public GI ID no.21327029
  misc_feature (1)..(496): Bit score of 1286.3 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(496): Functional Homolog Of Ceres SEEDLINE ID no. ME13153 at SEQ ID NO: 1302
MVLSKTASESDVSIHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 1322 - protein, 496 aa, Nicotiana tabacum
  misc_feature (1)..(496): Public GI ID no.13310813
  misc_feature (1)..(496): Bit score of 1284.8 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(496): Functional Homolog Of Ceres SEEDLINE ID no. ME13153 at SEQ ID NO: 1302
MVLSKTASESDVSIHSTFASRYVRTSLPRFKMPENSIPKEAAYQIINDELMLDGNPRLNLASFVTTWMEPECNKLMMDSINKNYVDMGEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITAAWKKFVADKKKKTNGVC

SEQ ID NO: 1323 - protein, 496 aa, Nicotiana tabacum
  misc_feature (1)..(496): Public GI ID no.1777921
  misc_feature (1)..(496): Bit score of 1284.9 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(496): Functional Homolog Of Ceres SEEDLINE ID no. ME13153 at SEQ ID NO: 1302
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGEFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 1324 - protein, 491 aa, Nicotiana tabacum
  misc_feature (1)..(491): Public GI ID no.13752462
  misc_feature (1)..(491): Bit score of 1265.1 for HMM based on sequences of FIGURE 44.
  misc_feature (34)..(381): Pfam Name: Pyridoxal_deC Pfam Description: Pyridoxal-dependent decarboxylase conserved domain
  misc_feature (1)..(491): Functional Homolog Of Ceres SEEDLINE ID no. ME13153 at SEQ ID NO: 1302
MVLSKTSSESDVSVHSTFASRYVRTSLPRFEMAENSIPKEAAFQIINDELMLDGNPRLNLASFVTTWMEPECDKLMMDSINKNYVDMDEYPVTTELQNRCVNMIARLFNAPLEEKETAVGVGTVGSSEAIMLAGLAFKRNWQNKRKAEGKPYNKPNIVTGANVQVCWEKFANYFEVELKEVKLREGYYVMDPVQAVEMVDENTICVAAILGSTLNGEFEDVKLLNDLLIEKNKQTGWNTPIHVDAASGGFIAPFLYPELEWDFRLPLVKSINVSGHKYGLVYAGIGWVIWRTKQDLPEELIFHINYLGADQPTFTLNFSKGSSQVIAQYYQLIRLGYEGYRNVMENCRENAIVLREGLEKTGRFNIVSKDEGVPLVAFSLKDNSRHNEFEVSETLRRFGWIVPAYTMPADAQHVTVLRVVIREDFSRTLAERLVLDIVKVLHELDTLPARLSAKLEEVKLVKNGKKFELEVQREVTNYWKKFVLARKAPVC

SEQ ID NO: 1325 - protein, 496 aa, Nicotiana tabacum
  misc_feature (1)..(496): Public GI ID no.3252854
  misc_feature (1)..(496): Bit score of 1264.4 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(496): Functional Homolog Of Ceres SEEDLINE ID no. ME13153 at SEQ ID NO: 1302
MVLSKTASESDVSVHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLEKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVLAYTMPPNAQHVTVLRVVIREDFSRTLAERLVIDIEKVFHGVDTLPARVNAKLAVAEANGSGVHKKTDREVQLEITTAWLKFVADKKKKTNGVC

SEQ ID NO: 1326 - protein, 500 aa, Petunia x hybrida
  misc_feature (1)..(500): Public GI ID no.1169238
  misc_feature (1)..(500): Bit score of 1286.3 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(500): Functional Homolog Of Ceres SEEDLINE ID no. ME13153 at SEQ ID NO: 1302
MVLSKTVSQSDVSIHSTFASRYVRTSLPRFKMPDNSIPKEAAYQIINDELMLDGNPRLNLASFVTTWMEPECDKLMMDSINKNYVDMDEYPVTTELQNRCVNMIAHLFNAPLEDGETAVGVGTVGSSEAIMLAGLAFKRKWQNKMKAQGKPCDKPNIVTGANVQVCWEKFARYFEVELKEVKLSEGYYVMDPEKAVEMVDENTICVAAILGSTLNGEFEDVKRLNDLLVEKNKETGWDTPIHVDAASGGFIAPFIYPELEWDFRLPLVKSINVSGHKYGLVYAGIGWVVWRNKDDLPDELIFHINYLGADQPTFTLNFSKGSSQVIAQYYQLIRLGYEGYKNVMENCQENASVLREGLEKTGRFNIISKEIGVPLVAFSLKDNRQHNEFEISETLRRFGWIVPAYTMPPNAQHITVLRVVIREDFSRTLAERLVRDIEKVLHELDTLPARVNAKLAVAEEQAAANGSEVHKKTDSEVQLEMITAWKKFVEEKKKKTNRVC

SEQ ID NO: 1327 - protein, 490 aa, Hordeum vulgare
  misc_feature (1)..(490): Public GI ID no.31296711
  misc_feature (1)..(490): Bit score of 1202.8 for HMM based on sequences of FIGURE 44.
  misc_feature (36)..(383): Pfam Name: Pyridoxal_deC Pfam Description: Pyridoxal-dependent decarboxylase conserved domain
  misc_feature (1)..(490): Functional Homolog Of Ceres SEEDLINE ID no. ME13153 at SEQ ID NO: 1302
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQDRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGQQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 1328 - protein, 424 aa, Hordeum vulgare
  misc_feature (1)..(424): Public GI ID no.55832255
  misc_feature (1)..(424): Bit score of 926.4 for HMM based on sequences of FIGURE 44.
  misc_feature (100)..(317): Pfam Name: Pyridoxal_deC Pfam Description: Pyridoxal-dependent decarboxylase conserved domain
  misc_feature (1)..(424): Functional Homolog Of Ceres SEEDLINE ID no. ME13153 at SEQ ID NO: 1302
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 1329 - DNA, 1955 bp, Zea mays
  misc_feature (1)..(1955): Ceres CLONE ID no.1468893
  misc_feature (1)..(1955): Encodes the peptide sequence at SEQ ID NO 1330
gaccgcgtcgggcatcggttcctgctctgtgctatactgctatcccctcccccaagccgccaccaccaccagcagcggaaccccccgccctcgttcctcccccgccggcgagagatcgacgagatggtgctgtcacacggcgtcggtggctccgatgagtccgtccactcgacgttcgcgtcccgctacgtccgcacctcccttcctaggtaccggatgccggagcagtcgatccccaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgtcaccaccgagctgcagaaccggtgcgtgaacatgatcgcgcatctcttcaatgctcctctcggggacgctgaaacggctgttggagtgggcaccgtcggctcgtccgaggccatcatgctggctgggctggcgttcaagaggcgttggcagaacaagatgaaggcggccggcaagccctgcgacaagccaaacattgtcaccggcgccaacgtccaagtttgctgggagaagttcgcgcgctacttcgaggtcgagctgaaggaagtgaagctgagcgacggctactacgtcatggacccgcagaaggcagtggacatggtggacgagaacaccatctgtgtcgcggccatcctcggttccacgctgaacggcgagttcgaggacgtgaagctgctcaacgacctgctcaccaagaagaacgcggagacaggctgggacacgccgatccacgtggacgcggcgagcggcgggttcatcgcgccgttcctgtacccggaactggagtgggacttccgactgccgctcgtgaagagcatcaacgtcagtggacacaagtatggtctggtctacgccggcatcgggtggtgcatctggaggaccaaggtggacctgccggaggagctcatcttccacatcaactacctcggcgccgaccagcccaccttcaccctcaacttctccaaaggttccagccaggttattgcacagtactaccagctgatccgccttggctttgaaggttacaagaacatcatggagaactgccaggagaacgcgacggttctgaagcaaggtctggagaagacggggaagttcaacatcgtgtccaaggacaacggcgtgccgctggtggccttctccctcaaggacagcagccggcacagcgagttcgagatctccgacttcctgcgccgcttcgggtggatcgtgccggcctacacgatgccccccgacgcgcagcacgtgaccgtgctccgcgtggtcatccgcgaggacttcagccgcaccctcgcggagcgcctggtgctcgacatcgagaaggttctgcacgagctggacgcgctgcccgcccgtgtccccagcggcgacctagccgcgctcgccgcggccgagtccagcgagagggagatggagaagcagcgccaggtgatctcgctctggaagagggccgtcctcgccaagaagaagaccaacggcgtctgctaagcagccgagccgacgcatttctggccgtattggcatggggtgaaatttgtctgagtacgcgtttgcagtttttacccgggtgaagattgttatgtgtcgaggttgagttttagaggacggaattgctccggctcggtgtatgtagcgagtgttttacgtgctcaacaactctcagacttccctcccctcttgcatgtaagctgtaagtcgatgcaaataatgttgcgtgtcgagcgacgattagtaatagtacctgatggggtacttgtattagtattgatatttgaattacactatacattatgtgacatactattaatattgctcgacaaagtaatattatcggcttc

SEQ ID NO: 1330 - protein, 493 aa, Zea mays
  misc_feature (1)..(493): Ceres CLONE ID no.1468893
  misc_feature (1)..(493): Bit score of 1273.4 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(493): Functional Homolog Of Ceres SEEDLINE ID no. ME13153 at SEQ ID NO: 1302
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKVDLPEELIFHINYLGADQPTFTLNFSKGSSQVIAQYYQLIRLGFEGYKNIMENCQENATVLKQGLEKTGKFNIVSKDNGVPLVAFSLKDSSRHSEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 1331 - protein, 420 aa, Lotus japonicus
  misc_feature (1)..(420): Public GI ID no.51587340
  misc_feature (1)..(420): Bit score of 1009.2 for HMM based on sequences of FIGURE 44.
  misc_feature (36)..(381): Pfam Name: Pyridoxal_deC Pfam Description: Pyridoxal-dependent decarboxylase conserved domain
  misc_feature (1)..(420): Functional Homolog Of Ceres SEEDLINE ID no. ME13153 at SEQ ID NO: 1302
MVLSNTASSGSESDLSIHSTFASRYVRTSLPRFKMPQESIPKEAAYQIINDELMLDGNPRLNLASFVTTWMEPECDKLIMASINKNYVDMDEYPVTTELQNRCVNMIAHLFNAPLGDSDTVGTVGSSEAIMLAGLAFKRTWQNRRKAEGKPHDKPNIVTGANVQVCWEKFARYFEVELKEVKLSEGYYVMDPQKAVDLVDENTICVAAILGSTLNGEFEDVKRLNDLLIEKNKETGWDTPIHVDAASGGFIAPFIYPELEWDFRLPLVKSINVSGHKYGLVYAGIGWVIWRNKEDLPEELIFHINYLGADQPTFTLNFSKGSSQIIAQYYQLIRLGYEGYKHVMENCRDNMLVLKEGLQKTGRFEIVSKDNGVPLVAFTLKDHTHYNEFQISDSLALRVDSAGIQHAPKYSARDRGPCSH

SEQ ID NO: 1332 - DNA, 1902 bp, Panicum virgatum
  misc_feature (1)..(1902): Ceres CLONE ID no.1796201
  misc_feature (1)..(1902): Encodes the peptide sequence at SEQ ID NO 1333
gacgacgcgagaccacccgggacacgccacgcaccctcctcacccgcaccagcaccagctctcactctcgctcgctgcggcggcctctgacgcgtcgccgtcgcctttccgcttccgcccgcggggggcgaatcgattcccctcctcggtcggtcgccgtcgctgtccgtccggcagcccgcccgccccgtacgtacgcgagaagcgagaggcgatggtggtcagcgtggccgcgacgggggccggcacggacgccgagccggtgacctccaccttcttcgcgtcccgctacgtccgggacccgctccgacggtaccggatgccggagcggtcgatcccgcgggaggcggcgtaccagatcatcaacgacgagctgatgctggacggcaacccgcggctgaacctggcgtccttcgtcaccacctggatggagcccgagtgcgacaagctcatcatgggctccatcaacaagaactacgtcgacatggacgagtaccccgtcaccaccgagctccagaaccgttgcgtaaatatgatagctcacctgttcaacgcgccgattaaggaggatgagactgctgtcggagttggaacagtgggatcctcggaagcaattatgcttgcaggcctagcattcaagaggaaatggcaaaacaagaggaaggaacaggggaagccgtatgacaaacccaacattgtcaccggtgctaatgttcaggtttgctgggagaagtttgcaagatattttgaagtggagctaaaggaggttaagttatctgaaggatattatgtcatggaccctgtcaaggctgttgacatggtggatgagaacaccatatgtgttgcggctatcttgggatctactctcacaggagagtttgaagatgtcaagcaattgaatgaccttcttactgaaaagaacaaggaaactgggtgggatgtgccgattcatgttgacgctgcgagcggagggttcatagcgcctttcctgtaccctgagcttgaatgggacttcaggctaccactagtgaagagcatcaatgtcagtgggcacaagtatggccttgtctacgctggtgttggttgggtaatttggaggagcaagaaggatttgcctgaagagctcattttccatataaactacctggggacagaccagcctacgttcacgctcaacttctccaaaggttctagtcagatcattgcacaatactatcagctcattcgccttggcttccaggggtacaagaacatcatggagaactgcatggagaacgctgcgatcctgcgggagggcatcgcggcgaccggccggttcgacatcctgtccaaggacgccggcgtgccgctggtcgccttctcgctcaaggacagcagccggttcagcgtgttcgacatctcggagaacctgcggcggttcgggtggatcgtgccggcgtacaccatgccggcggacgcggagcacgtggccgtgctccgcgtggtcatccgggaggacttcagccggaccctcttggagcggctcgtcggcgacgtcctcaagatcctgcgcgagctggacgcctgcgccacccacgccgtgcgggtcgccaccgccaccgccgcggtgcagtcgggcgacggcggcggcgtcgtggccaggaagagcatcctggagatcgagcgggaggtcgcctcgcgctggagggacgccgtgagcaagaagaagaccgggccgtgctgattgacgcgtggaggaggatggtttgtattgtacgtatgtgcttgtgtatctgtgcttgaagcttggatcattgtatgcgtagtcgaactccgtgtgttctttgctttggtggtcttgtaccgtatagcacgagatctggctgtttgtgttttggatggcaatgttcaggaacgaaccag

SEQ ID NO: 1333 - protein, 502 aa, Panicum virgatum
  misc_feature (1)..(502): Ceres CLONE ID no.1796201
  misc_feature (1)..(502): Bit score of 1240.5 for HMM based on sequences of FIGURE 44.
  misc_feature (37)..(385): Pfam Name: Pyridoxal_deC Pfam Description: Pyridoxal-dependent decarboxylase conserved domain
  misc_feature (1)..(502): Functional Homolog Of Ceres SEEDLINE ID no. ME13153 at SEQ ID NO: 1302
MVVSVAATGAGTDAEPVTSTFFASRYVRDPLRRYRMPERSIPREAAYQIINDELMLDGNPRLNLASFVTTWMEPECDKLIMGSINKNYVDMDEYPVTTELQNRCVNMIAHLFNAPIKEDETAVGVGTVGSSEAIMLAGLAFKRKWQNKRKEQGKPYDKPNIVTGANVQVCWEKFARYFEVELKEVKLSEGYYVMDPVKAVDMVDENTICVAAILGSTLTGEFEDVKQLNDLLTEKNKETGWDVPIHVDAASGGFIAPFLYPELEWDFRLPLVKSINVSGHKYGLVYAGVGWVIWRSKKDLPEELIFHINYLGTDQPTFTLNFSKGSSQIIAQYYQLIRLGFQGYKNIMENCMENAAILREGIAATGRFDILSKDAGVPLVAFSLKDSSRFSVFDISENLRRFGWIVPAYTMPADAEHVAVLRVVIREDFSRTLLERLVGDVLKILRELDACATHAVRVATATAAVQSGDGGGVVARKSILEIEREVASRWRDAVSKKKTGPC

SEQ ID NO: 1334 - protein, 492 aa, Oryza sativa subsp. indica
  misc_feature (1)..(492): Public GI ID no.125543034
  misc_feature (1)..(492): Bit score of 1281.9 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(492): Functional Homolog Of Ceres SEEDLINE ID no. ME13153 at SEQ ID NO: 1302
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVDENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGADQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 1335 - protein, 461 aa, Oryza sativa subsp. indica
  misc_feature (1)..(461): Public GI ID no.125545540
  misc_feature (1)..(461): Bit score of 1172.5 for HMM based on sequences of FIGURE 44.
  misc_feature (2)..(350): Pfam Name: Pyridoxal_deC Pfam Description: Pyridoxal-dependent decarboxylase conserved domain
  misc_feature (1)..(461): Functional Homolog Of Ceres SEEDLINE ID no. ME13153 at SEQ ID NO: 1302
MPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 1336 - protein, 501 aa, Oryza sativa subsp. japonica
  misc_feature (1)..(501): Public GI ID no.115476804
  misc_feature (1)..(501): Bit score of 1260.3 for HMM based on sequences of FIGURE 44.
  misc_feature (37)..(385): Pfam Name: Pyridoxal_deC Pfam Description: Pyridoxal-dependent decarboxylase conserved domain
  misc_feature (1)..(501): Functional Homolog Of Ceres SEEDLINE ID no. ME13153 at SEQ ID NO: 1302
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 1337 - protein, 497 aa, Oryza sativa subsp. japonica
  misc_feature (1)..(497): Public GI ID no.42409426
  misc_feature (1)..(497): Bit score of 1254.9 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(497): Functional Homolog Of Ceres SEEDLINE ID no. ME13153 at SEQ ID NO: 1302
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 1338 - protein, 514 aa, Oryza sativa subsp. japonica
  misc_feature (1)..(514): Public GI ID no.125603698
  misc_feature (1)..(514): Bit score of 1239.4 for HMM based on sequences of FIGURE 44.
  misc_feature (37)..(398): Pfam Name: Pyridoxal_deC Pfam Description: Pyridoxal-dependent decarboxylase conserved domain
  misc_feature (1)..(514): Functional Homolog Of Ceres SEEDLINE ID no. ME13153 at SEQ ID NO: 1302
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGLSLEVDRYDQENWWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 1339 - protein, 509 aa, Pinus pinaster
  misc_feature (1)..(509): Public GI ID no.75268060
  misc_feature (1)..(509): Bit score of 1234.1 for HMM based on sequences of FIGURE 44.
  misc_feature (32)..(380): Pfam Name: Pyridoxal_deC Pfam Description: Pyridoxal-dependent decarboxylase conserved domain
  misc_feature (1)..(509): Functional Homolog Of Ceres SEEDLINE ID no. ME13153 at SEQ ID NO: 1302
MALSSATDSDGSIHSTFASRYVQESLPRFQIPSRSIPKDAAYQIISDELMLDGNPRLNLASFVTTWMEPECDKLIMQAINKNYVDMDEYPVTTELQNRCVNIIANLFNAPLGDGEEAVGVGTVGSSEAIMLAGLAFKRKWQNKRKAEGKPYDKPNIVTGANVQVCWEKFARYFEVELKEVKLKKDYYIMDPVKAVEMVDENTICVAAILGSTYNGEFEDVKLVNDLLIQKNKETGWDTPIHVDAASGGFIAPFLYPELEWDFRLPLVKSINVSGHKYGLVYAGIGWVIWRAKQDLPEELIFHINYLGADQPTFTLNFSKGASQIIAQYYQLIRLGFEGYRNIMGNCAANAKALSDGLVRTGRFNILSKEIGVPLVAFSLKDSSRHDEYEISDHLRRFGWIVPAYTMAPDAQEVKLLRVVVREDFNRSLAERLVHDIEKVLHELDTLPSKIAREVVASLVDGHPELKEVKDLGIDVTQFKSSAVFNEIVNSQKAVKAWKKFVAQKANRVC

SEQ ID NO: 1340 - protein, 499 aa, Populus x canescens
  misc_feature (1)..(499): Public GI ID no.75268007
  misc_feature (1)..(499): Bit score of 1276.6 for HMM based on sequences of FIGURE 44.
  misc_feature (33)..(381): Pfam Name: Pyridoxal_deC Pfam Description: Pyridoxal-dependent decarboxylase conserved domain
  misc_feature (1)..(499): Functional Homolog Of Ceres SEEDLINE ID no. ME13153 at SEQ ID NO: 1302
MVLSKTASESDVSVHSTFASRYVRASLPRFKMPENSIPKEAAFQIINDELMLDGNPRLNLASFVTTWMEPECDKLIIASINKNYVDMDEYPVTTELQNRCVNMIAHLFNAPLGDSETAVGVGTVGSSEAIMLAGLAFKRKWQNKRKAEGKPYDKPNIVTGANVQVCWEKFARYFEVELKEVKLSDGYYVMDPEKAVQMVDENTICVAAILGSTLNGEFEDVKLLNDLLVEKNKSTGWDTPIHVDAASGGFIAPFIYPELEWDFRLPLVKSINVSGHKYGLVYAGIGWVIWRNKEDLPEELIFHINYLGADQPTFTLNFSKGSSQVIAQYYQLIRLGYEGYKNVMENCRDNMLVLKQGLEKTGKFNIVSKDKGVPLVAFSLKDNSLHNEFEVSDMLRRFGWIVPAYTMPPDAQHVTVLRVVIREDFSRTLAERLVIDIGKVLHELETLPSRISAKIVLANEEKDAVAAGKEKKDVQNETREIITAWRKLVVQRKKLNGVC

SEQ ID NO: 1341 - DNA, 1381 bp, Zea mays
  misc_feature (1)..(1381): Ceres SEEDLINE ID no.ME13177
  misc_feature (1)..(1381): Ceres CLONE ID no.339439
  misc_feature (1)..(1381): Inplanta Sequence
  misc_feature (1)..(1381): Encodes the peptide sequence at SEQ ID NO. 1342
gacctgtcgtcttcgtctccggcagagcaaagcggcggcgaggcgggagatatagaggagagacgagagcgggatggggtacctgtggagggtgcggctgtcttcatttgctgccggcgcggcgacggcttcggcggcggggttcttcctcctctacaaggaccacctgctcgcccgcgctgccgacgccgagtccaactccgcctcctactccccgccgctcgccacagccgacaccgctttctccgcgccgccgcgcgccgtggcgcccgccgacctccagctctccgggtcctacgcctccgacatctacacctacctccgctccctggaggtggatccgcagcggcggtccagatccgattacatcgaggcggtgcaggcggacgtcacggcccacatgcggagcatcctcgtcgactggctcgtcgaggtcgccgaggagtacaagctcgtcgcggacacgctctacctcaccatctcttatgtcgaccgcttcctctccgtcaacgcgctcggccgtgacaagctgcagctccttggcgttgcctccatgctcattgccgcgaagttcgaggagatcagcccgccgcacccggaggacttctgctacatcacagacaacacctacaccaaagaggagctcctcaagatggagagcgacatactcaagcttctcaagttcgagttgggcaatcctacaatcaagaccttcctgagacgtttcataagatctgcccatgaagacaagaagggctccatcttgttaatggaattcttggggagctacctcgctgagctgagtctactagattatggctgcctccggttcttgccatcagtagttgctgcttcagtcatgtttgttgctaggctgaccattgatccaaataccaatccgtggaacacaaagctgcagaagatgactggctacaaagtttctgaactcaaggattgcatcgtagccatacatgacttgcagctcaacaggaaatgtccatcattaacggcaattcgagacaagtacaagcagcacaagttcaaatgcgtgtcattgatcctcgtgcctgtcgtgatccctacttcatactttgaagacttagctgagtagctgctctcggactgtaccgctgtaaggctaacaatctgagctctccttgagctcttagggacaagcagaaaataaccgtttgatgagctttcctctcatttaagtagcgtggtgaaagctatttgtttgaggttctttaggattcgcgccgctgtgtcactcttagtgagaccaggcattctcttgctgtgaatcttgtatcatatcttagtcacaccttgccttggtccgttggcaacgaatgtaatgtttgatacgttagacccttcg

SEQ ID NO: 1342 - protein, 345 aa, Zea mays
  misc_feature (1)..(345): Ceres SEEDLINE ID no.ME13177
  misc_feature (1)..(345): Ceres CLONE ID no.339439
  misc_feature (1)..(345): Bit score of 689.6 for HMM based on sequences of FIGURE 45.
  misc_feature (209)..(336): Pfam Name: Cyclin_C Pfam Description: Cyclin, C-terminal domain
  misc_feature (78)..(207): Pfam Name: Cyclin_N Pfam Description: Cyclin, N-terminal domain
MGYLWRVRLSSFAAGAATASAAGFFLLYKDHLLARAADAESNSASYSPPLATADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 1343 - DNA, 1677 bp, Gossypium hirsutum
  misc_feature (1)..(1677): Ceres CLONE ID no.1918110
  misc_feature (1)..(1677): Encodes the peptide sequence at SEQ ID NO 1344
cccatctctctcctctcttcgtttccaagtcttccccacgtcctctttctttctttctctctgcaactgcaactggttggctgaagagtgagagaggcaatggcggatcaggagaactgtgtgagagtgacaagggccgcggccaggaagcgagctgccgagtcggcgggattgatcgaagggagagtcatgaacaagaaaagggttgtcttgggggacctttccaacttgtccaatgttgctgtctctgcgaataaagttcaggggaaggaaaacaaaaagaagcaagctaaagggaagctgaaatcaaagacggaagtcgcaaagccgaatttggaggtgaaaacagatgaggtttcagttgataaaccggtggatatcgatgctaaatctgttgacccacaaatgtgtgggtattacgtatctgatatctatgaatatcttcgccaaatggaggcggatccgaagagaagacctttacctgattatatcgagaaggtacagaaggatgtaagtacaaatatgagagggattttggtggattggttggtggaagttgcagatgaatacaagcttgtttcggatactttatatataacagtttcctacatcgatagatacctgtctttaaatgctctcaacaggcaaaggcttcagttgttgggtgtatcttcaatgctgattgcctcaaagtacgaagaaatcaaccctccaaatgtggaagatttttgctatataacagataatacatacaggaaagatgagatggtgaaaatggaggctgatatactcaagtccttgaagtttgaattgggcaatcctactgttaaaacatttctgaggagatttaccagggttgcacaagaggattacaaagattccagcttgcagctagaatgccttggatgttaccttgcagagttgagtttgttggactatggctgtgtaaagtttttaccatcaatggttgctgcttctgttatattccttgctagattcataattcaacctaagatgcatccttggagctctgctgtgcagagtactcgggctacaaagcctctgatctaaaagaatgtgtccttatcatacatgacttatatttgagtagaagaggaggtgcacttcaagcagttagagaaaaatacaagcagcataagttcaaatgtgtggcaaccatgcctgcttctccggagattccagcttcttattttgaagatgttcaagaagttgatgtttcatatgttgaagatgttcaaagctgttagagtttgacatatgctatttctgatgtgtaacttctatagaaggcctggatgtgggtgaaaagaatatttgaacttaaaagggactggcacttgagcttgctaattttttattggttgaagaactccttatgggtgtggcatctatgatgtaagcgattgttggtagtgatactaacttggcaaacgttttatcacatgagcaggactttagtatgttaatgattcatagaaatcaatattgaaacatgttgattgacagattgtaagtatttcttttggcttctactgcttttgaaaagttgaagagtcaatctccaaactttgtggttaactgaattatgtgaaactgttttgttgataaatggatgtcattctctggaagcaataaatatacatttaccctttctct

SEQ ID NO: 1344 - protein, 323 aa, Gossypium hirsutum
  misc_feature (1)..(323): Ceres CLONE ID no.1918110
  misc_feature (1)..(323): Bit score of 677.8 for HMM based on sequences of FIGURE 45.
  misc_feature (110)..(239): Pfam Name: Cyclin_N Pfam Description: Cyclin, N-terminal domain
  misc_feature (241)..(311): Pfam Name: Cyclin_C Pfam Description: Cyclin, C-terminal domain
  misc_feature (1)..(323): Functional Homolog Of Ceres SEEDLINE ID no. ME13177 at SEQ ID NO: 1342
MADQENCVRVTRAAARKRAAESAGLIEGRVMNKKRVVLGDLSNLSNVAVSANKVQGKENKKKQAKGKLKSKTEVAKPNLEVKTDEVSVDKPVDIDAKSVDPQMCGYYVSDIYEYLRQMEADPKRRPLPDYIEKVQKDVSTNMRGILVDWLVEVADEYKLVSDTLYITVSYIDRYLSLNALNRQRLQLLGVSSMLIASKYEEINPPNVEDFCYITDNTYRKDEMVKMEADILKSLKFELGNPTVKTFLRRFTRVAQEDYKDSSLQLECLGCYLAELSLLDYGCVKFLPSMVAASVIFLARFIIQPKMHPWSSAVQSTRATKPLI

SEQ ID NO: 1345 - DNA, 1083 bp, Populus balsamifera subsp. trichocarpa
  misc_feature (1)..(1083): Ceres ANNOT ID no.1443786
  misc_feature (1)..(1083): Encodes the peptide sequence at SEQ ID NO 1346
atggcagagcaagagaactgcacccgcgttactcgcgctgccaaaaagagggcggctgcgctggcttccacggaggaccaacccttgaataagaagagggttgtgctgggagagcttcccaacttatcaaacgccatcgtttcatcaaacgagccccagaagcagaaagcaaaagcaaagccaaaggcaaggaagggggcttcaacgaagaaggagggtgttctcaaagaggatgttgatgggaaccctgaagatccccaaatgtgtgcaccatatgcatctgatatttatgagtatcttcataaaatggaggtggatccaaaaagaaggccactgcctgattacattgagaaggttcaaaaagatgtgagtcccaatatgagagggattttggtggattggttggtggaggtcgcagaggaatacaagcttgtctctgagaccttgtatcttactgtttcttacgttgacagattcttgtctttcaatgttctcagcaggcagaggcttcagcttcttggtgtttcttctatgcttcttgcctcaaagtatgaagaaatcaaccctccgcatgtggaagatttttgctacattacagataatacatacaccaaggaagaggtggttaaaatggaagctgacatacttaaatctttgaaatttgaaatggggaatcctacgataaagacatttctaaggagattcactagggttgctctagaggactacaaaacttcaaatttgcagcttgagttcctcggattctaccttgctgagttgagcttgttggattacaattgtgtgaaatttttaccttctttggtggctgcttctgttatatttcttacaaggtttctgatgcgacccaagacaaatccttggagttcaaccttgcaacaatacactggatacaaggcagcggatctaagggaatgtgttctcatcatacatgacttgtatttgagtagaagaggaggtggattgcaagctgtaagagaaaaatacaagcagcataagttcaagtgcgtggcaaacatgccttccccgccagagttaccagctttatatttcgaagaggtttaa

SEQ ID NO: 1346 - protein, 360 aa, Populus balsamifera subsp. trichocarpa
  misc_feature (1)..(360): Ceres ANNOT ID no.1443786
  misc_feature (1)..(360): Bit score of 867.0 for HMM based on sequences of FIGURE 45.
  misc_feature (226)..(353): Pfam Name: Cyclin_C Pfam Description: Cyclin, C-terminal domain
  misc_feature (95)..(224): Pfam Name: Cyclin_N Pfam Description: Cyclin, N-terminal domain
  misc_feature (1)..(360): Functional Homolog Of Ceres SEEDLINE ID no. ME13177 at SEQ ID NO: 1342
MAEQENCTRVTRAAKKRAAALASTEDQPLNKKRVVLGELPNLSNAIVSSNEPQKQKAKAKPKARKGASTKKEGVLKEDVDGNPEDPQMCAPYASDIYEYLHKMEVDPKRRPLPDYIEKVQKDVSPNMRGILVDWLVEVAEEYKLVSETLYLTVSYVDRFLSFNVLSRQRLQLLGVSSMLLASKYEEINPPHVEDFCYITDNTYTKEEVVKMEADILKSLKFEMGNPTIKTFLRRFTRVALEDYKTSNLQLEFLGFYLAELSLLDYNCVKFLPSLVAASVIFLTRFLMRPKTNPWSSTLQQYTGYKAADLRECVLIIHDLYLSRRGGGLQAVREKYKQHKFKCVANMPSPPELPALYFEEV

SEQ ID NO: 1347 - DNA, 1092 bp, Populus balsamifera subsp. trichocarpa
  misc_feature (1)..(1092): Ceres ANNOT ID no.1486570
  misc_feature (1)..(1092): Encodes the peptide sequence at SEQ ID NO 1348
atgaattcaatttcagagaaagagaactgtgtccgcattactcgcgctgccaaaaagagggcggcggcgctggcttcagccgaggaccggcccttgaataagaagagggttgtgttgggagaacttcccaacttatcgaacaccaccgtttcagtgaatgaggtacataagcagaaagcaaagacaaagtcaaataccagcaagaggactttaacgaagaaggagggtgttttcaaagaggatgttgatgggaaacctgaagatccccaaatgtgtgcaccatatgcatctgatatttatgagtatcttcataaaatggaggtggatccaaaaagaaggcctttgcctgattacattgagaaggttcaaaaagatgttagccccaatatgagagggattttggtggattggttggttgaggttgcggaggagtacaagattgtctctgacactttgtatcttactgtttcttacattgatagattcttgtctttcaatgttctaaataggcagagacttcagcttcttggtgtttctgctatgctcattgcctcaaagtatgaagaaatcaaccctccaaatgtagaagatttttgctacataacagataatacgtacaccaaggaagaggtggttaaaatggaagctgatatacttaaatctttgaaatttgaagtgggaaatcctacaataaagacactcttaaggagattcacaagggcagcacaagaggattacaaaacttcggatttgcagtttgagttcctgggattttaccttgccgagttgagcttgttggattacaattgtgtgaaatatctaccttctttggtggctgcttctgttatttttcttacaagatttctgatgcgacccaagacacatccttggagttcaaccttgcaacaatacactggatacaaagcaacggatctaaaggattgtgttctcatcatacatgacttgtatttgagtagaagagggggtgggttacaagctgtaagagaaaaatataagcagcataagttcaagtgcgtggcgaacatgccttcccctccagagataccagctttatattttgacgatgtttaa

SEQ ID NO: 1348 - protein, 363 aa, Populus balsamifera subsp. trichocarpa
  misc_feature (1)..(363): Ceres ANNOT ID no.1486570
  misc_feature (1)..(363): Bit score of 822.6 for HMM based on sequences of FIGURE 45.
  misc_feature (229)..(356): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(363): Functional Homolog Of Ceres SEEDLINE ID no. ME13177 at SEQ ID NO: 1342
MNSISEKENCVRITRAAKKRAAALASAEDRPLNKKRVVLGELPNLSNTTVSVNEVHKQKAKTKSNTSKRTLTKKEGVFKEDVDGKPEDPQMCAPYASDIYEYLHKMEVDPKRRPLPDYIEKVQKDVSPNMRGILVDWLVEVAEEYKIVSDTLYLTVSYIDRFLSFNVLNRQRLQLLGVSAMLIASKYEEINPPNVEDFCYITDNTYTKEEVVKMEADILKSLKFEVGNPTIKTLLRRFTRAAQEDYKTSDLQFEFLGFYLAELSLLDYNCVKYLPSLVAASVIFLTRFLMRPKTHPWSSTLQQYTGYKATDLKDCVLIIHDLYLSRRGGGLQAVREKYKQHKFKCVANMPSPPEIPALYFDDV

SEQ ID NO: 1349 - DNA, 1077 bp, Populus balsamifera subsp. trichocarpa
  misc_feature (1)..(1077): Ceres ANNOT ID no.1539981
  misc_feature (1)..(1077): Encodes the peptide sequence at SEQ ID NO 1350
atgaattcaatttcagagaaagagaactgtgtccgcattactcgcgctgccaaaaagagggcggcggcgctggcttcagccgaggaccggcccttgaataagaagagggttgtgttgggagaacttcccaacttatcgaacaccaccgtttcagtgaatgaggtacataagcagaaagcaaagacaaagtcaaataccagcaagaggactttaacgaagaaggagggtgttttcaaagaggatgttgatgggaaacctgaagatccccaaatgtgtgcaccatatgcatctgatatttatgagtatcttcataaaatggaggtggatccaaaaagaaggcctttgcctgattacattgagaaggttcaaaaagatgttagccccaatatgagagggattttggtggattggttggttgaggttgcggaggagtacaagattgtctctgacactttgtatcttactgtttcttacattgatagattcttgtctttcaatgttctaaataggcagagacttcagcttcttggtgtttctgctatgctcattgcctcaaagtatgaagaaatcaaccctccaaatgtagaagatttttgctacataacagataatacgtacaccaaggaagaggtggttaaaatggaagctgatatacttaaatctttgaaatttgaagtgggaaatcctacaataaagacactcttaaggagattcacaagggcagcacaagaggattacaaatttgagttcctgggattttaccttgccgagttgagcttgttggattacaattgtgtgaaatatctaccttctttggtggctgcttctgttatttttcttacaagatttctgatgcgacccaagacacatccttggagttcaaccttgcaacaatacactggatacaaagcaacggatctaaaggattgtgttctcatcatacatgacttgtatttgagtagaagagggggtgggttacaagctgtaagagaaaaatataagcagcataagttcaagtgcgtggcgaacatgccttcccctccagagataccagctttatattttgacgatgtttaa

SEQ ID NO: 1350 - protein, 358 aa, Populus balsamifera subsp. trichocarpa
  misc_feature (1)..(358): Ceres ANNOT ID no.1539981
  misc_feature (1)..(358): Bit score of 806.0 for HMM based on sequences of FIGURE 45.
  misc_feature (229)..(351): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(358): Functional Homolog Of Ceres SEEDLINE ID no. ME13177 at SEQ ID NO: 1342
MNSISEKENCVRITRAAKKRAAALASAEDRPLNKKRVVLGELPNLSNTTVSVNEVHKQKAKTKSNTSKRTLTKKEGVFKEDVDGKPEDPQMCAPYASDIYEYLHKMEVDPKRRPLPDYIEKVQKDVSPNMRGILVDWLVEVAEEYKIVSDTLYLTVSYIDRFLSFNVLNRQRLQLLGVSAMLIASKYEEINPPNVEDFCYITDNTYTKEEVVKMEADILKSLKFEVGNPTIKTLLRRFTRAAQEDYKFEFLGFYLAELSLLDYNCVKYLPSLVAASVIFLTRFLMRPKTHPWSSTLQQYTGYKATDLKDCVLIIHDLYLSRRGGGLQAVREKYKQHKFKCVANMPSPPEIPALYFDDV

SEQ ID NO: 1351 - DNA, 1170 bp, Populus balsamifera subsp. trichocarpa
  misc_feature (1)..(1170): Ceres ANNOT ID no.1514366
  misc_feature (1)..(1170): Encodes the peptide sequence at SEQ ID NO 1352
atgagcgagaacgagaatcacgtgcaatccacgcgctcatcatcatcatcatccaggaaacgggccccaaaggctcaccaccctctgccaccctccaagaagaagcgagtcccattgggtgaactcacaaactctctccatatcaccaccaacaactcggattgcaatatcagcgagtctaagtatgcagccaaagcggatgacttgccaccaccaagtactgagtcaagtcgagactcggatttcgagaccaccccgaagattgaatgtgaagtgaaggaggggaatcataacgatttagaaaagtttccgagcgctgagtccattcaaaaatcagggttaaggaggtgttcttacacttcctctatctatcgatatcttcactccttggagatggagggcaatagaaggtgcttgtcaaattacatgcgggaggtgcagaatgatgtatcaggcaatatgcgggaaattctagtggattggttagtggaagttgcagaagaatacagacttgtctcagacaccctttatctcactgtatcgtatatcgataggtttctatcttcacaggctttgagtaggaacaatctacagcttcttggtgtttcttgcatgcttattgcctcgaagtatgaagagattagtcctccacatgtcgagagcttttgccacataacagacaacacttacaccaaggatcaggtacttgatatggagaaacaagtacttaaatccttgaactatgaaatgggtgctcctacaacaataaattttctcaggcaatcttctgatttgcaattcgagctcttgagttgttatctggcggagctaagtttgttagaatatgggtgcatgtgcttcttaccatcaatgattgctgcatcagctgttttcctttcaagtttcacgatccagccacagatgcatccttggagtatggcattgcagcgtcattcaggttacagaccatctgacctaaaggaatgtgttcttgctattcatgacattcaattaaatagaaaaggaagctcttcgcgagcagtgagagataaatacacacagaacaagtttaagcatgtggcaactttatctcctccctcagaagttcctgggcgttactttgcggccatcaatgagttatgctctgtgagattctcaagaatgcgttga

SEQ ID NO: 1352 - protein, 389 aa, Populus balsamifera subsp. trichocarpa
  misc_feature (1)..(389): Ceres ANNOT ID no.1514366
  misc_feature (1)..(389): Bit score of 583.1 for HMM based on sequences of FIGURE 45.
  misc_feature (122)..(251): Pfam Name: Cyclin_N Pfam Description: Cyclin, N-terminal domain
  misc_feature (253)..(370): Pfam Name: Cyclin_C Pfam Description: Cyclin, C-terminal domain
  misc_feature (1)..(389): Functional Homolog Of Ceres SEEDLINE ID no. ME13177 at SEQ ID NO: 1342
MSENENHVQSTRSSSSSSRKRAPKAHHPLPPSKKKRVPLGELTNSLHITTNNSDCNISESKYAAKADDLPPPSTESSRDSDFETTPKIECEVKEGNHNDLEKFPSAESIQKSGLRRCSYTSSIYRYLHSLEMEGNRRCLSNYMREVQNDVSGNMREILVDWLVEVAEEYRLVSDTLYLTVSYIDRFLSSQALSRNNLQLLGVSCMLIASKYEEISPPHVESFCHITDNTYTKDQVLDMEKQVLKSLNYEMGAPTTINFLRQSSDLQFELLSCYLAELSLLEYGCMCFLPSMIAASAVFLSSFTIQPQMHPWSMALQRHSGYRPSDLKECVLAIHDIQLNRKGSSSRAVRDKYTQNKFKHVATLSPPSEVPGRYFAAINELCSVRFSRMR

SEQ ID NO: 1353 - DNA, 1110 bp, Populus balsamifera subsp. trichocarpa
  misc_feature (1)..(1110): Ceres ANNOT ID no.1461093
  misc_feature (1)..(1110): Encodes the peptide sequence at SEQ ID NO 1354
atgagcgagaacgagaatcacgtgcaatccacgcgctcatcatcatcatcatccaggaaacgggccccaaaggctcaccaccctctgccaccctccaagaagaagcgagtcccattgggtgaactcacaaactctctccatatcaccaccaacaactcggattgcaatatcagcgagtctaagtatgcagccaaagcggatgacttgccaccaccaagtactgagtcaagtcgagactcggatttcgagaccaccccgaagattgaatgtgaagtgaaggaggggaatcataacgatttagaaaagtttccgagcgctgagtccattcaaaaatcagggttaaggaggtgttcttacacttcctctatctatcgatatcttcactccttggagatggagggcaatagaaggtgcttgtcaaattacatgcgggaggtgcagaatgatgtatcaggcaatatgcgggaaattctagtggattggttagtggaagttgcagaagaatacagacttgtctcagacaccctttatctcactgtatcgtatatcgataggtttctatcttcacaggctttgagtaggaacaatctacagcttcttggtgtttcttgcatgcttattgcctcgaagtatgaagagattagtcctccacatgtcgagagcttttgccacataacagacaacacttacaccaaggatcaggtacttgatatggagaaacaatcttctgatttgcaattcgagctcttgagttgttatctggcggagctaagtttgttagaatatgggtgcatgtgcttcttaccatcaatgattgctgcatcagctgttttcctttcaagtttcacgatccagccacagatgcatccttggagtatggcattgcagcgtcattcaggttacagaccatctgacctaaaggaatgtgttcttgctattcatgacattcaattaaatagaaaaggaagctcttcgcgagcagtgagagataaatacacacagaacaagtttaagcatgtggcaactttatctcctccctcagaagttcctgggcgttactttgcggccatcaatgagttatgctctgtgagattctcaagaatgcgttga

SEQ ID NO: 1354 - protein, 369 aa, Populus balsamifera subsp. trichocarpa
  misc_feature (1)..(369): Ceres ANNOT ID no.1461093
  misc_feature (1)..(369): Bit score of 511.9 for HMM based on sequences of FIGURE 45.
  misc_feature (122)..(241): Pfam Name: Cyclin_N Pfam Description: Cyclin, N-terminal domain
  misc_feature (244)..(350): Pfam Name: Cyclin_C Pfam Description: Cyclin, C-terminal domain
  misc_feature (1)..(369): Functional Homolog Of Ceres SEEDLINE ID no. ME13177 at SEQ ID NO: 1342
MSENENHVQSTRSSSSSSRKRAPKAHHPLPPSKKKRVPLGELTNSLHITTNNSDCNISESKYAAKADDLPPPSTESSRDSDFETTPKIECEVKEGNHNDLEKFPSAESIQKSGLRRCSYTSSIYRYLHSLEMEGNRRCLSNYMREVQNDVSGNMREILVDWLVEVAEEYRLVSDTLYLTVSYIDRFLSSQALSRNNLQLLGVSCMLIASKYEEISPPHVESFCHITDNTYTKDQVLDMEKQSSDLQFELLSCYLAELSLLEYGCMCFLPSMIAASAVFLSSFTIQPQMHPWSMALQRHSGYRPSDLKECVLAIHDIQLNRKGSSSRAVRDKYTQNKFKHVATLSPPSEVPGRYFAAINELCSVRFSRMR

SEQ ID NO: 1355 - protein, 355 aa, Arabidopsis thaliana
  misc_feature (1)..(355): Public GI ID no.15239172
  misc_feature (1)..(355): Bit score of 801.8 for HMM based on sequences of FIGURE 45.
  misc_feature (219)..(346): Pfam Name: Cyclin_C Pfam Description: Cyclin, C-terminal domain
  misc_feature (90)..(217): Pfam Name: Cyclin_N Pfam Description: Cyclin, N-terminal domain
  misc_feature (1)..(355): Functional Homolog Of Ceres SEEDLINE ID no. ME13177 at SEQ ID NO: 1342
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 1356 - DNA, 1461 bp, Arabidopsis thaliana
  misc_feature (1)..(1461): Ceres CLONE ID no.37206
  misc_feature (1)..(1461): Encodes the peptide sequence at SEQ ID NO 1357
aaaaatttcgaaatcggaaaatttacacagagaagcgccatgacctaaaaatctcaaaacttccccaacaaaaatggcgcttttactcaacccatttccttttacctaccttgtacattaccccttttctcaaatctcactttcccactgaaataaccccatggcggagaatcagaactgtgcgaggatgacgagagcggcggcgaaacgaaaagcgtcgtccatggcgttagacgaaaacccagttagtaagaagagagttgttctcggagagcttccgaatatgtccaatgtcgttgctgtacccaatcaagaaagagagacccttaaggctaaaacaagtgttaatacctcgaagaggcagatgaagaaggctttgatgattcctgaagctagcgtactaatcgaatcgagatctgttgatcctcagatgtgtgagccttttgctagtgatatttgtgcttatctccgtgaaatggaggggaagccgaaacatagaccactacctgattatattgaaaaggttcagagtgatttaactccacacatgagagcggttttggtggattggttagtggaggttgctgaggagtacaagcttgtttcggatacgctttatctcactatctcctatgttgatagattcttgtctgtgaagcctattaacaggcagaagcttcagcttgtgggagtttctgcaatgcttattgcgtcgaaatatgaagagataggtcctcctaaagttgaagatttttgttacattacggataatacatttactaaacaagaagtggtgtcgatggaggcggatatacttcttgctctgcagtttgaattaggaagcccaaccatcaaaacattcctaagacggtttacacgggttgcacaagaagatttcaaagactcacaattgcagatagagttcctttgttgctatctatcagaattgagtatgttagattacacctgtgtgaagtatttgccatctcttttgtctgcttcagctgtatttcttgcccggttcatcatccgtccaaaacaacatccttggaatcaaatgctagaagaatacacaaagtacaaagcagctgatctacaagtgtgcgtgggtatcatacatgacttgtatctaagcagaagaggaaacactctagaagctgttagaaataagtacaagcaacacaagtacaagtgcgttgcgaccatgcctgtttcaccggagctacctcttgctttctttgaagatattaccattagaggaatggcgtaaaagaagcttgaagcttatgtattggaagtgttagttacctgaattttgggttgtatatatctgttagaatggcagattagtattgagtattatctcttttagcgtatgttcaatgattttttgctaacactagttaagaaactttttttttttgcttgaccattttttcaatggtttattagatttttatt

SEQ ID NO: 1357 - protein, 369 aa, Arabidopsis thaliana
  misc_feature (1)..(369): Ceres CLONE ID no.37206
  misc_feature (1)..(369): Bit score of 772.8 for HMM based on sequences of FIGURE 45.
  misc_feature (229)..(356): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(369): Functional Homolog Of Ceres SEEDLINE ID no. ME13177 at SEQ ID NO: 1342
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 1358 - protein, 370 aa, Arabidopsis thaliana
  misc_feature (1)..(370): Public GI ID no.42571785
  misc_feature (1)..(370): Bit score of 768.1 for HMM based on sequences of FIGURE 45.
  misc_feature (230)..(357): Pfam Name: Cyclin_C Pfam Description: Cyclin, C-terminal domain
  misc_feature (98)..(228): Pfam Name: Cyclin_N Pfam Description: Cyclin, N-terminal domain
  misc_feature (1)..(370): Functional Homolog Of Ceres SEEDLINE ID no. ME13177 at SEQ ID NO: 1342
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASRKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 1359 - DNA, 1444 bp, Arabidopsis thaliana
  misc_feature (1)..(1444): Ceres CLONE ID no.121607
  misc_feature (1)..(1444): Encodes the peptide sequence at SEQ ID NO 1360
cactcatccgatctctcaatcctctcaaatctcaaactctcttcccatcactctctcgctctctcttcaatctcatctcaatcatgacagagcaagagatctgcgtgagggttacaagagcggcggcgaaacgaaaagcttcgacggcgatgggtattgacggagatcgggtcaacaagaagagagttgttctcggtgagcttctaaacgtctccaatgtcaatctcttggctaatctcaatcagaagaaagaaacccagaagccgaaaaggaatcttaaacctcctccggcgaaacagattaagtcagctccggtggctattattgacctagaatcaaaatctgacattgattctcgatctgatgatcctcaaatgtgtggaccttatgttgctgatatctacgagtatcttcgtcaacttgaggtgaagccaaagcagagacctttaccagattacatagagaaagttcagaaagatgtaacaccaagtatgagaggtgttttggttgattggttagtggaagttgctgaagagtataaacttggatctgaaacactttatctcactgtctcacatattgatagattcttgtctttaaagactgttaacaagcaaaagctacagcttgttggagtttctgctatgcttattgcttcgaaatatgaagagataagtcctcctaaagtggatgatttttgttacattacggataatacgttttcgaaacaagatgttgtgaagatggaagctgatatacttcttgctcttcagtttgagttgggaagaccaacgattaatacttttatgagacggtttactagagttgcacaagacgatttcaaagttccacatttgcagctagagcctctttgttgctatttgtcagaattgagtatattagattataagactgtgaagtttgtgccgtctctgttggctgcttctgctgtttttctcgctcggttcatcatccgtccgaaacaacatccttggaaccaaatgttagaagagtacacaaagtacaaagcggctgatctacaagtgtgtgttggaatcatacatgacttgtatttgagcagaagaggaggtgctttacaagctgttagagagaaatataagcaccataagttccaatgcgttgcgaccatgcctgtttcaccagagctgccggttaccttttgggaggatgttaccatttgatctgaggttatgctatcttaagcaaatgttacggagctcgattaccgaatcttgtttcaaatagtataatggacacagatcttcaagtgaagctagaagagtaacaactatagaagtgaaggcaggagcaaataagtttgtgttatgtgaagatgtgtgatgtattattgaaatctcttttttttttttctacaaaattttagtgtgaaattcggaataatataattttatacaattatgcc

SEQ ID NO: 1360 - protein, 372 aa, Arabidopsis thaliana
  misc_feature (1)..(372): Ceres CLONE ID no.121607
  misc_feature (1)..(372): Bit score of 753.0 for HMM based on sequences of FIGURE 45.
  misc_feature (105)..(234): Pfam Name: Cyclin_N Pfam Description: Cyclin, N-terminal domain
  misc_feature (236)..(363): Pfam Name: Cyclin_C Pfam Description: Cyclin, C-terminal domain
  misc_feature (1)..(372): Functional Homolog Of Ceres SEEDLINE ID no. ME13177 at SEQ ID NO: 1342
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIASKYEEISPPKVDDFCYITDNTFSKQDVVKMEADILLALQFELGRPTINTFMRRFTRVAQDDFKVPHLQLEPLCCYLSELSILDYKTVKFVPSLLAASAVFLARFIIRPKQHPWNQMLEEYTKYKAADLQVCVGIIHDLYLSRRGGALQAVREKYKHHKFQCVATMPVSPELPVTFWEDVTI

SEQ ID NO: 1361 - protein, 327 aa, Arabidopsis thaliana
  misc_feature (1)..(327): Public GI ID no.15220145
  misc_feature (1)..(327): Bit score of 562.7 for HMM based on sequences of FIGURE 45.
  misc_feature (190)..(317): Pfam Name: Cyclin_C Pfam Description: Cyclin, C-terminal domain
  misc_feature (59)..(188): Pfam Name: Cyclin_N Pfam Description: Cyclin, N-terminal domain
  misc_feature (1)..(327): Functional Homolog Of Ceres SEEDLINE ID no. ME13177 at SEQ ID NO: 1342
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTI

SEQ ID NO: 1362 - protein, 328 aa, Arabidopsis thaliana
  misc_feature (1)..(328): Public GI ID no.116830956
  misc_feature (1)..(328): Bit score of 562.7 for HMM based on sequences of FIGURE 45.
  misc_feature (190)..(317): Pfam Name: Cyclin_C Pfam Description: Cyclin, C-terminal domain
  misc_feature (59)..(188): Pfam Name: Cyclin_N Pfam Description: Cyclin, N-terminal domain
  misc_feature (1)..(328): Functional Homolog Of Ceres SEEDLINE ID no. ME13177 at SEQ ID NO: 1342
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTIG

SEQ ID NO: 1363 - protein, 425 aa, Brassica napus
  misc_feature (1)..(425): Public GI ID no.562190
  misc_feature (1)..(425): Bit score of 718.7 for HMM based on sequences of FIGURE 45.
  misc_feature (160)..(287): Pfam Name: Cyclin_N Pfam Description: Cyclin, N-terminal domain
  misc_feature (289)..(416): Pfam Name: Cyclin_C Pfam Description: Cyclin, C-terminal domain
  misc_feature (1)..(425): Functional Homolog Of Ceres SEEDLINE ID no. ME13177 at SEQ ID NO: 1342
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 1364 - protein, 365 aa, Brassica rapa
  misc_feature (1)..(365): Public GI ID no.83032266
  misc_feature (1)..(365): Bit score of 795.5 for HMM based on sequences of FIGURE 45.
  misc_feature (228)..(355): Pfam Name: Cyclin_C Pfam Description: Cyclin, C-terminal domain
  misc_feature (96)..(226): Pfam Name: Cyclin_N Pfam Description: Cyclin, N-terminal domain
  misc_feature (1)..(365): Functional Homolog Of Ceres SEEDLINE ID no. ME13177 at SEQ ID NO: 1342
MAENQNSTRMTRAAAKRKASVTDENPVSKKRVVLGELPNNSNVPAPLIPLQERETQKPKSTLFAAKKQTKTPPIPQTVDFESGSSDPQMCGPFVADICAYLREMEGKLKQRPLHDYIEKVQSDLTPSMRGVLMDWLVEVAEEYKLVSDTLYLTVSYVDRFLSAKPINRQRLQLVGVSAMLIASRKYEEISPPKVEDFVYITDNTFTRQDVVSMEADILLALQFELGCPTIKTFLRRFTRVAQEDFNESLLQIECLCCYLSELSLLDYSCVKFLPSMLAASAVFLARFIIRPKQRPWNQMLEEYTKYKASDLQQPVGIIHDLYLSRRGNSLEAVRNKYKQHKFKCVATMPVSPELPQAFFEDVTIR

SEQ ID NO: 1365 - DNA, 1773 bp, Glycine max
  misc_feature (1)..(1773): Ceres CLONE ID no.602910
  misc_feature (1)..(1773): Encodes the peptide sequence at SEQ ID NO 1366
aaaattcagagcgtgcaaattgcaaaatgcagaaattgctcaacgatttcccccaaaaaatgagtttcacgggaagcgggaagaagacccaccgcaaaaatttcaaaccacaaagacagcattaatattcttcctttcatttccagttcttcttcttaaaccccttattctccttctctcttgcactgtcttacaatttgaattttccaatggcaacttctgagaacaacagcagcgcgcgtccccaacgcgaagcgaagaagagggccgcagctgcaatatcccaaattcatggcaacgccgccaagaagaaacgcgtcgttttaggcgacgtcactaacgtttcctcaagcgacgtcgccgtttccgtttccaaaaaacccgttcagacacataaaaatgttaaactcgagaaaccggccgcgccggttgccacgccggagaaggttgaggaaagacacgacccgcaactctgtgggccctacgtttctgatatatacgaataccttcgcggaatggaggtggatcctagtaagagaccattgatggattatgttcagaagattcagagggatgttaatgctaacatgcgcggtgttcttgtggattggttggtggaagttgcagaagaatacaaacttgtttcggacacgctttatttctctgttgcttatattgataggtttttgtcgttgaatattttgtcgagacagaggttgcaattgctgggggttgcttcaatgctcattgcttcgaaatacgaagagattaagccgcccgaggtggaggatttttgttacattacggataacacatactctaaggaagaggttgtgaacatggaggctgaaatattgaaggctttgaaatttgaattgggtggtcctacagtgaagacattcttgaggagattctccagagttggtcaagagggtgttgatacttctgatctccagtttgagttccttagctgctaccttgccgagctcagtttgttggattataattgtataaagtttttgccatctttggtggctgcatcagttgtattcctagcaagatttatgtttagcacaaagacacatccttggaattcggcactccatcaactcactagatataaacctgctgacttgaaggaatgtgttctaaacttacatgacttgtacctcagtaggagaggggcctctttgcaagctgtgagagagaaatacaaacagcataagttcaaatgtgtggcaacaacaccatctcctcccgagatacctctttctttttttgaatttgaggggcagattcttaggcaattgtaatttggctattcttggtatggctctggtttcaactattggcaggaaagtgtttcctaacactagagatgagagtttcagacattttgttgcacttgtttgtagagagagagaggtgcttgccagaaatgcagcgacaacatactatgctggcctcactgactttgtgattgagcttgtgtgaaaatgagataaatcccattagttgagaattaggttattttttgacaattagaagttctttgtaagatttccttgaaggatttatgatttctatgtatagggaaatgctatacgttttcattgtagttgttccattctaagatgtccaaactctgatattcagaaatcaatttttcagctgtaaacaagtgttggattggttactttaacccaaccatttttgtccgtggtctaaacaaatgtctgtgatagaatataattgagtttgtctgtgtagtct

SEQ ID NO: 1366 - protein, 367 aa, Glycine max
  misc_feature (1)..(367): Ceres CLONE ID no.602910
  misc_feature (1)..(367): Bit score of 805.1 for HMM based on sequences of FIGURE 45.
  misc_feature (226)..(353): Pfam Name: Cyclin_C Pfam Description: Cyclin, C-terminal domain
  misc_feature (95)..(224): Pfam Name: Cyclin_N Pfam Description: Cyclin, N-terminal domain
  misc_feature (1)..(367): Functional Homolog Of Ceres SEEDLINE ID no. ME13177 at SEQ ID NO: 1342
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKFKCVATTPSPPEIPLSFFEFEGQILRQL

SEQ ID NO: 1367 - protein, 348 aa, Glycine max
  misc_feature (1)..(348): Public GI ID no.857393
  misc_feature (1)..(348): Bit score of 611.6 for HMM based on sequences of FIGURE 45.
  misc_feature (214)..(341): Pfam Name: Cyclin_C Pfam Description: Cyclin, C-terminal domain
  misc_feature (83)..(212): Pfam Name: Cyclin_N Pfam Description: Cyclin, N-terminal domain
  misc_feature (1)..(348): Functional Homolog Of Ceres SEEDLINE ID no. ME13177 at SEQ ID NO: 1342
METRAAAKRKANAAIVVVVEKQHPKRQRVVLGELPNLQNLIVSKIQNPRKEKLQCRKNPNANKPSPTNNTLSSPQLDGSYVSDIHEYLREMEMQKKRRPMVNYIEKFQKIVTPTMRGILVDWLVEVAEEYKLLSDTLHLSVSYIDRFLSVNPVTKSRLQLLGVSSMLIAAKYEETDPPSVDEFCSITDNTYDKAEVVKMEADILKSLKFEMGNPTVSTFLRRYANVASDVQKTPNSQIEHLGSYIGELSLLDYDCLRFLPSIVAASVIFLAKFIIWPEVHPWTSSLCECSGYKPAELKECVLILHDLYLSRKAASFKAVREKYKHQKFKCVANLPTPPYVPSCYFEDQ

SEQ ID NO: 1368 - DNA, 1498 bp, Glycine max
  misc_feature (1)..(1498): Ceres CLONE ID no.561499
  misc_feature (1)..(1498): Encodes the peptide sequence at SEQ ID NO 1369
attcacccaacacttcaactccatcttcttccatccatttcctctttctcgatctgttccaaattcacttcacacacaggaaagaagatggagactcgcgccgccgcaaagagaaaggcaaatgccgccaccatagtctttgtcgaaaaacaataccccaacaagaggcagcgggttgtgttgggtgaacttcccaatttacaaaaccttattgtctccgaaactcaaaattcgcgcaaagagaagctcctatgtcggaagaatcccaatgagaagaaaccatcacccacaaacaacaacacctttccttcccctcagatcaacgaatcttatgattcggatatccacgggtatcttcgtgaaatggagatgcagaataagagaagaccaatggttgactacattgaaaaggttcagaaaattgttaccccaaccatgagagcaatattggtggattggttagtggaggtagctgtggagtacaagcttctatcggatactcttcatctctctgtatcatacatcgataggtttttatcagttaatccagtcagtaaatccagacttcagttactgggtgtttcgtccatgctcattgctgcaaaatatgaggagatggatccacctggtgtggacgagttttgcagcatcactgatcacacttatgacaagacagaggttgtgaagatggaagctgacatacttaagtccctaatgtttgaaatgggaaatcctactgtaagcacctttctaaggaggtatgctgatgttgcttctaatgaccaaaaaactccaaatttgcagattgaatttttgggcagctatattggcgagctaagtttgttggactatgattgtttaagattcttgccttctattgtggctgcctcggttatatttcttgccaagttcattatctgtcctgaagtgcatccatggacttcttccttgtgtgaatgctcgggttacaagccagctgagttgaaagaatgtgtccttatcttgcatgacttgtatttgtcaagaaaggcagcatccttcaaagctgttcgggcaaaatacaagcagcaaaagttcgaatgtgtggcaaacctgcctacccctccatatgtaccgagttgttactttgaagaccagtggtgcagtgaattccttgataaatgatcaaaccgaccattgcttgcatgggcatggcttagaaatttgatgcgtaggtttttgtctttgaattgcaagagcaacaggatttcattagataccaaagttcaattcccattcctgatgaactatcagggagaagacctttaaataaggatcaaataacaagatcttagaatgtacaactgcatacttgcaacatgtattaggagaattacggtgtaggatgaaccgaaaattgcattgttcttacagagaatttttatcttagtgaagtagtttttagacatatttgttaggaattttataatttttaattaattaatatggattatatatt

SEQ ID NO: 1369 - protein, 358 aa, Glycine max
  misc_feature (1)..(358): Ceres CLONE ID no.561499
  misc_feature (1)..(358): Bit score of 592.7 for HMM based on sequences of FIGURE 45.
  misc_feature (216)..(343): Pfam Name: Cyclin_C Pfam Description: Cyclin, C-terminal domain
  misc_feature (85)..(214): Pfam Name: Cyclin_N Pfam Description: Cyclin, N-terminal domain
  misc_feature (1)..(358): Functional Homolog Of Ceres SEEDLINE ID no. ME13177 at SEQ ID NO: 1342
METRAAAKRKANAATIVFVEKQYPNKRQRVVLGELPNLQNLIVSETQNSRKEKLLCRKNPNEKKPSPTNNNTFPSPQINESYDSDIHGYLREMEMQNKRRPMVDYIEKVQKIVTPTMRAILVDWLVEVAVEYKLLSDTLHLSVSYIDRFLSVNPVSKSRLQLLGVSSMLIAAKYEEMDPPGVDEFCSITDHTYDKTEVVKMEADILKSLMFEMGNPTVSTFLRRYADVASNDQKTPNLQIEFLGSYIGELSLLDYDCLRFLPSIVAASVIFLAKFIICPEVHPWTSSLCECSGYKPAELKECVLILHDLYLSRKAASFKAVRAKYKQQKFECVANLPTPPYVPSCYFEDQWCSEFLDK

SEQ ID NO: 1370 - protein, 355 aa, Pisum sativum
  misc_feature (1)..(355): Public GI ID no.7242793
  misc_feature (1)..(355): Bit score of 793.6 for HMM based on sequences of FIGURE 45.
  misc_feature (216)..(344): Pfam Name: Cyclin_C Pfam Description: Cyclin, C-terminal domain
  misc_feature (85)..(214): Pfam Name: Cyclin_N Pfam Description: Cyclin, N-terminal domain
  misc_feature (1)..(355): Functional Homolog Of Ceres SEEDLINE ID no. ME13177 at SEQ ID NO: 1342
MADQDNSTRRPQREAKKRAVAALCEQRKRKRVALGDITNDVVSETEKLVSDSHSHTQKKKKRNIAKSPVPEKLEDPQLCEPYVSDIHDYLRNLEVDPSKRPLPDYIQKVQRDINANMRGVLVDWLVEVAEEYKLVADTLYFSVSYIDRFLSLNDLSRQKLQLLGVSSMLIASKYEEIKPPEVEDFCYITDNTYSKEEVLSMEAEILKTLKFELGGPTIKTFLRRFITKVGQEGVDASELQFEFLCCYLAELSLLDYNCVKFLPSMVAASVVFLARFMLNPKSRPWNSAICQFTSYKPADLKECVLNMHDLYLGRKGATLQAVRDKYKQHKFKCVATTPSPPEISLSFFEFRGADP

SEQ ID NO: 1371 - protein, 341 aa, Daucus carota
  misc_feature (1)..(341): Public GI ID no.116167
  misc_feature (1)..(341): Bit score of 710.8 for HMM based on sequences of FIGURE 45.
  misc_feature (208)..(334): Pfam Name: Cyclin_C Pfam Description: Cyclin, C-terminal domain
  misc_feature (77)..(206): Pfam Name: Cyclin_N Pfam Description: Cyclin, N-terminal domain
  misc_feature (1)..(341): Functional Homolog Of Ceres SEEDLINE ID no. ME13177 at SEQ ID NO: 1342
APSMTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 1372 - protein, 372 aa, Catharanthus roseus
  misc_feature (1)..(372): Public GI ID no.2190259
  misc_feature (1)..(372): Bit score of 865.3 for HMM based on sequences of FIGURE 45.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(372): Functional Homolog Of Ceres SEEDLINE ID no. ME13177 at SEQ ID NO: 1342
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPWNSLLQHNSGYKPADLKECVLIIHDLQLSKRGSSLVAVRDKYKQHKFKCVSTLTAPPSIPDEFFEDI

SEQ ID NO: 1373 - protein, 378 aa, Solanum lycopersicum
  misc_feature (1)..(378): Public GI ID no.5420278
  misc_feature (1)..(378): Bit score of 739.5 for HMM based on sequences of FIGURE 45.
  misc_feature (114)..(243): Pfam Name: Cyclin_N Pfam Description: Cyclin, N-terminal domain
  misc_feature (245)..(372): Pfam Name: Cyclin_C Pfam Description: Cyclin, C-terminal domain
  misc_feature (1)..(378): Functional Homolog Of Ceres SEEDLINE ID no. ME13177 at SEQ ID NO: 1342
MVDEENKVPATAAASRGSNKRAFDSIAITNENDPLQISERPYPANKKRVVLGELNNLGNVIVSTQNSDLTETHESKRKIKLRKTRNVVKETVELKTSANSSPKDNLQKCSYGPLIYQHLHSLEVEERRRPLSNYMEKVQNNVIPSMRTVLVDWLVEVTEEYKLVSDTLYLAVSYIDRFLSSHVLAMEKLQLLGVSCMLVASKYEEISPPHVEDFCYITDNTYTREEVVNMERDLLSFLNFEISSPTTITFLRIFLKAAQDNLSFLTLQFEFLSCYLAELSLLDYSCVRFLPSMTAASAIFLSRFTVLPEVCPWTLALQQCTGYKPSELKDCVLVIHELQSSLMEATGRALREKYMNHKYKCVAALHPPDIPSCFFDDA

SEQ ID NO: 1374 - protein, 384 aa, Nicotiana tabacum
  misc_feature (1)..(384): Public GI ID no.1064931
  misc_feature (1)..(384): Bit score of 856.9 for HMM based on sequences of FIGURE 45.
  misc_feature (116)..(245): Pfam Name: Cyclin_N Pfam Description: Cyclin, N-terminal domain
  misc_feature (247)..(374): Pfam Name: Cyclin_C Pfam Description: Cyclin, C-terminal domain
  misc_feature (1)..(384): Functional Homolog Of Ceres SEEDLINE ID no. ME13177 at SEQ ID NO: 1342
MKKQEKEAIMADLENCGRVTRLAKKRAAEAMASHQQQHPSKKRVVLGEIQNFSNLGVSQIKGLNTEPKKQPKSKQQQSKRKLKRAVTSKIDKEELNVDNVDANYDDPQMCSAYVSDIYDYLRKMEIEEKRRPLPDYLEKVQKDLSPNMRGVLVDWLVEVAEEYKLLSDTLYLAVSYIDRFLSTNVITRQKLQLLGVSSMLISAKYEEISPPHVEDFCYITDNTYTKEEVVKMEADVLKTLNFEMGNPTVKTFLRRFTGVAQEDYKTPNLQLEFLGYYLAELSILDYSCVKYVPSLLAAAVVFLSRFTLQPNTHPWSLALQQYSGYKAADLKECILILHDLQLSRRGGSLAAVRDKYKQHKFKCVSSLTSPVEIPASFFEDMRQL

SEQ ID NO: 1375 - protein, 371 aa, Nicotiana tabacum
  misc_feature (1)..(371): Public GI ID no.2196455
  misc_feature (1)..(371): Bit score of 686.1 for HMM based on sequences of FIGURE 45.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(371): Functional Homolog Of Ceres SEEDLINE ID no. ME13177 at SEQ ID NO: 1342
MANEENKAAPTNTSRASNKRAFDDTLAAASSNGNDPLLKRVVLGELTNLEYVVGSTKTNTHNSKHKIKLKKTAPTKRKKIAIQSFKSDAATNFSPNDDLQKCAYAPLIYQHLHSLEVEARRRPLSNYMEKVQNDVTPTMRMILVDWLVEVADEYKLVSDTLYLTVTFVDRFLSSHVMARNSLQLLGVSCMLVASKYEEISPPHVEDFCYITDNTYTGEEVVNMERDLLNFLNFEISNPTTKTFLRIFTKVSQDNVDFLTLHFEFLGCYLAELSLLDYSCVRFLPSAVAASAIFLSRFTLLPKVHPWNLALQHCTGYKPSELKDCVLVIHELQSGRRAASVQAVRKKYMDHKYKCVAALHPPDIPACFFDDA

SEQ ID NO: 1376 - protein, 371 aa, Nicotiana tabacum
  misc_feature (1)..(371): Public GI ID no.1064925
  misc_feature (1)..(371): Bit score of 677.5 for HMM based on sequences of FIGURE 45.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(371): Functional Homolog Of Ceres SEEDLINE ID no. ME13177 at SEQ ID NO: 1342
MANEENKASPTNTSRASNNRAFDDTLAAASSNGNDPLLKRVVLGELTNLEYVVGSTKTNTHNSKRKIKLKKTAPTKRKKVAKQSFKSDAATNFSPNDDLQKCAYAPLIYQHLHSLEVEERRRPLSNYMEKIQNDVTPTMRMILVDWLVEVADEYKLVSDTLYLTVTFIDRFLSSHVLARNSLQLLGVSCMLAASKYEEISPPHVEDFCYITDNTYTGEEVVNMERELLNFLDFEISNPTTKTFLRIFTKAAQDNVDFLTLHFEFLGCYLTELSLLDYSCVQFLPSVVAASAIFLSRFTILPKVHPWNLALQQCTGYKPSELKDCVLVIHELQSGRRAASVQAVRKKYMDHKYKCVAALHPPDIPACFFDDA

SEQ ID NO: 1377 - protein, 437 aa, Petunia x hybrida
  misc_feature (1)..(437): Public GI ID no.6093215
  misc_feature (1)..(437): Bit score of 804.4 for HMM based on sequences of FIGURE 45.
  misc_feature (176)..(301): Pfam Name: Cyclin_N Pfam Description: Cyclin, N-terminal domain
  misc_feature (303)..(427): Pfam Name: Cyclin_C Pfam Description: Cyclin, C-terminal domain
  misc_feature (1)..(437): Functional Homolog Of Ceres SEEDLINE ID no. ME13177 at SEQ ID NO: 1342
MNTNRAVLVPHRGEVGGKQKNGQADGRNNRRVLGDIGNLVTGAPVIEGKPKAQISRPATRSFCAQLLANAQAEKNKVKPLAEVVNKVPAKKKASDKPAVQEAVIVISPDEEVKKKTIEKSPLSKRKAKKTGKTLTSTLTARSKAACGLSNRPKNEIDDIDAADAANHLAVVEYVEDIYNFYKLTEDESRVNNYMEFQPELNHKMRAILVDWLIEVHRKFELMPESLYLTINILDRFLSMKTVPRKELQLVGISAMLIACKYEEIWAPEVNDFMHISDNVYTRDHILQMEKAILGKLEWYLTVPTPYVFLVRYIKAAMPSDDQEIQNMAFFFAELGLMNYTTTISYCPSMLAASAVYAARGTLNKGPLWTPTLQHHTGYSEEQLMECTKQLVSYHKGAAESKLKAIYRKFSSPDRGAVALFPPARNLLPTTTTTTTSS

SEQ ID NO: 1378 - protein, 441 aa, Antirrhinum majus
  misc_feature (1)..(441): Public GI ID no.461726
  misc_feature (1)..(441): Bit score of 771.2 for HMM based on sequences of FIGURE 45.
  misc_feature (192)..(317): Pfam Name: Cyclin_N Pfam Description: Cyclin, N-terminal domain
  misc_feature (319)..(439): Pfam Name: Cyclin_C Pfam Description: Cyclin, C-terminal domain
  misc_feature (1)..(441): Functional Homolog Of Ceres SEEDLINE ID no. ME13177 at SEQ ID NO: 1342
MGSRHQVVQQQNRGDVVPGAIKQKSMAVEKKNRRALGDIGNVVTVRGVEGKALPQVSRPITRGFCAQLIANAEAAAAENNKNSLAVNAKGADGALPIKRAVARVPVQKKTVKSKPQEIIEISPDTEKKKAPVLEKEITGEKSLKKKAPTLTSTLTARSKAASVVRTKPKEQIVDIDAADVNNDLAVVEYVEDMYKFYKSAENDSRPHDYMDSQPEINEKMRAILIDWLVQVHYKFELSPETLYLTINIVDRYLASKTTSRRELQLLGMSSMLIASKYEEIWAPEVNDLVCISDGSYSNEQVLRMEKKILGALEWYLTVPTPYVFLVRFIKASLPDSDVEKNMVYFLAELGMMNYATIIMYCPSMIAAAAVYAARCTLNKMPIWNETLRMHTGFSEVQLMDCAKLLIDFHGGSTDQKLQGIYRKYSRLEKGAVALLPQPLLA

SEQ ID NO: 1379 - protein, 440 aa, Camellia sinensis
  misc_feature (1)..(440): Public GI ID no.89111295
  misc_feature (1)..(440): Bit score of 795.0 for HMM based on sequences of FIGURE 45.
  misc_feature (181)..(306): Pfam Name: Cyclin_N Pfam Description: Cyclin, N-terminal domain
  misc_feature (308)..(437): Pfam Name: Cyclin_C Pfam Description: Cyclin, C-terminal domain
  misc_feature (1)..(440): Functional Homolog Of Ceres SEEDLINE ID no. ME13177 at SEQ ID NO: 1342
MGSRAVVVPDQQPRGRGGKQKNGQAEGRNRRVLRDIGNLVPVPTVEEKPQNQISRPVTRSLCVQPAAAAEKKNKKPLAEVVNGGGEVKAAAAAHKKHYDPPKPETVIVISSDEELESEEKKKPVAVIARKSRVGSSRTMTSILTARSKALCGPTTKPKVPIADIDAADVDNELAVVEYVEDIYKFYKLTEGESRVHDYMDSQPEINSKMRSILIDWLTEVHRKFELMPETLYLTINIVDRYLSMNAVPRRELQLVGISSMLIACKYEEIWAPEVSDFIVISDNAYVREQILIMEKAILGKLEWYLTVPTPYVFLVRFIKASVPSNDHREEMENMVFFLAELGLMHYPTIILYCPSMIAASAVYAARCTLNSNPLWTETLKHHTGYSEDQLGDCAKMLARFHSDGGGVEKSKLKAVYKKFSSSDRSSVALFPPARSLLLVL

SEQ ID NO: 1380 - protein, 405 aa, Allium cepa
  misc_feature (1)..(405): Public GI ID no.82949283
  misc_feature (1)..(405): Bit score of 718.1 for HMM based on sequences of FIGURE 45.
  misc_feature (152)..(278): Pfam Name: Cyclin_N Pfam Description: Cyclin, N-terminal domain
  misc_feature (280)..(400): Pfam Name: Cyclin_C Pfam Description: Cyclin, C-terminal domain
  misc_feature (1)..(405): Functional Homolog Of Ceres SEEDLINE ID no. ME13177 at SEQ ID NO: 1342
MAGADENHGAVKLANFRETTNRRALKDIKNFVGAPSFPCAANKRQLKEVVCGNNDSVIPRRPITRQFASTLASKSQQSHGETSNKHGQITGNEKHNPIIIDEDVPMVEESEEMEECELVEEITMEDIVIDSAQDIDIGDVGNPLAVVDYVDDIYNYYRRVEASSCVHPDYMSNQFDINDKMRAILIDWLVEVHYKFELMEETLYLTVNIIDRFLSRQAVVRKKLQLVGVTAMLLACKYEEVSVPVVDDLVTISDRAYTRKEVLDMEKSIVKTLQFNTSVPTPFVFLRRFLKAAGSEKKLELLSSFIIELSLVEYQMLKFQPSLLAAAAIYTAQCSLKGFKFWTRTCEQYTMYTEDQLLECSKMMVGFHRNAGSGKLTGVHRKYSTSKFGFAGKSYPALFLLDNRL

SEQ ID NO: 1381 - protein, 385 aa, Oryza sativa subsp. indica
  misc_feature (1)..(385): Public GI ID no.125537180
  misc_feature (1)..(385): Bit score of 777.7 for HMM based on sequences of FIGURE 45.
  misc_feature (118)..(247): Pfam Name: Cyclin_N Pfam Description: Cyclin, N-terminal domain
  misc_feature (249)..(376): Pfam Name: Cyclin_C Pfam Description: Cyclin, C-terminal domain
  misc_feature (1)..(385): Functional Homolog Of Ceres SEEDLINE ID no. ME13177 at SEQ ID NO: 1342
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIESVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYSCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 1382 - protein, 385 aa, Oryza sativa subsp. japonica
  misc_feature (1)..(385): Public GI ID no.115489300
  misc_feature (1)..(385): Bit score of 779.1 for HMM based on sequences of FIGURE 45.
  misc_feature (118)..(247): Pfam Name: Cyclin_N Pfam Description: Cyclin, N-terminal domain
  misc_feature (249)..(376): Pfam Name: Cyclin_C Pfam Description: Cyclin, C-terminal domain
  misc_feature (1)..(385): Functional Homolog Of Ceres SEEDLINE ID no. ME13177 at SEQ ID NO: 1342
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIEAVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 1383 - protein, 351 aa, Ostreococcus tauri
  misc_feature (1)..(351): Public GI ID no.55978000
  misc_feature (1)..(351): Bit score of 619.8 for HMM based on sequences of FIGURE 45.
  misc_feature (102)..(228): Pfam Name: Cyclin_N Pfam Description: Cyclin, N-terminal domain
  misc_feature (230)..(350): Pfam Name: Cyclin_C Pfam Description: Cyclin, C-terminal domain
  misc_feature (1)..(351): Functional Homolog Of Ceres SEEDLINE ID no. ME13177 at SEQ ID NO: 1342
MITGAQGVRQTRSKTTYEVPQQQQQQSFEWGRTSQRTSHGKPRRGSVMGGTMTTAGADVDMRESYSTYLERSSAADVMTDALPDIDLYDHDNPLAVTQYVNDIYQYWYKVEPDTRVSETYMLIQGDINYKMRAILIDWLVEVHLKFKLMPETLFLTTNLIDRFLELKTVTRRNLQLVGVTAMLVASKYEEIWAPEVRDFVYISDRAYTRQQILEMEKQMLNTLGFHLTVPTPYCFLNRFFKAAGGDRQFQLYASYAVECALPEYGMLKYSGSTLAAAGVYIAIRGLQTGSWNHTMEAHTRLSESEVYPCACDMAELMRKAPTATLTAVYKKYSSEKFMKIATLPVPHDLRL

SEQ ID NO: 1384 - DNA, 632 bp, Zea mays
  misc_feature (1)..(632): Ceres SEEDLINE ID no.ME13200
  misc_feature (1)..(632): Ceres CLONE ID no.896483
  misc_feature (1)..(632): Inplanta Sequence
  misc_feature (1)..(632): Encodes the peptide sequence at SEQ ID NO. 1385
aaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgactatgacgtcaagatgattgaatcaggccacgtgccgtaccccaagtacaagacacatggattctggacctgaggttgaaatgttggagggctcaaggaggcagaaaacaaagctctatgaatctaagatggacctaggttctagaaggaagcaaagaaatccagccatggttggaaaataaaatgatgaaacagtgtgcatatgtatagtataggttatgagcaagtttatgtttacctgtggttgtaggatctagtgtaccttcacaaactgcatgatttcattattcccttgaactaagttatggaggatgtaaactcatgtatttatgaaaactaaaaaaatattgccttgtagc

SEQ ID NO: 1385 - protein, 85 aa, Zea mays
  misc_feature (1)..(85): Ceres SEEDLINE ID no.ME13200
  misc_feature (1)..(85): Ceres CLONE ID no.896483
  misc_feature (12)..(62): Pfam Name: Myb_DNA-binding Pfam Description: Myb-like DNA-binding domain
  misc_feature (1)..(85): Bit score of 200.8 for HMM based on sequences of FIGURE 46.
MSASRSSSPNSISQWSQKENKMFEEALAYYGEGTSNRWDKVSRAMGGIKSAEEVRCHYEDLDYDVKMIESGHVPYPKYKTHGFWT

SEQ ID NO: 1386 - DNA, 279 bp, Populus balsamifera subsp. trichocarpa
  misc_feature (1)..(279): Ceres ANNOT ID no.1503394
  misc_feature (1)..(279): Encodes the peptide sequence at SEQ ID NO 1387
atgtcttccagccatcaaactccaaggaattctagctcctcttggacaccaagggaaaacaaactgtttgaaaaggctctagccttgtttgataaggacacaccggaccggtggcaaaatatagccaaagctgttggtggcgtgaaatcagctgaggaaatgaagagacactacgaaatcctcattgaagatcttaaacatatcgagtccggccgtgttcctattcctaattacaagtccagtagaagctacagcaatacaaacgaagaagaaaggtaa

SEQ ID NO: 1387 - protein, 92 aa, Populus balsamifera subsp. trichocarpa
  misc_feature (1)..(92): Ceres ANNOT ID no.1503394
  misc_feature (1)..(92): Bit score of 210.1 for HMM based on sequences of FIGURE 46.
  misc_feature (12)..(58): Pfam Name: Myb_DNA-binding Pfam Description: Myb-like DNA-binding domain
  misc_feature (1)..(92): Functional Homolog Of Ceres SEEDLINE ID no. ME13200 at SEQ ID NO: 1385
MSSSHQTPRNSSSSWTPRENKLFEKALALFDKDTPDRWQNIAKAVGGVKSAEEMKRHYEILIEDLKHIESGRVPIPNYKSSRSYSNTNEEER

SEQ ID NO: 1388 - DNA, 375 bp, Populus balsamifera subsp. trichocarpa
  misc_feature (1)..(375): Ceres ANNOT ID no.1460824
  misc_feature (1)..(375): Encodes the peptide sequence at SEQ ID NO 1389
atgtcttcaagctatcaagcttccagaaattctagatccgcttggacaccaagggaaaacaaactgtttgaaaaggcactagccttgtttgataaggacacaccggacaggtggcaaaatatagccaaagctgttggtggtgtgaaatctgccgaggaagtgaagaaacactatgaaatccttattgaagatcttcaacatatcgagtctggccgcattcctattcctaagtacaagtctagtggaagctgcaacaacacaaacgaagaggaaagtgaagttaataagaacaaactgcagatggcaactggcaatctccatattgactcattgagagtcctccaggatttcatggcagggtgtaatcaacattaa

SEQ ID NO: 1389 - protein, 124 aa, Populus balsamifera subsp. trichocarpa
  misc_feature (1)..(124): Ceres ANNOT ID no.1460824
  misc_feature (1)..(124): Bit score of 207.5 for HMM based on sequences of FIGURE 46.
  misc_feature (12)..(58): Pfam Name: Myb_DNA-binding Pfam Description: Myb-like DNA-binding domain
  misc_feature (1)..(124): Functional Homolog Of Ceres SEEDLINE ID no. ME13200 at SEQ ID NO: 1385
MSSSYQASRNSRSAWTPRENKLFEKALALFDKDTPDRWQNIAKAVGGVKSAEEVKKHYEILIEDLQHIESGRIPIPKYKSSGSCNNTNEEESEVNKNKLQMATGNLHIDSLRVLQDFMAGCNQH

SEQ ID NO: 1390 - protein, 97 aa, Arabidopsis thaliana
  misc_feature (1)..(97): Public GI ID no.4914437
  misc_feature (1)..(97): Bit score of 216.1 for HMM based on sequences of FIGURE 46.
  misc_feature (11)..(60): Pfam Name: Myb_DNA-binding Pfam Description: Myb-like DNA-binding domain
  misc_feature (1)..(97): Functional Homolog Of Ceres SEEDLINE ID no. ME13200 at SEQ ID NO: 1385
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 1391 - protein, 98 aa, Arabidopsis thaliana
  misc_feature (1)..(98): Public GI ID no.112292446
  misc_feature (1)..(98): Bit score of 215.9 for HMM based on sequences of FIGURE 46.
  misc_feature (9)..(58): Pfam Name: Myb_DNA-binding Pfam Description: Myb-like DNA-binding domain
  misc_feature (1)..(98): Functional Homolog Of Ceres SEEDLINE ID no. ME13200 at SEQ ID NO: 1385
SSSMSSQSSGSWTAKQNKAFEQALATYDQDTPNRWQNVAKVVGGKTTEEVKRHYELLVQDINSIENGHVPFPNYRTSGGCTNGRLSQEEKRMRNMRLQ

SEQ ID NO: 1392 - DNA, 458 bp, Glycine max
  misc_feature (1)..(458): Ceres CLONE ID no.638126
  misc_feature (1)..(458): Encodes the peptide sequence at SEQ ID NO 1393
tttatcagtcatggcgtcaagctctctcagcaaacaaaaggcttctgactcctcttggacaccaaaacagaacaagctgtttgaaaaagcacttgcaaaatatgacaaggatacccctgaccgatggcagaatgtagccaaagcagtaggtggaaaatctgcagatgaagttaagagacactatgaaatcctcttggaggatctgagacacattgagtctggtcatgttcctcttcccaagtacaagtccacaggaagcagcaccaatgttgaggaagaagagaggcttctgaagtatcttaaactgaattgatggaagcaatgtttatgttatcctcagctattggcagaatttatgtggccatccttgaatctgcggaaatatcttccctctctgttctatttcctgccattgtaatttagattgtttcaaatttcaatgaattatcctattctag

SEQ ID NO: 1393 - protein, 100 aa, Glycine max
  misc_feature (1)..(100): Ceres CLONE ID no.638126
  misc_feature (1)..(100): Bit score of 227.4 for HMM based on sequences of FIGURE 46.
  misc_feature (13)..(62): Pfam Name: Myb_DNA-binding Pfam Description: Myb-like DNA-binding domain
  misc_feature (1)..(100): Functional Homolog Of Ceres SEEDLINE ID no. ME13200 at SEQ ID NO: 1385
MASSSLSKQKASDSSWTPKQNKLFEKALAKYDKDTPDRWQNVAKAVGGKSADEVKRHYEILLEDLRHIESGHVPLPKYKSTGSSTNVEEEERLLKYLKLN

SEQ ID NO: 1394 - protein, 92 aa, Medicago truncatula
  misc_feature (1)..(92): Public GI ID no.124360540
  misc_feature (1)..(92): Bit score of 214.9 for HMM based on sequences of FIGURE 46.
  misc_feature (9)..(58): Pfam Name: Myb_DNA-binding Pfam Description: Myb-like DNA-binding domain
  misc_feature (1)..(92): Functional Homolog Of Ceres SEEDLINE ID no. ME13200 at SEQ ID NO: 1385
MASSSMSASGSWSVKENKAFERALAVYDKDTPDRWYNVAHAVGGKTPEEVKKHYELLVEDIKHIESGKVPFPNYKKISVSHEEKRMRNMSLH

SEQ ID NO: 1395 - protein, 88 aa, Solanum lycopersicum
  misc_feature (1)..(88): Public GI ID no.7981380
  misc_feature (1)..(88): Bit score of 199.8 for HMM based on sequences of FIGURE 46.
  misc_feature (11)..(60): Pfam Name: Myb_DNA-binding Pfam Description: Myb-like DNA-binding domain
  misc_feature (1)..(88): Functional Homolog Of Ceres SEEDLINE ID no. ME13200 at SEQ ID NO: 1385
MSSMSSQHGSSGSWTAKQNKAFEKALAVYDKETRDRWSNVAKAVGGKTAEEVKRHYEILLRDVFFIDNGMVPFPKYKTTGGSHNSTSD

SEQ ID NO: 1396 - protein, 93 aa, Antirrhinum majus
  misc_feature (1)..(93): Public GI ID no.118137433
  misc_feature (1)..(93): Bit score of 214.0 for HMM based on sequences of FIGURE 46.
  misc_feature (8)..(57): Pfam Name: Myb_DNA-binding Pfam Description: Myb-like DNA-binding domain
  misc_feature (1)..(93): Functional Homolog Of Ceres SEEDLINE ID no. ME13200 at SEQ ID NO: 1385
MASTRGSGRPWSAKENKAFERALAVYDKDTPDRWANVARAVEGRTPEEVKKHYEILVEDIKYIESGKVPFPNYRTTGGNMKTDEKRFRNLKIR

SEQ ID NO: 1397 - DNA, 563 bp, Musa acuminata
  misc_feature (1)..(563): Ceres CLONE ID no.1723374
  misc_feature (1)..(563): Encodes the peptide sequence at SEQ ID NO 1398
acacagatcagctagctccaccagagaagcaaagcaaacccttcttccctgagatggcatccggttcgatgagctcctcctggaccgcgaaggagaacaagatgttcgagaaggcactggcggtgtacgacagggacacccccgaccgctggcacaagatcgcccgggccatcggcgggaagacggcggacgaagtgaagcgctactacgacctgctcgtggaggacgtgcgccgcatcgaggctggccaaatgccgtacgccaattaccggtcctctaatggcagaggttgagagtgtttggagctcaaccggagaacgaacaagaagcaaggagcatttcactgttctggatatcagttaccacaatcttaattataggactatatgaactctacatgtctgtggacttacaagtagtttcttctatgcagtcttctttctcccttctatcgtgtactcccagatatatcgaagactgccatcataaacatatatatggctagtcttcttgtaatcggttatcttgcttgctaatgaacgcttagtattgttctattctag

SEQ ID NO: 1398 - protein, 79 aa, Musa acuminata
  misc_feature (1)..(79): Ceres CLONE ID no.1723374
  misc_feature (1)..(79): Bit score of 180.5 for HMM based on sequences of FIGURE 46.
  misc_feature (7)..(56): Pfam Name: Myb_DNA-binding Pfam Description: Myb-like DNA-binding domain
  misc_feature (1)..(79): Functional Homolog Of Ceres SEEDLINE ID no. ME13200 at SEQ ID NO: 1385
MASGSMSSSWTAKENKMFEKALAVYDRDTPDRWHKIARAIGGKTADEVKRYYDLLVEDVRRIEAGQMPYANYRSSNGRG

SEQ ID NO: 1399 - DNA, 662 bp, Panicum virgatum
  misc_feature (1)..(662): Ceres CLONE ID no.1785379
  misc_feature (1)..(662): Encodes the peptide sequence at SEQ ID NO 1400
aaaaccgtaagagcttctgaggagcaaaagacttcagtctagacactagacacagtaaaccttagcaccaacccaggttcagtatcttaccaaggatactccaaatatggctggatcacagagctcctctcccaattccaactcaacgtggagcctgaaagagaacaagatgtttgaagaggcactcgcctactatggtgagggcacacccaacctgtgggacaaagtgtccagcgccataggaggcatcaagtctgctgaggaggtgcgctgccactatgaagatcttgttgacgacgtcaagatgattgagtcagggcgggttacgtaccccaagtacaagacgcagggattctggacccgaggttgaagcatcagaagctcaagtgggccgaaacaaaagttccaagaatctatgattcacttaggttctagaaggaagcgaagtaatccaattctggttggagaataaaatgatgaaacattgtgtatatgtatatagtagataattagcaatgttaagtctctttgttgttgtaggatctagtttacattcataaaccccctgtatacattatccccttaaactaagttatgaagatgtaaaatcatgtatttatgttaattaaaaaagttgtgcctggtagcattctgttgcctcg

SEQ ID NO: 1400 - protein, 87 aa, Panicum virgatum
  misc_feature (1)..(87): Ceres CLONE ID no.1785379
  misc_feature (1)..(87): Bit score of 202.6 for HMM based on sequences of FIGURE 46.
  misc_feature (12)..(62): Pfam Name: Myb_DNA-binding Pfam Description: Myb-like DNA-binding domain
  misc_feature (1)..(87): Functional Homolog Of Ceres SEEDLINE ID no. ME13200 at SEQ ID NO: 1385
MAGSQSSSPNSNSTWSLKENKMFEEALAYYGEGTPNLWDKVSSAIGGIKSAEEVRCHYEDLVDDVKMIESGRVTYPKYKTQGFWTRG

SEQ ID NO: 1401 - protein, 85 aa, Oryza sativa subsp. indica
  misc_feature (1)..(85): Public GI ID no.125553354
  misc_feature (1)..(85): Bit score of 202.2 for HMM based on sequences of FIGURE 46.
  misc_feature (12)..(62): Pfam Name: Myb_DNA-binding Pfam Description: Myb-like DNA-binding domain
  misc_feature (1)..(85): Functional Homolog Of Ceres SEEDLINE ID no. ME13200 at SEQ ID NO: 1385
MSGSRSSSPNSKSEWSRKENKMFEEALAYYGEDTPNRWDKVASAMGGIKSAEEIRCHYEDLTDDVKTIESGRVQFPKYKTQGYWT

SEQ ID NO: 1402 - protein, 91 aa, Oryza sativa subsp. indica
  misc_feature (1)..(91): Public GI ID no.125527154
  misc_feature (1)..(91): Bit score of 169.9 for HMM based on sequences of FIGURE 46.
  misc_feature (18)..(68): Pfam Name: Myb_DNA-binding Pfam Description: Myb-like DNA-binding domain
  misc_feature (1)..(91): Functional Homolog Of Ceres SEEDLINE ID no. ME13200 at SEQ ID NO: 1385
MSSRSSSSSRNSNSVNMDSEWSKKENKLFEEALAYYGEGAPDLFHKVSRAMGGTKTADEVRRHYEILEDDLKLIEARRVPFPKYNTQGAWN

SEQ ID NO: 1403 - protein, 75 aa, Oryza sativa subsp. indica
  misc_feature (1)..(75): Public GI ID no.125558161
  misc_feature (1)..(75): Bit score of 162.3 for HMM based on sequences of FIGURE 46.
  misc_feature (2)..(52): Pfam Name: Myb_DNA-binding Pfam Description: Myb-like DNA-binding domain
  misc_feature (1)..(75): Functional Homolog Of Ceres SEEDLINE ID no. ME13200 at SEQ ID NO: 1385
MASEWSKEENKLFEQAIAYYGEGAPDLWHKVSRAMGGTKTADEVRRHFEILVDDIKLIEARRVPFPKYNTQGAWN

SEQ ID NO: 1404 - protein, 75 aa, Oryza sativa subsp. japonica
  misc_feature (1)..(75): Public GI ID no.115471859
  misc_feature (1)..(75): Bit score of 159.7 for HMM based on sequences of FIGURE 46.
  misc_feature (2)..(52): Pfam Name: Myb_DNA-binding Pfam Description: Myb-like DNA-binding domain
  misc_feature (1)..(75): Functional Homolog Of Ceres SEEDLINE ID no. ME13200 at SEQ ID NO: 1385
MASEWSKEENKLFEQAIAYYGEGAPDLWHKVSRAMGGTKTADEVRLHFEILVDDIKLIEARRVPFPKYNTQGAWN

SEQ ID NO: 1405 - protein, 87 aa, Oryza sativa subsp. japonica
  misc_feature (1)..(87): Public GI ID no.55773837
  misc_feature (1)..(87): Bit score of 143.1 for HMM based on sequences of FIGURE 46.
  misc_feature (18)..(68): Pfam Name: Myb_DNA-binding Pfam Description: Myb-like DNA-binding domain
  misc_feature (1)..(87): Functional Homolog Of Ceres SEEDLINE ID no. ME13200 at SEQ ID NO: 1385
MSSRSSSSSRNSNSVNMDSEWSKKENKLFEEALAYYGEGAPDLFHKVSRAMGGTKTADEVRRHYEILEDDLKLIEARRVPFPKGGSI

SEQ ID NO: 1406 - DNA, 330 bp, Sorghum bicolor
  misc_feature (1)..(330): Ceres ANNOT ID no.6040771
  misc_feature (1)..(330): Encodes the peptide sequence at SEQ ID NO 1407
atgtctgcctcgcggagctcctctcccaactccatgtcaaagtggagccccaaagagaacaagatgtttgaacaggcactcgcctactatggcgagggcacacccaaccggtgggacaaggtgtccagcgccatgggaggcatcaagtctgctgaggaggtgcgctgccactatgaagatcttgactatgacgtcaagatgattgagtcaggccatgtaccgtacccccagtacaagacacagggattctggacccgaggctcactaatgcccactaattatgtgggctccaatcctagtattatgacaaaaatctcctacttccaatag

SEQ ID NO: 1407 - protein, 109 aa, Sorghum bicolor
  misc_feature (1)..(109): Ceres ANNOT ID no.6040771
  misc_feature (1)..(109): Bit score of 213.7 for HMM based on sequences of FIGURE 46.
  misc_feature (12)..(62): Pfam Name: Myb_DNA-binding Pfam Description: Myb-like DNA-binding domain
  misc_feature (1)..(109): Functional Homolog Of Ceres SEEDLINE ID no. ME13200 at SEQ ID NO: 1385
MSASRSSSPNSMSKWSPKENKMFEQALAYYGEGTPNRWDKVSSAMGGIKSAEEVRCHYEDLDYDVKMIESGHVPYPQYKTQGFWTRGSLMPTNYVGSNPSIMTKISYFQ

SEQ ID NO: 1408 - DNA, 955 bp, Zea mays
  misc_feature (1)..(955): Ceres SEEDLINE ID no.ME13204
  misc_feature (1)..(955): Ceres CLONE ID no.995409
  misc_feature (1)..(955): Inplanta Sequence
  misc_feature (1)..(955): Encodes the peptide sequence at SEQ ID NO. 1409
gtagtaaactattattagcctttctatttatagtggctgagagacgggcggacattctcgtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaaggcggcggcggcgcgcatgaacgacaccagtagtagtgacatgcaggtcatcacacccgcgccgctcgctatctcgacggcggctcgaatggggccggacgggtgctccggggaggacgtggcggtgtaccagagcagcgccaaccctctgcccagcggcatcccggcctacaccgtgcgcatcatcaacgtctgcagcggggggtgcaccgtctacgacgtccacgtctcctgcggcgacttcgcgtccacggagctggtcgacccggccaagttccagcgcgtcggcttcaacgactgcgtcgtcaagggcggtggcgcgctcgagcccagcgagaccgtctccttccagtactccaactccttctcgtaccacctcagcgttgcgtccgtcgcttgccgttagataactgctggtgagccagtgccgttaaataactgaagccgtcggcccgtgatgatatatatataacacctggagtagctagctagttccacgtacgtgttggtgttgtgttgagtagtctacgtatgtgtacttcgatctgcattgtgtttgtgtgtgtctaactatttctacggtcgttgttgtcgctacacgtttttacgtctaatactatagtctggtg

SEQ ID NO: 1409 - protein, 178 aa, Zea mays
  misc_feature (1)..(178): Ceres SEEDLINE ID no.ME13204
  misc_feature (1)..(178): Ceres CLONE ID no.995409
  misc_feature (1)..(178): Bit score of 373.2 for HMM based on sequences of FIGURE 47.
MGQRRFEDERAALATVASLLLILTTAQAAAAAASGRHLSLPTQKAAAARMNDTSSSDMQVITPAPLAISTAARMGPDGCSGEDVAVYQSSANPLPSGIPAYTVRIINVCSGGCTVYDVHVSCGDFASTELVDPAKFQRVGFNDCVVKGGGALEPSETVSFQYSNSFSYHLSVASVACR

SEQ ID NO: 1410 - DNA, 838 bp, Brassica napus
  misc_feature (1)..(838): Ceres CLONE ID no.939980
  misc_feature (1)..(838): Encodes the peptide sequence at SEQ ID NO 1411
gtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtcgtcgtcgtgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaacccagcgagaccgtctccttccagtactccaactccttctcctaccagctcagtgtcgcctccgtcgcgtgccactagagatcatcgaccactactactagatgatcatcgtcggtcgtcgttacgttgtgctgtactagtactactgctgttgttatgctaaccagctagttccacgtacgttaattgttgagtctatctgcatgcacttctgtttaatttccatcgtgtgtgtgtaactatatatttctacggtcgtcgtagttcggcatcaaactggaagtgatcaatcaatggaaaaatctctatctct

SEQ ID NO: 1411 - protein, 169 aa, Brassica napus
  misc_feature (1)..(169): Ceres CLONE ID no.939980
  misc_feature (1)..(169): Bit score of 239.2 for HMM based on sequences of FIGURE 47.
  misc_feature (1)..(169): Functional Homolog Of Ceres SEEDLINE ID no. ME13204 at SEQ ID NO: 1409
MGEWCFKKRAALVIIVAIISSLQLLLITAQEAGGDHEVWSSSSSPAGGRGGGAVVVPTARMGPDGSSSCSGEEAVVVYQSSANPLPSGIPAYTVQIINVCGGGCTVYDVHVSCGDFASTELVDPAKFQRVAFDDCVVKGGAALEPSETVSFQYSNSFSYQLSVASVACH

SEQ ID NO: 1412 - DNA, 932 bp, Gossypium hirsutum
  misc_feature (1)..(932): Ceres CLONE ID no.1939206
  misc_feature (1)..(932): Encodes the peptide sequence at SEQ ID NO 1413
aggcattgcttatcttctttcgaaatccgagttcctttttcgagctaaaagaaatcccaaaacgcatgcgtttaactgttgattctcttctctgtcacgaatcctaagattttctggtatctgaaacacccatcaaaagaaaataagaaaactcttcgtttgtctttttttcccccatggcgttttgagcacctcttatcaactcgaggctcaactcacctgcttcaagttccccgagtctactcgttgaccattaagacttggagaagagaatctgataaaagagggtttctcctttttcttcttcgtttgaatttttggttgctttcaccgatgaatcggcgattcctatttgtactatcatcgttgtccttcgccgtattattccttttcctcgtcgcccttttctcaggtcaaggtaaaaacatcaatggctcatttggtttgaagctattgaggctaaggatcaaccaagggaaccacacccttttaacgccacatcgcaagcttcttcgaacagcactggcggaacccaaccggatatggggagagaagtgtagtaaagctgacatagtgataaaccagggacccaccgccccactgccaagcggcattcccacctacacagtggaaatcctgaacgtatgtgtgagtggctgtgacatctcagggatccacttaacctgcggctggttcagctccgctcgtctcatcaaccccaaaatattcaagcgccttcgttacaatgactgcctcgtgaacgacggcaagccattgatcaacggtggcactctctcctttcaatacgctaataccttcctttacccactttctgtctctcgtgtggtgtgttcttagtaatatacccataaacacttggttagttttccatgcatatatcatcatgaatggatcctattgggtttttgccg

SEQ ID NO: 1413 - protein, 174 aa, Gossypium hirsutum
  misc_feature (1)..(174): Ceres CLONE ID no.1939206
  misc_feature (1)..(174): Bit score of 383.7 for HMM based on sequences of FIGURE 47.
  misc_feature (1)..(174): Functional Homolog Of Ceres SEEDLINE ID no. ME13204 at SEQ ID NO: 1409
MNRRFLFVLSSLSFAVLFLFLVALFSGQGKNINGSFGLKLLRLRINQGNHTLLTPHRKLLRTALAEPNRIWGEKCSKADIVINQGPTAPLPSGIPTYTVEILNVCVSGCDISGIHLTCGWFSSARLINPKIFKRLRYNDCLVNDGKPLINGGTLSFQYANTFLYPLSVSRVVCS

SEQ ID NO: 1414 - DNA, 624 bp, Populus balsamifera subsp. trichocarpa
  misc_feature (1)..(624): Ceres ANNOT ID no.1453316
  misc_feature (1)..(624): Encodes the peptide sequence at SEQ ID NO 1415
atggaaggagagctcaaaatgagaggtggtgatctgatcaggccaggaagattttgcatactctcagtggctaccattattagttctttgcttgctgtgttctttgaagatatctaccatagtagcatgcacgcaagcagccttgtaagtcttttattaaacccggtccaaacccagtcattgactgagttgtttcatttgaaagctgttagtgaaattggctctaaaaaaccagtcttctacaaggaaaacaacaccaattttgccaggaagctactgcagttacctgatgctgggagtacgaaccgcataggcgcagcttgttcaaaggatggcattgatatagttcaaggctcaacagctcctcttccaaatggcataccatcatacacggttcaaatactgaatgtttgtgtctccggttgtagtatatcaaacattcatgtcagttgtggatggttcagctcagccaaactgataaatcctagtgtgtttcgacgaatttactacgacgattgccttgttaatgatggagaacctcttggccctggagaaaccctctccttccagtatgctaacagttttctgtacccattatccgtctcttctgttgcctgttgttaa

SEQ ID NO: 1415 - protein, 207 aa, Populus balsamifera subsp. trichocarpa
  misc_feature (1)..(207): Ceres ANNOT ID no.1453316
  misc_feature (1)..(207): Bit score of 403.0 for HMM based on sequences of FIGURE 47.
  misc_feature (1)..(207): Functional Homolog Of Ceres SEEDLINE ID no. ME13204 at SEQ ID NO: 1409
MEGELKMRGGDLIRPGRFCILSVATIISSLLAVFFEDIYHSSMHASSLVSLLLNPVQTQSLTELFHLKAVSEIGSKKPVFYKENNTNFARKLLQLPDAGSTNRIGAACSKDGIDIVQGSTAPLPNGIPSYTVQILNVCVSGCSISNIHVSCGWFSSAKLINPSVFRRIYYDDCLVNDGEPLGPGETLSFQYANSFLYPLSVSSVACC

SEQ ID NO: 1416 - DNA, 498 bp, Populus balsamifera subsp. trichocarpa
  misc_feature (1)..(498): Ceres ANNOT ID no.1458721
  misc_feature (1)..(498): Encodes the peptide sequence at SEQ ID NO 1417
atgatgctcatcattacaggttgcagtcttggaataaaaacaggtggttcagataagtttttgcaatcatgtgatggaagtaataaccaatcaacaacactaaccaccataagacaacagtcatactcaagccacagaaagctttcgccagacttcaagtttccctggaagtctatacttcttcttgtctcaaatggtacttgcacaaacagagatataagcatctcacaaagtagagatactacttctgggatcccacagtacatagtgcagattgtcaacacttgcgtttatggttgtgctccttcaaatatccatctccattgtggctggtttgcctctgcaagaatggttaacccaagaaccttcaaaaggctctcttatgatgattgcttggtaaatggagggaaagctttgaagactagtcagactgtcagattcacatactcaaactccttcatgtacgcactccaattcaagtctgccaagttctgctga

SEQ ID NO: 1417 - protein, 164 aa, Populus balsamifera subsp. trichocarpa
  misc_feature (1)..(164): Ceres ANNOT ID no.1458721
  misc_feature (1)..(164): Bit score of 157.1 for HMM based on sequences of FIGURE 47.
  misc_feature (1)..(164): Functional Homolog Of Ceres SEEDLINE ID no. ME13204 at SEQ ID NO: 1409
MLIITGCSLGIKTGGSDKFLQSCDGSNNQSTTLTTIRQQSYSSHRKLSPDFKFPWKSILLLVSNGTCTNRDISISQSRDTTSGIPQYIVQIVNTCVYGCAPSNIHLHCGWFASARMVNPRTFKRLSYDDCLVNGGKALKTSQTVRFTYSNSFMYALQFKSAKFC

SEQ ID NO: 1418 - protein, 179 aa, Arabidopsis thaliana
  misc_feature (1)..(179): Public GI ID no.79319075
  misc_feature (1)..(179): Bit score of 400.8 for HMM based on sequences of FIGURE 47.
  misc_feature (1)..(179): Functional Homolog Of Ceres SEEDLINE ID no. ME13204 at SEQ ID NO: 1409
MRMEHIYKFQHWLFFIGLGVLLSLSLSVKANDFEGSNDRRSIALKARSFVSINENRTALSRKLLLSPDIGDGTNRIGQDCSKDDIVLFQGSTNPLPSGVPSYTVEIFNSCVSDCNIAEIHVSCGWFSSVRLVNPRVFRRLDYDDCLVNDGQPLGPGQSLSFQYANSFSYPLSVASVSCF

SEQ ID NO: 1419 - protein, 161 aa, Medicago truncatula
  misc_feature (1)..(161): Public GI ID no.124359953
  misc_feature (1)..(161): Bit score of 330.2 for HMM based on sequences of FIGURE 47.
  misc_feature (1)..(161): Functional Homolog Of Ceres SEEDLINE ID no. ME13204 at SEQ ID NO: 1409
MSFYLFFLFITMPLIVFCDFEMPSGSSTQIFHSFHEDKNGSLTVSEKVEHAHYTPRKFWFHGSCTKRDISISQSKGSTSGIPQYIVQIVNTCVSGCAPYDIHLHCGWFASARIINPKLFKRLSYDDCLVHGGKPLTSNQIIRFTYSNSFMYPLAFKSARFC

SEQ ID NO: 1420 - DNA, 774 bp, Triticum aestivum
  misc_feature (1)..(774): Ceres CLONE ID no.891431
  misc_feature (1)..(774): Encodes the peptide sequence at SEQ ID NO 1421
aaggtactccgtccacacagggctgtgaagagagaattagatcagcctcggggctagaacaggaaggcgccatggcatgctttcggagtcgttcaagagctgcggccgtggtcgttgtcaccatgctcctgctccaagcttgcagtgaagtttcagcatcttcctcgccgcagttccgcaagatgttggtcagcgtcaatgcatcttccatgtcatcgagcggcggcggaggccactcggcggagccgttggagctggaggagtgctcgaaggacctcctggaggtttttcagaacaacgcgccgagcatggccggcggcatgccgacctacagcgtcgagatcaccaacacctgcatcgactgcgccgtgtgcgacgtccacatcgcatgcggcgacttcgcctcaaatgacgtcatcgacccagacaagttccgccgcctcggtttcaacgactgcctcgtcaatggcggcgggtccatcgagcccagcttccctgtgtcgttccagtacggcaactcctttccctacccgatgacagtcgcgtccgcctcctgtgactgtaactagctatatatggctagggtacgaatgaagctatctattttcgttacaaataaaatcaagtagagctcggctaccggcttgtggtctaatcttacttctggagctactgttatctactactccctccgtccggaaatacttattatcaaaataaataaaatgtgatgtatctagatatatattggttttagatacatatctttttatc

SEQ ID NO: 1421 - protein, 165 aa, Triticum aestivum
  misc_feature (1)..(165): Ceres CLONE ID no.891431
  misc_feature (1)..(165): Bit score of 327.8 for HMM based on sequences of FIGURE 47.
  misc_feature (1)..(165): Functional Homolog Of Ceres SEEDLINE ID no. ME13204 at SEQ ID NO: 1409
MACFRSRSRAAAVVVVTMLLLQACSEVSASSSPQFRKMLVSVNASSMSSSGGGGHSAEPLELEECSKDLLEVFQNNAPSMAGGMPTYSVEITNTCIDCAVCDVHIACGDFASNDVIDPDKFRRLGFNDCLVNGGGSIEPSFPVSFQYGNSFPYPMTVASASCDCN

SEQ ID NO: 1422 - DNA, 764 bp, Triticum aestivum
  misc_feature (1)..(764): Ceres CLONE ID no.1033710
  misc_feature (1)..(764): Encodes the peptide sequence at SEQ ID NO 1423
aaggtagtagcagcaaggcctgaggcaggaagaaacacaaaggcgccatggcgtgctttcggattcgttcaagcgctgcagctgtggtcgtcgtcaccatgctcctgctccaagcttgctttgaagtttcagcgtcttcctcgctgcagcagcatccgcatcagtcgcgcaagatgctcagcgtcgatgcatcttccgtgtcatcgagcggcgccggaggcccctcggcggagccgttggagctggaggagtgctcggaggacctcctggaggtgttccagaacaacgcgccgagcatggccggcggcatgccgacgtacagcgtggagttcaccaacacctgcatcgactgcgccgtgtgcgacgtccacgtcgcgtgcggcgacttcgcctcaaatgatgtcatcgacccagacaagttccgccgtctcggcttcaacgactgcctcgtcaatggcggcaggtccatcgagcccagcttccctgtgtcgttccagtacggcaactcctttccctacccgatgacagtcgcgtccgcctcctgtgactgtaactagctatatatggctagggtacgaatgaagctatctattttcgttgcaaataaaatcaagtagagctcggctaccggcttgtggtctaatcttacttttggagttactgttatctactatcagtgtatatggcgtcgaggactaggtgaaccgagtccaatgaaaaacattttaaagttctcccattttagtaaatgtcagtcagccttc

SEQ ID NO: 1423 - protein, 169 aa, Triticum aestivum
  misc_feature (1)..(169): Ceres CLONE ID no.1033710
  misc_feature (1)..(169): Bit score of 290.5 for HMM based on sequences of FIGURE 47.
  misc_feature (1)..(169): Functional Homolog Of Ceres SEEDLINE ID no. ME13204 at SEQ ID NO: 1409
MACFRIRSSAAAVVVVTMLLLQACFEVSASSSLQQHPHQSRKMLSVDASSVSSSGAGGPSAEPLELEECSEDLLEVFQNNAPSMAGGMPTYSVEFTNTCIDCAVCDVHVACGDFASNDVIDPDKFRRLGFNDCLVNGGRSIEPSFPVSFQYGNSFPYPMTVASASCDCN

SEQ ID NO: 1424 - protein, 261 aa, Oryza sativa subsp. indica
  misc_feature (1)..(261): Public GI ID no.125536578
  misc_feature (1)..(261): Bit score of 599.2 for HMM based on sequences of FIGURE 47.
  misc_feature (1)..(261): Functional Homolog Of Ceres SEEDLINE ID no. ME13204 at SEQ ID NO: 1409
MEPWRWQICLVTPRSFLFQAFVRTGFRAMRVSSASSTPPPPAFAAAAWAVVLLAMLRSDVALAAAASSNDDTGLSPLMPPPPPLAAPVPAAVSPAPATPPAVLSPRKLLRPPGADVVGVGFVSGSGGGGGGGGGGDGVRTRRVDDGCAGADDIAIYQGRATPLPSGVPAYTVDVMNRCAGGGGGGGDEECAIAGIHVRCGWFSSVSLVDPRVFRRLGHDDCLLNDGRPLLAGETVSFEYTNSFPYKLSVSVATCVVDPAAP

SEQ ID NO: 1425 - protein, 202 aa, Oryza sativa subsp. japonica
  misc_feature (1)..(202): Public GI ID no.20270065
  misc_feature (1)..(202): Bit score of 489.3 for HMM based on sequences of FIGURE 47.
  misc_feature (1)..(202): Functional Homolog Of Ceres SEEDLINE ID no. ME13204 at SEQ ID NO: 1409
MADCTTMRLASSVTIILLLLVASQALVVSGESSSSAMQSKTLNMNKLLNISEDHSPNGGRHWMQRMQPDSCSEQNVVVYQNNAEHLPSGIPTYSVEIINVCTACTVYDVHISCGEFASAELVDPSQFQRIGFNDCLVKGGGRLGPSEAVSFQYSNSFAYPLAVANVACFHYSIVWASMIPCLPEHACHTASSVKGLGPRPHA

SEQ ID NO: 1426 - protein, 169 aa, Oryza sativa subsp. japonica
  misc_feature (1)..(169): Public GI ID no.115481446
  misc_feature (1)..(169): Bit score of 373.5 for HMM based on sequences of FIGURE 47.
  misc_feature (1)..(169): Functional Homolog Of Ceres SEEDLINE ID no. ME13204 at SEQ ID NO: 1409
MADCTTMRLASSVTIILLLLVASQALVVSGESSSSAMQSKTLNMNKLLNISEDHSPNGGRHWMQRMQPDSCSEQNVVVYQNNAEHLPSGIPTYSVEIINVCTACTVYDVHISCGEFASAELVDPSQFQRIGFNDCLVKGGGRLGPSEAVSFQYSNSFAYPLAVANVACE

SEQ ID NO: 1427 - DNA, 480 bp, Arabidopsis thaliana
  misc_feature (1)..(480): Ceres SEEDLINE ID no.ME14649
  misc_feature (1)..(480): Ceres ANNOT ID no.850581
  misc_feature (1)..(480): Inplanta Sequence
  misc_feature (1)..(480): Encodes the peptide sequence at SEQ ID NO. 1428
atgcatcgactgctactggaatcccacggcggcgggaacgagacgagcggaagcggcgggggagatgggtacacgagggacatgaacttcgacgcaaacatggtgatcatacttgcggctcttctctgcgcgctgatactagcgcttgggctgaattcgattctccggtgcgcgatgcgatgcggtttcgggttatcatcctctgcggcggcggggacggtggccgacagagctggattaaagaagagagaactgaagaagtttccagtagctgagtacgggtcgggggaagtgaagatagcggcgacggagtgcgcaatctgtctgggggaattcgcggacggcgagagagtgcgagtactgccgccgtgtaatcacagtttccacatgtcatgcatcgacacgtggcttgtctctcactcttcatgtcccaattgtcggcattcactcatcgaggtccacgtggcggggtctgagtga

SEQ ID NO: 1428 - protein, 159 aa, Arabidopsis thaliana
  misc_feature (1)..(159): Ceres SEEDLINE ID no.ME14649
  misc_feature (1)..(159): Ceres ANNOT ID no.850581
  misc_feature (1)..(159): Bit score of 363.3 for HMM based on sequences of FIGURE 48.
  misc_feature (105)..(146): Pfam Name: zf-C3HC4 Pfam Description: Zinc finger, C3HC4 type (RING finger)
MHRLLLESHGGGNETSGSGGGDGYTRDMNFDANMVIILAALLCALILALGLNSILRCAMRCGFGLSSSAAAGTVADRAGLKKRELKKFPVAEYGSGEVKIAATECAICLGEFADGERVRVLPPCNHSFHMSCIDTWLVSHSSCPNCRHSLIEVHVAGSE

SEQ ID NO: 1429 - DNA, 1405 bp, Gossypium hirsutum
  misc_feature (1)..(1405): Ceres CLONE ID no.1978733
  misc_feature (1)..(1405): Encodes the peptide sequence at SEQ ID NO 1430
aagataatttcccgactcttgtgtgctacaaattggtaaccagtagaccttggaaaccccaaattattgtcctcataatctccataattatatccttcaaccctgtccttgtagccggtgatatgatgggagtaaaggttttaagcttttaactggtttacatggaatctttgtggtgtgggaagccatagcttctatttttgcattctcactctctgttgtactatgaaagccttcccttttcctccaatcaccaaaaggagatgctttttaatggtgtctttatcttagttggaagttgctgacaggcacataaccctaactctaaagccccgtatctccctttagttaaaaagctgatctacaagaacccaatgaaagaaagcataagccctcactttctttatatatcagctgcagctgcacccatctttgcttagccaaaccacgagtttcaagcaaacaagccaagggattttaattttgtttcattcatcagcagcaaatgagagaggtgaacttttagtaactctttttatataagctttttgggatgatgcaagctaaaacagcaatggtgaccactctttaccatcgaccgcaccgccttctcctcgatacgcaaccgaacgcatcgccatcgctaccgaatggaagcaggacgcgcaacgctttcgccaatgaagccaactttgacaccaacatggtgatcatcctagcggctttgctttgtgcattgatatgtgctctaggactaaactccattatgcgttgcactttccgttgcggcagaaggtttggtttggacgccacggaagagaccgcggcgcgtttggctgccgcgacgggcctgaagaagagcgcgttgcgtcggcttccggtggccgtgtatggttcagggatggatatgaaggctactgagtgtccaatttgccttggagaattcatgggtggtgaaaaagttagggtgttgccaaaatgtaaccatggtttccatgtaaggtgtatagatacatggttgctgtcacactcatcttgcccaacttgcaggcagtcattgttggatcaggcaactagcagcagtgatggtgcagtggagatcgaaaacggaatccgaccacatggaaattcttcaggaggacaacaagctgatgtaccagttcctgcagatgaggttggttgatactggtcttaaaatagttctccaaccagatgagagaaaaggggaccttagagtagtttttctaatgtttcttttggcatttttaaagttaggtttgtttatgcatatgcatagagagaactatttgatacttatatgagggtttgcatacaaattcatgtccagttgtatgtgattgtaatgagtttattaggaaatataaaaagatgaatcatgaaccag

SEQ ID NO: 1430 - protein, 209 aa, Gossypium hirsutum
  misc_feature (1)..(209): Ceres CLONE ID no.1978733
  misc_feature (1)..(209): Bit score of 455.7 for HMM based on sequences of FIGURE 48.
  misc_feature (124)..(165): Pfam Name: zf-C3HC4 Pfam Description: Zinc finger, C3HC4 type (RING finger)
  misc_feature (1)..(209): Functional Homolog Of Ceres SEEDLINE ID no. ME14649 at SEQ ID NO: 1428
MMQAKTAMVTTLYHRPHRLLLDTQPNASPSLPNGSRTRNAFANEANFDTNMVIILAALLCALICALGLNSIMRCTFRCGRRFGLDATEETAARLAAATGLKKSALRRLPVAVYGSGMDMKATECPICLGEFMGGEKVRVLPKCNHGFHVRCIDTWLLSHSSCPTCRQSLLDQATSSSDGAVEIENGIRPHGNSSGGQQADVPVPADEVG

SEQ ID NO: 1431 - DNA, 567 bp, Populus balsamifera subsp. trichocarpa
  misc_feature (1)..(567): Ceres ANNOT ID no.1476165
  misc_feature (1)..(567): Encodes the peptide sequence at SEQ ID NO 1432
atgcatcgccgcatgcttgatacggtaccgcttgatgtggcaccggctaatgggaacagaacgcatgattcgtacattaacgagacgaatttcgacaccaacatggtgattatattagcagctttgctatgtgcactaatcggtgcgctaggattgaattcaattgtgcgttgccttttgcgctgcagtagcaggtttgccttggagaccacagaagaagccgcagcgcgtttagctgccacaggactcaagaagcgtgatttacgccagatccctgtggcgatctatggagcaggagggagtatctcagccacagaatgtccaatttgcttaggggagttcgtcgatggagagaaagttcgggtgcttccgaaatgcaaccatggattccatgtcaggtgcatagacacatggcttttgtcacactcgtcgtgcccgaattgtcggcattcattgcttgaacataccacagattccggtgcagctcaggaggtaaccggagcagcacggccaggcgaaaatgatcccggccgacaagccagaggatggccagaacatggtggttga

SEQ ID NO: 1432 - protein, 188 aa, Populus balsamifera subsp. trichocarpa
  misc_feature (1)..(188): Ceres ANNOT ID no.1476165
  misc_feature (1)..(188): Bit score of 454.2 for HMM based on sequences of FIGURE 48.
  misc_feature (107)..(148): Pfam Name: zf-C3HC4 Pfam Description: Zinc finger, C3HC4 type (RING finger)
  misc_feature (1)..(188): Functional Homolog Of Ceres SEEDLINE ID no. ME14649 at SEQ ID NO: 1428
MHRRMLDTVPLDVAPANGNRTHDSYINETNFDTNMVIILAALLCALIGALGLNSIVRCLLRCSSRFALETTEEAAARLAATGLKKRDLRQIPVAIYGAGGSISATECPICLGEFVDGEKVRVLPKCNHGFHVRCIDTWLLSHSSCPNCRHSLLEHTTDSGAAQEVTGAARPGENDPGRQARGWPEHGG

SEQ ID NO: 1433 - DNA, 546 bp, Populus balsamifera subsp. trichocarpa
  misc_feature (1)..(546): Ceres ANNOT ID no.1529617
  misc_feature (1)..(546): Encodes the peptide sequence at SEQ ID NO 1434
atgcatcgccgcatgcttgatacggtaccgcttgatgtggcaccggctaatgggaacagaacgcatgattcgtacattaacgagacgaatttcgacaccaacatggtgattatattagcagctttgctatgtgcactaatcggtgcgctaggattgaattcaattgtgcgttgccttttgcgctgcagtagcaggtttgccttggagaccacagaagaagccgcagcgcgtttagctgccacaggactcaagaagcgtgatttacgccagatccctgtggcgatctatggagcaggagggagtatctcagccacagaatgtccaatttgcttaggggagttcgtcgatggagagaaagttcgggtgcttccgaaatgcaaccatggattccatgtcaggtgcatagacacatggcttttgtcacactcgtcgtgcccgaattgtcggcattcattgcttgaacataccacagattccggtgcagctcaggaggtaaccggagcagcacggccaggcgaaaatgatcccggccgacaagctaattaa

SEQ ID NO: 1434 - protein, 181 aa, Populus balsamifera subsp. trichocarpa
  misc_feature (1)..(181): Ceres ANNOT ID no.1529617
  misc_feature (1)..(181): Bit score of 436.0 for HMM based on sequences of FIGURE 48.
  misc_feature (107)..(148): Pfam Name: zf-C3HC4 Pfam Description: Zinc finger, C3HC4 type (RING finger)
  misc_feature (1)..(181): Functional Homolog Of Ceres SEEDLINE ID no. ME14649 at SEQ ID NO: 1428
MHRRMLDTVPLDVAPANGNRTHDSYINETNFDTNMVIILAALLCALIGALGLNSIVRCLLRCSSRFALETTEEAAARLAATGLKKRDLRQIPVAIYGAGGSISATECPICLGEFVDGEKVRVLPKCNHGFHVRCIDTWLLSHSSCPNCRHSLLEHTTDSGAAQEVTGAARPGENDPGRQAN

SEQ ID NO: 1435 - DNA, 809 bp, Brassica napus
  misc_feature (1)..(809): Ceres CLONE ID no.871529
  misc_feature (1)..(809): Encodes the peptide sequence at SEQ ID NO 1436
  misc_feature (489)..(489): y is t/u or c
  misc_feature (498)..(498): r is g or a
  misc_feature (515)..(515): r is g or a
  misc_feature (541)..(541): m is a or c
  misc_feature (575)..(575): m is a or c
  misc_feature (584)..(584): b is g or c or t/u
  misc_feature (603)..(603): w is a or t/u
  misc_feature (605)..(605): k is g or t/u
  misc_feature (609)..(609): y is t/u or c
  misc_feature (618)..(618): w is a or t/u
  misc_feature (626)..(626): m is a or c
  misc_feature (637)..(637): y is t/u or c
  misc_feature (801)..(801): y is t/u or c
tcttcatcactctcacattcctctgtcttcaaactcacacaaagaaaaagaaactagaaaatgactcgaccggcaagattcctcgagacggcggcgacgccaccacaaccgtcggagcagatgcttgcggcggaatccgacatggttgtgatcttgtcggctcttctctgcgctctcatatgcgtagctggccttgccgccgtcgtacgctgcgcttggctccgacggtttaccaccggagaaaattctccgtcggcgaacaaaggcctgaagaagaaagctctccagtctctcccaagatccactttcaccgcggcggaatcaacctccggcacggccgccgaagacggtggagattcgacggaatgtgcgatttgtctcagtgatttcgccgacggcgaagagatcagagtgcttcctctctgtggccattccttccacgtggagtgtattgacaaatggcttgtctctaggtcttcgtgtccttcytgtcgccgrattcttaggccggtgaratgtgaccggtgcggtcacgcttccmcggcggggagtcaaatgaaagatcatcaacatcmccaacactbgtcgcagctcacttcctcwaktccyacttttctwccttaacmctaattttttyttaagtatctgaataattaattcagaaagtatgtaaagtgagtttcattagtaaaattcttaggaaatagagatcttttgtgtgatttttcttgtaatttatcgtgtttaaatcaattagatggagtttatagttcttttttttatcaaaggagtttatagttyttgatgtt

SEQ ID NO: 1436 - protein, 187 aa, Brassica napus
  misc_feature (1)..(187): Ceres CLONE ID no.871529
  misc_feature (1)..(187): Bit score of 382.2 for HMM based on sequences of FIGURE 48.
  misc_feature (103)..(144): Pfam Name: zf-C3HC4 Pfam Description: Zinc finger, C3HC4 type (RING finger)
  misc_feature (1)..(187): Functional Homolog Of Ceres SEEDLINE ID no. ME14649 at SEQ ID NO: 1428
  misc_feature (143)..(143): Xaa is any aa, unknown or other
  misc_feature (146)..(146): Xaa is any aa, unknown or other
  misc_feature (152)..(152): Xaa is any aa, unknown or other
  misc_feature (161)..(161): Xaa is any aa, unknown or other
  misc_feature (172)..(172): Xaa is any aa, unknown or other
  misc_feature (175)..(175): Xaa is any aa, unknown or other
  misc_feature (181)..(181): Xaa is any aa, unknown or other
  misc_feature (182)..(182): Xaa is any aa, unknown or other
  misc_feature (183)..(183): Xaa is any aa, unknown or other
  misc_feature (186)..(186): Xaa is any aa, unknown or other
MTRPARFLETAATPPQPSEQMLAAESDMVVILSALLCALICVAGLAAVVRCAWLRRFTTGENSPSANKGLKKKALQSLPRSTFTAAESTSGTAAEDGGDSTECAICLSDFADGEEIRVLPLCGHSFHVECIDKWLVSRSSCPXCRXILRPVXCDRCGHASXAGSQMKDHQHXQHXSQLTSXXXTFXP

SEQ ID NO: 1437 - protein, 519 aa, Arabidopsis thaliana
  misc_feature (1)..(519): Ceres SEEDLINE ID no.ME20628
  misc_feature (1)..(519): Ceres ANNOT ID no.859276
  misc_feature (1)..(519): Bit score of 1233.8 for HMM based on sequences of FIGURE 56.
  misc_feature (368)..(431): Pfam Name: bZIP_1 Pfam Description: bZIP transcription factor
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 1438 - DNA, 874 bp, Glycine max
  misc_feature (1)..(874): Ceres CLONE ID no.1043344
  misc_feature (1)..(874): Encodes the peptide sequence at SEQ ID NO 1439
agacccagttgttacttttgttcatatagccacaaagtcacaggttacttaggaatcgaggtcttgaagtccaaacagttttctttgtaaattgaaatattttgaagcatcatcgaacatgcagcggcggtttctggagacggaactgagcatgccaccctcgtacggcggcggcaacactagcgacacgttcatcagcgacgcgaactttgacaccaacatggtgatcattctggcggcgctgctgtgcgctttgatatgcgcgctgggtctgaactccatcgcgcggtgcgcgctgcggtgcgggcggcccttcggcaacgagacggcggagcaggcggcagcgcggctggcggggacggggctaaagcgccgcgagctcagccgcatcccagtcgcggtgtacggcgccgccggcgaaaacacgattccggcgacggagtgccccatatgcctcggcgagttcgagaaaggtgacagggttcgaatgttgcccaagtgcaaccacgggttccacgtgaggtgcattgacacgtggcttctgtcgcattcctcgtgccccaattgccgccactcgctcctcgagaagcccgcggccgcgccggaaagtgggtcggggcggcgtagcgaggtggtggtggtggtggagcaggcgagttgaagggcattaacagtgaaaggtggaaggacaagttttggtgaatggaggttgagaaatttaatgttagtggttagagtagttattagttggttattaataaattcgaagtggccaatccatatacacgtttattttttaagaaattaaaacatatgtttgtgtatgttaatttacagtttgtatataagttggaaattggatataagggtgctt

SEQ ID NO: 1439 - protein, 169 aa, Glycine max
  misc_feature (1)..(169): Ceres CLONE ID no.1043344
  misc_feature (1)..(169): Bit score of 403.1 for HMM based on sequences of FIGURE 48.
  misc_feature (98)..(139): Pfam Name: zf-C3HC4 Pfam Description: Zinc finger, C3HC4 type (RING finger)
  misc_feature (1)..(169): Functional Homolog Of Ceres SEEDLINE ID no. ME14649 at SEQ ID NO: 1428
MPPSYGGGNTSDTFISDANFDTNMVIILAALLCALICALGLNSIARCALRCGRPFGNETAEQAAARLAGTGLKRRELSRIPVAVYGAAGENTIPATECPICLGEFEKGDRVRMLPKCNHGFHVRCIDTWLLSHSSCPNCRHSLLEKPAAAPESGSGRRSEVVVVVEQAS

SEQ ID NO: 1440 - protein, 222 aa, Beta vulgaris
  misc_feature (1)..(222): Public GI ID no.40642617
  misc_feature (1)..(222): Bit score of 526.7 for HMM based on sequences of FIGURE 55.
  misc_feature (60)..(214): Pfam Name: Pyrophosphatase Pfam Description: Inorganic pyrophosphatase
  misc_feature (1)..(222): Functional Homolog Of Ceres SEEDLINE ID no. ME19182 at SEQ ID NO: 1577
MDEEMNAVAEMNAVASKVKEEYRRAPKLNQRIISSMSRRSVAAHPWHDLEIGPNAPEICNCVVEIPKGSKVKYELDKKTGLIMVDRILYSSVVYPHNYGFIPRTLCEDGDPMDVLVLMQEPVVPGRFLRARAIGLMPMIDQGEKDDKIIAVCADDPEVRHYTDINQLPPHRLAEIRRFFEDYKKNENKEVAVNEFLPAQIAHDAIQHSMDLYAEYILQTLRR

SEQ ID NO: 1441 - DNA, 828 bp, Triticum aestivum
  misc_feature (1)..(828): Ceres CLONE ID no.786542
  misc_feature (1)..(828): Encodes the peptide sequence at SEQ ID NO 1442
  misc_feature (578)..(578): y is t/u or c
  misc_feature (799)..(799): w is a or t/u
  misc_feature (800)..(800): r is g or a
  misc_feature (810)..(810): m is a or c
acacacagctttcactttcactttcactttcgcagctgcgccaaggaaaagaaaagaagatgtctcgattcccatgtatgcactactcgatcatatcccgaaccaaaacgctctcttgatttcttcccgaaaccaccacacacacgtccatcagcagctcgcgagctcagctggtacgcaggcacaccatgcggcggctcagcgacgcaggggaggccacgccgctggtcacccccgcggcggccgcggcggcgggcggcaccttggcatcgccggccgctgcggggagcaacgccaacttcgacgccaacatggtgatcatcctggccgcgctgctctgcgttctcattttcgcgcttgggctcaactccgtcatccgctgcgtgctccactgcggccgccggctcgcgccgtcgtcgagcctcgcggccagcgccaccacggcgaggacgacgacatccgtgcacgtgcaggcggggctcaagaggaaggcgctgaggaagatacccgtggaggtgtacggcggagccaagtcgtccggcggcgccctcccagccacggccacggagtgcgccatytgcctcggcgagttcgccgacggcgagaaggtacgcgtgctcccgcggtgccaccacggattccacgtccgctgcatcgacatgtggctcgccacgcacacctcctgccccaactgccgggcctcgctcgctgaggacggcgccgccgctgccaacggcggagggagatagcgccggacagggtacgggtttgtaatttcttctagttagggaactaaagwraaacgttgcmccgctgctttgcttcctc

SEQ ID NO: 1442 - protein, 186 aa, Triticum aestivum
  misc_feature (1)..(186): Ceres CLONE ID no.786542
  misc_feature (1)..(186): Bit score of 388.8 for HMM based on sequences of FIGURE 48.
  misc_feature (128)..(169): Pfam Name: zf-C3HC4 Pfam Description: Zinc finger, C3HC4 type (RING finger)
  misc_feature (1)..(186): Functional Homolog Of Ceres SEEDLINE ID no. ME14649 at SEQ ID NO: 1428
  misc_feature (130)..(130): Xaa is any aa, unknown or other
MRRLSDAGEATPLVTPAAAAAAGGTLASPAAAGSNANFDANMVIILAALLCVLIFALGLNSVIRCVLHCGRRLAPSSSLAASATTARTTTSVHVQAGLKRKALRKIPVEVYGGAKSSGGALPATATECAXCLGEFADGEKVRVLPRCHHGFHVRCIDMWLATHTSCPNCRASLAEDGAAAANGGGR

SEQ ID NO: 1443 - DNA, 1096 bp, Zea mays
  misc_feature (1)..(1096): Ceres CLONE ID no.346115
  misc_feature (1)..(1096): Encodes the peptide sequence at SEQ ID NO 1444
aaccgccgccgaggagcagcgctgcgtctcaagagctccccggcgagatcgtccatcaccatcaaaaaggccgcaccacactgatcacaagcatcaaacttcctaaagcgctctggtcgcagcctcgcagtggccgcagctgcagcgtcccctcccctttcgccatcgagcatcacctgtgctgaccgccggcgcgtaactgcaccagggtcactgcttacgaggaagaggaggcgcaacgcaacagtgttgttgggttgtctcgtcgtgcggtgccggtgcccatgggcgtgcacgccagggcgatgagctggtacacgagcccgccggggtcgccggcgccggggagcgccgccgaggcgcagcacgcgctgagcagcagcccccggggcggcgacaccagcttcgacaccaacatggtcgtcgtccttgccgcgctgctgttcgcgctcctcttcgcgctgggcatcaactcgctcgcgcgctgcctcatccgctgggcgcgccgcgcgccggcagcggagggcggcggcggcgggttcgagaagcgcgtgctccggagcatgcccgtcgaggtgtacggcgccgcggccgtcaccgtcgccgacgtctgcgccatctgcctcggcgagttcgcggacggcgagaaggtgcgcgtgctgccgcgctgcacccacggcttccatgtccgctgcgtcgacacctggctcctgtcgcacgactcctgccccacgtgccgggcctccgtgctcgacggcgcaaaggccgccactcccgccggtgggggcagccggtggcagggcagcgaggctgctgccatcgccgttgtcattcgatgacgtggacaggaagggcccgcgtgcccattggtggtggagccacacggcaggtatgcaggagcttcgttccgtagtcgggagatatttttctgtgagagaccgaccagtgggcccagaccctttgtagcttcctcggtcgcaggcaagtcaaggttgcagctggccatgttggttgccaccatggaccgtccactgtcctgtggcaggcatgtcgaaaccgatatgattccatcaatcatgtggtctgatcttgacac

SEQ ID NO: 1444 - protein, 184 aa, Zea mays
  misc_feature (1)..(184): Ceres CLONE ID no.346115
  misc_feature (1)..(184): Bit score of 406.6 for HMM based on sequences of FIGURE 48.
  misc_feature (110)..(151): Pfam Name: zf-C3HC4 Pfam Description: Zinc finger, C3HC4 type (RING finger)
  misc_feature (1)..(184): Functional Homolog Of Ceres SEEDLINE ID no. ME14649 at SEQ ID NO: 1428
MGVHARAMSWYTSPPGSPAPGSAAEAQHALSSSPRGGDTSFDTNMVVVLAALLFALLFALGINSLARCLIRWARRAPAAEGGGGGFEKRVLRSMPVEVYGAAAVTVADVCAICLGEFADGEKVRVLPRCTHGFHVRCVDTWLLSHDSCPTCRASVLDGAKAATPAGGGSRWQGSEAAAIAVVIR

SEQ ID NO: 1445 - DNA, 1086 bp, Zea mays
  misc_feature (1)..(1086): Ceres CLONE ID no.372726
  misc_feature (1)..(1086): Encodes the peptide sequence at SEQ ID NO 1446
atcgaacttcctaaagcgctctggtcgcagactcgcagtggccgcagctgcagcgtcccctcccttttcgccatcgagcgtcaactgtgctggccgccggcgcgtaactgcaccagggtcactgcttacgaggaagaggaggcacaacagtgttgttggggtgtctcgtcgtgcggtgccggtgccggtgaccatgggcgtgcacgccagggcgatgagctggtacacgagcccgccggggtcgccggcgccggggagcgccgccgaggcggagcacgcgctgagcagcagcccccggggcggcgacaccaacatggtcatcgtcctcgccgcgctgctgttcgcgctcctcttcgcgctgggcatcaactcgctcgcgcgctgcctcatccgctgggcgcgccgcgcgccggcagcggagggcggcggcgccggcgggctcgagaagcgcgtgctccggagcatgcccgtcgaggtgtacggcgccgcggccgtcaccgtcgccgacgtctgcgccatctgcctcggcgagttcgcggacggcgagaaggtgcgcgtgctgccgcgctgcgcccacggcttccatgtccgctgcgtcgacacctggctcctgtcgcacgactcctgccccacgtgccgggcctccgtgctcgacggcgcaaaggccgccactcccgccggtgggggcagccggcggcagggcagcgaggctgctgccatcgccgttgtcattggatgacgtggacaggaagggcccgcgtgcccattggtggtggagccacacggcaggtatgccagagcttcgttccgtggtcgggagatattttgctgtgagagaccgaccagtgggcccagaccctttgtagcttcctaggtcgcaggcaagtcaaggttgcagcagcatcctttcggctctcggcctgtacttgtgcttggcttgctcgtcttaccttacgtcgcagctggtcctgtttgtgcatactgcatactagattactagggagggagtggatgatgtgggcggtgggcagtacgctgctataggcagctaggtctgcaataatacagtttagttcggttcgattt

SEQ ID NO: 1446 - protein, 181 aa, Zea mays
  misc_feature (1)..(181): Ceres CLONE ID no.372726
  misc_feature (1)..(181): Bit score of 379.7 for HMM based on sequences of FIGURE 48.
  misc_feature (107)..(148): Pfam Name: zf-C3HC4 Pfam Description: Zinc finger, C3HC4 type (RING finger)
  misc_feature (1)..(181): Functional Homolog Of Ceres SEEDLINE ID no. ME14649 at SEQ ID NO: 1428
MGVHARAMSWYTSPPGSPAPGSAAEAEHALSSSPRGGDTNMVIVLAALLFALLFALGINSLARCLIRWARRAPAAEGGGAGGLEKRVLRSMPVEVYGAAAVTVADVCAICLGEFADGEKVRVLPRCAHGFHVRCVDTWLLSHDSCPTCRASVLDGAKAATPAGGGSRRQGSEAAAIAVVIG

SEQ ID NO: 1447 - DNA, 1086 bp, Zea mays
  misc_feature (1)..(1086): Ceres CLONE ID no.1442113
  misc_feature (1)..(1086): Encodes the peptide sequence at SEQ ID NO 1448
aaacgtgcatcgcgactagttagcagttactgccgcggacagagcacggcaggaaggagcgagcattcgtgcgggagagctggtggcacatggaccgccgggactcctccgaggcgccggggccggccgtgaacggcactggcggcgtcggaggcgcgggcgcggcggcgcccggggtcgtcgacgcgaccttcgacaccaacacggtgatcctgctggcggcgctgttcctggcgctgctgctcgccatcgcgctcaactcgctggccaggttcgcgctctggtgcggaggccgggccgcggccgggggcggcgaggtggcggcgtcgccgagcgtcgccgcgtcgtcctgcgcgggcgtccggggcgggatcaagaagcgcgcgctgcggagcatccccgtggaggtttacgtcggcggggatgcgaaagacgacgaggaggagggggccgggagcggggacgtgtgcgccatctgcctcggcgagttcgcggacggcgagaaggtgcgcgtgctgccgcggtgcggccacgcgttccacgtcccgtgcgtcgacgcctggctgctgtcccgcggctcgtgcccgacgtgccgccgccccgtcatggacgccaagcctgccagtgccagtgccacaggcggcaggggagtggcccagcagagcgcccgccgcccggacagcgacaccgtcgccgtggtcattgcgtgagggacgacggaggggagcatgggcgtggccatgggcccatggccatcgcaagcagcagagacctagtggtaggagcgagcacacgcaacgaagcaaggtatagagtagcgctctgtactgttccggcgtcgctgtggataagttcatgtaaaaaatatctccgtagcctgccctgctctggtagccgcatcgtccgatattatccggcgacggctggcccacttgcactagatgacgctacatgcttggagtgtactgctcgctagtgtagcatcttcttgccgttgccgttgccgtcaaatgtagtgcacgagtagctgcccagttgctctgtcacagttttcagtttcggtggtgccgtgcaacaatttgttac

SEQ ID NO: 1448 - protein, 206 aa, Zea mays
  misc_feature (1)..(206): Ceres CLONE ID no.1442113
  misc_feature (1)..(206): Bit score of 191.8 for HMM based on sequences of FIGURE 48.
  misc_feature (127)..(168): Pfam Name: zf-C3HC4 Pfam Description: Zinc finger, C3HC4 type (RING finger)
  misc_feature (1)..(206): Functional Homolog Of Ceres SEEDLINE ID no. ME14649 at SEQ ID NO: 1428
MDRRDSSEAPGPAVNGTGGVGGAGAAAPGVVDATFDTNTVILLAALFLALLLAIALNSLARFALWCGGRAAAGGGEVAASPSVAASSCAGVRGGIKKRALRSIPVEVYVGGDAKDDEEEGAGSGDVCAICLGEFADGEKVRVLPRCGHAFHVPCVDAWLLSRGSCPTCRRPVMDAKPASASATGGRGVAQQSARRPDSDTVAVVIA

SEQ ID NO: 1449 - DNA, 1223 bp, Zea mays
  misc_feature (1)..(1223): Ceres CLONE ID no.283124
  misc_feature (1)..(1223): Encodes the peptide sequence at SEQ ID NO 1450
aagggggaggggagctttccacttcacggctgatgagtgatgaccctaccagaaatcgacccgatacggctcctgcgccagatcgtccatcaatagcccgaatcacactcatcacaagcctcaaacttttccaaaccaatttagatgcggcgtgagtgctaaagcgctctctggactctgtttcgcagtggccgcagctgcagcgtcctcttccctttttgccatccagcatcacctgtgccgccggcgcgtaattgcaccgcggtcactggttaataggaagaagggaaggaggaggggggagcggtgtgccggggtatcgtcgtgcccatgggcgtgcacgccaggtcgatgagctggtatatggggtcgccggcgccggggagcgccgccgagggcgaggggcagcgcgcgctgagaagcagctccggtggcagcgacggcagcttcgacaccaacatggtcatcatcctcgccgcgctgctgttcgcgctcctcttcgcgatgggcctcaactcgctcgcgcgctgcctcatccgctgggcacgccgcgcgccggccggggaggacggcggcgccggcgggctaaagaagcgcgcgctccggagcatccccgtcgaggtgtacggcgcgtgcggcgccgacggggcggcggctgtcgccgccgacgtctgcgccatctgcctcggcgagttcgcggacggcgagaaggtgcgcgtgctgccgcgctgcgcccacggcttccacgtccgctgccgtcgacacctggctcctgtcgcacgactcctgccccacgtgccggggctccgtgctcgacggcgcaaaggccgccgcctctgctcccgccgccgggggcaaccggcggcagggaagcgaggctgctgccatcgcaattgtcattggatgacgtggacgtgtgggggcccgcgtgcccactggtggtggagccacacggtatgcgagactagcttcgttccgtggtagtgagatattttgctgtgatgagaagccgacgagtcgcggcggcccatctctcagtcaagacacagcatggccttcaggatattatcccttcggtctgtacttgtgcatggtcgtcgcagctgatcctgtttgtgtatactaggagtggatgatgaggtatgccgctataggcttgcaataatacagttttgtttgtacatgttcgatttgacacaattttagagcactgagcagagcac

SEQ ID NO: 1450 - protein, 217 aa, Zea mays
  misc_feature (1)..(217): Ceres CLONE ID no.283124
  misc_feature (1)..(217): Bit score of 241.4 for HMM based on sequences of FIGURE 48.
  misc_feature (115)..(170): Pfam Name: zf-C3HC4 Pfam Description: Zinc finger, C3HC4 type (RING finger)
  misc_feature (1)..(217): Functional Homolog Of Ceres SEEDLINE ID no. ME14649 at SEQ ID NO: 1428
MGVHARSMSWYMGSPAPGSAAEGEGQRALRSSSGGSDGSFDTNMVIILAALLFALLFAMGLNSLARCLIRWARRAPAGEDGGAGGLKKRALRSIPVEVYGACGADGAAAVAADVCAICLGEFADGEKVRVLPRCAHGFHVRCRRHLAPVARLLPHVPGLRARRRKGRRLCSRRRGQPAAGKRGCCHRNCHWMTWTCGGPRAHWWWSHTVCETSFVPW

SEQ ID NO: 1451 - DNA, 1075 bp, Panicum virgatum
  misc_feature (1)..(1075): Ceres CLONE ID no.1821683
  misc_feature (1)..(1075): Encodes the peptide sequence at SEQ ID NO 1452
gggggcggggagctttccacttcaccgccgtcgctacctgcagcagccggcccggttcgtcgcgggcgatcaaaaggccggctcgatcacagtgatctcaagcatcaaacttttccgggccaaggcgggtagatacggagcgggtgctaaagcgaagcgagagcgccctccgctggtggcgacccgcctgtcgtggtggctgcagcagcatcacctgtaccgccggcgcgtgattgcaccacgagccgtgttggtggagccggaaggtgaagagggaggaggacgggggtgggcgggctggtggtacggtggtccggaggagaaccagcggcggcggcggcgtccatgggcgtgcacgggcggtcgatgggctggtacctgggcccgccggggtcgccggcgcccgggagcgccgtcgcggaggcgcagcacgcgctgagcagcagcccggggggcggcgacgccagcttcgacaccaacatggtcatcatcctcgccgcgctgctcttcgccctgctcttcgcgctcgggctcaaccagctggcgcggtgcctcatccgctgggcgcgccgcgcgtcggagggggaggccggcgccagggggggagggctcaagaggcgcgccctccggagcatccccgtggaggtctacggcgcgtgcggcgccgacggggccgcggccgtcgccgccgacgtctgcgccatctgcctcggcgagttcgcggacggcgagaaggtgcgcgtcctgccgcgctgcgcccacggcttccatgtccggtgcgtcgacacctggctcctctcgcacgactcctgccccacgtgccgcggcaccgtgctcgaggccgccgcgcccggcaaggacaaggccgctgcctccgcccccgccggggggagccggcggcagggcagcgaggctgctgcaatcgcggtggtcatcgggtgacgtggacgggagtgccccacgagcctattgttggcggggcgccggggccacaggtatgcgagctttgttccgtggccgtgagatattttgcgatcagaaactgacaggtgggccctgttcagttgtttatagt

SEQ ID NO: 1452 - protein, 198 aa, Panicum virgatum
  misc_feature (1)..(198): Ceres CLONE ID no.1821683
  misc_feature (1)..(198): Bit score of 430.4 for HMM based on sequences of FIGURE 48.
  misc_feature (118)..(159): Pfam Name: zf-C3HC4 Pfam Description: Zinc finger, C3HC4 type (RING finger)
  misc_feature (1)..(198): Functional Homolog Of Ceres SEEDLINE ID no. ME14649 at SEQ ID NO: 1428
MGVHGRSMGWYLGPPGSPAPGSAVAEAQHALSSSPGGGDASFDTNMVIILAALLFALLFALGLNQLARCLIRWARRASEGEAGARGGGLKRRALRSIPVEVYGACGADGAAAVAADVCAICLGEFADGEKVRVLPRCAHGFHVRCVDTWLLSHDSCPTCRGTVLEAAAPGKDKAAASAPAGGSRRQGSEAAAIAVVIG

SEQ ID NO: 1453 - protein, 168 aa, Oryza sativa subsp. indica
  misc_feature (1)..(168): Public GI ID no.125533171
  misc_feature (1)..(168): Bit score of 368.2 for HMM based on sequences of FIGURE 48.
  misc_feature (111)..(152): Pfam Name: zf-C3HC4 Pfam Description: Zinc finger, C3HC4 type (RING finger)
  misc_feature (1)..(168): Functional Homolog Of Ceres SEEDLINE ID no. ME14649 at SEQ ID NO: 1428
MRRLGDVVEAPALVLTPASMQQAGGRGSSGALDASMVVILAALLCVVICALGLTSLIRCALHCARGLSPTTATPTPSVSTAATAGLKKTELRRIPVEVYGAKQAGVPDGECAICLGDFADGDKVRVLPRCHHGFHVRCIDTWLAAHTSCPTCRDSILSVHGVVAGGQT

SEQ ID NO: 1454 - protein, 170 aa, Oryza sativa subsp. indica
  misc_feature (1)..(170): Public GI ID no.125535554
  misc_feature (1)..(170): Bit score of 382.9 for HMM based on sequences of FIGURE 48.
  misc_feature (113)..(154): Pfam Name: zf-C3HC4 Pfam Description: Zinc finger, C3HC4 type (RING finger)
  misc_feature (1)..(170): Functional Homolog Of Ceres SEEDLINE ID no. ME14649 at SEQ ID NO: 1428
MRRLVDVVEAPALVLTPAWAATASMQQAGGSSGALDTNMVIVLAALLCVVICSLGLSSLIRCALHCARGLSPSPAMATPAAATTTGGLKKKELRRIPVEVYGAKQAGVPDAECAICLGDFADGDKVRVLPRCHHGFHVGCIDTWLAAHTSCPTCRDSILSVHAGVTGGQT

SEQ ID NO: 1455 - protein, 189 aa, Oryza sativa subsp. indica
  misc_feature (1)..(189): Public GI ID no.125552720
  misc_feature (1)..(189): Bit score of 234.8 for HMM based on sequences of FIGURE 48.
  misc_feature (124)..(165): Pfam Name: zf-C3HC4 Pfam Description: Zinc finger, C3HC4 type (RING finger)
  misc_feature (1)..(189): Functional Homolog Of Ceres SEEDLINE ID no. ME14649 at SEQ ID NO: 1428
MASGVAAPAPSVFEAARPALESGGGGGGAPPPGRADASFDTNMVIILAALFFALLFAIGLNSLARCALRCGGRGAAAAGGGGGGGGGGAASSGVGCGGIKKRALRSIPVEVYCGGEETAETDVCAICLGEFADGEKVRVLPRCRHGFHVRCVDAWLVSHGSCPTCRRQVIGGGGSTPPPDSDTIAVVVA

SEQ ID NO: 1456 - protein, 208 aa, Oryza sativa subsp. indica
  misc_feature (1)..(208): Public GI ID no.125528198
  misc_feature (1)..(208): Bit score of 339.6 for HMM based on sequences of FIGURE 48.
  misc_feature (124)..(165): Pfam Name: zf-C3HC4 Pfam Description: Zinc finger, C3HC4 type (RING finger)
  misc_feature (1)..(208): Functional Homolog Of Ceres SEEDLINE ID no. ME14649 at SEQ ID NO: 1428
MGVHTKSMNWYMGTPASPSPGSAGEAQHALSSGGGGGSDASFDTNMVIILAALLFALLFALGLNSLARLIIRWARRAATGEGAGGGVEGAGAGGGLKKRALRSIPIEVYGGGGGGSPAAAAEVCAICLGEFADGEKVRVLPRCGHGFHVRCVDTWLVSHDSCPTCRGSVLHGATTKHKPTAAAAAAGSRRPGSEVDAPAAAAVTVVIA

SEQ ID NO: 1457 - protein, 170 aa, Oryza sativa subsp. japonica
  misc_feature (1)..(170): Public GI ID no.77553492
  misc_feature (1)..(170): Bit score of 377.9 for HMM based on sequences of FIGURE 48.
  misc_feature (113)..(154): Pfam Name: zf-C3HC4 Pfam Description: Zinc finger, C3HC4 type (RING finger)
  misc_feature (1)..(170): Functional Homolog Of Ceres SEEDLINE ID no. ME14649 at SEQ ID NO: 1428
MRRLVDVVEAPALVLTPAWAATASMQQAGGSSGALDANMVIVLAALLCVVICSLGLSSLIRCALHCARGLSPSPAMATPAAATTTGGLKKKELRRITVEVYGAKQAGVPDAECAICLGDFADGDKVRVLPRCHHGFHVGCIDTWLAAHTSCPTCRDSILSVHAGVTGGQT

SEQ ID NO: 1458 - protein, 208 aa, Oryza sativa subsp. japonica
  misc_feature (1)..(208): Public GI ID no.115440747
  misc_feature (1)..(208): Bit score of 340.2 for HMM based on sequences of FIGURE 48.
  misc_feature (124)..(165): Pfam Name: zf-C3HC4 Pfam Description: Zinc finger, C3HC4 type (RING finger)
  misc_feature (1)..(208): Functional Homolog Of Ceres SEEDLINE ID no. ME14649 at SEQ ID NO: 1428
MGVHTKSMSWYMGTPASPSPGSAGEAQHALSSGGGGGSDASFDTNMVIILAALLFALLFALGLNSLARLIIRWARRAATGEGAGGGVEGAGAGGGLKKRALRSIPIEVYGGGGGGSPAAAAEVCAICLGEFADGEKVRVLPRCGHGFHVRCVDTWLVSHDSCPTCRGSVLHGATTKHKPTAAAAAAGSRRPGSEVDAPAAAAVTVVIA

SEQ ID NO: 1459 - protein, 189 aa, Oryza sativa subsp. japonica
  misc_feature (1)..(189): Public GI ID no.115464491
  misc_feature (1)..(189): Bit score of 235.5 for HMM based on sequences of FIGURE 48.
  misc_feature (124)..(165): Pfam Name: zf-C3HC4 Pfam Description: Zinc finger, C3HC4 type (RING finger)
  misc_feature (1)..(189): Functional Homolog Of Ceres SEEDLINE ID no. ME14649 at SEQ ID NO: 1428
MASGVAAPAPSVFEAARPALESGGGGGGAPPPGRADASFDTNMVIILAALFFALLFAIGLNSLARCALRCGGRGAAAAGGGGGGGGGGAAAAGVGCGGIKKRALRSIPVEVYCGGEETAETDVCAICLGEFADGEKVRVLPRCRHGFHVRCVDAWLVSHGSCPTCRRQVIGGGGSTPPPDSDTIAVVVA

SEQ ID NO: 1460 - protein, 197 aa, Oryza sativa subsp. japonica
  misc_feature (1)..(197): Public GI ID no.115447581
  misc_feature (1)..(197): Bit score of 37.6 for HMM based on sequences of FIGURE 48.
  misc_feature (145)..(188): Pfam Name: zf-C3HC4 Pfam Description: Zinc finger, C3HC4 type (RING finger)
  misc_feature (1)..(197): Functional Homolog Of Ceres SEEDLINE ID no. ME14649 at SEQ ID NO: 1428
MTRRANHTASPSVNATTAAAAAAMITATPSPPPRLPLPNPGNADAGAGAWGPYASSRAFFSNVATILIILACVSLLAFCLHAAARCLIRCLARRRDSGAPALAPALAQAQPPKPSSDDGANTGSSGAASAASGVAMVGGWAEAECAICLSELADGGGERVRVLPACGHGFHGACVDGWLAARASCPTCRAPSRAGEP

SEQ ID NO: 1461 - protein, 506 aa, Medicago truncatula
  misc_feature (1)..(506): Public GI ID no.92870675
  misc_feature (1)..(506): Bit score of 1323.8 for HMM based on sequences of FIGURE 56.
  misc_feature (358)..(421): Pfam Name: bZIP_1 Pfam Description: bZIP transcription factor
  misc_feature (1)..(506): Functional Homolog Of Ceres SEEDLINE ID no. ME20628 at SEQ ID NO: 1681
MEDTEAASSFKMNNHMEQLTIPQFNASSQSQMRTVTRNHHHNQRGGGIPPSHPHQIPPISPYSHMNNQIPVSRPQMPSHSTSPTPSHTRSLSQPSFFSLDSLPPLSPCTFRESSSTSDHADVSMEDRDVTSHSPLPPFAARNPSLPPRKSHRRSNSDIPFGFSTVLQSSPPLIPLRGREGVKPNSSVVKRETNWEHGNVEEKKSLSPEGEVVDDLFSAYMNLDNIDAINDDKNAATDDSRASGTKTNGGDSSDNEAESSVNESGDSMQRREGNKRSAGGDIAPTTRHYRSVSMDSFIGKLNFNDESLKMPPSPGGLMSPGNSGDGNNAAFSLEFGNGEFSGPELKKIMANEKLAEIAMADPKRAKRILANRQSAARSKERKMRYISELEHKVQTLQTEATTLSAQLTLLQRDSVGLTNQNSELKFRLQSMEQQAKLRDALNEALTAEVQRLKIVTAELNGESLPSNCMIPQHSVNPMMFQQQHQHQQHQQQQQQNGNANSKNELKQ

SEQ ID NO: 1462 - DNA, 742 bp, Arabidopsis thaliana
  misc_feature (1)..(742): Ceres SEEDLINE ID no.ME16546
  misc_feature (1)..(742): Ceres ANNOT ID no.862321
  misc_feature (1)..(742): Genomic Sequence
  misc_feature (1)..(742): Inplanta Sequence
  misc_feature (1)..(742): Encodes the peptide sequence at SEQ ID NO. 1463
atgaagcttgtctggtcgccggaaactgcttctgacgcctacatcgacaccgttaaatcggtatgccttttaactagattacatatgtgtgtaaatacatgctttttttatataatctttatttgattttgcatgtaaatatatgtgtgtatagtgtaagagcgacaaagagtcaggagtggcagaatttttatcagctacagcggctggatggaacgcgaggctgatcgttgagacatggtcacgcggcgatccaatcacgactagcgtcggactcgcggttgctgcaactcacacgggtggaagacacgtgtgtatagtacctgacgagcaatctaaacttgagtacgtgttggccatgagaggatttgttacgacggaggttgtggtggtcggagaatctgttgagaacacgatggaggagtttcccggtgtggatttcttggtggtggactcgaagcggcgagagttcgtcagaacgctgaggtttgcgaagctgagcaacaagggtgccgttttggtgtgtaaaaacgccatgcatagagcaatctctggttttaaatggcacgatgtgttgaaaagaggaacacgtgtggtgagatccgtgtttttaccggttggtagtgggttggatattgtacacgtgggagctactggtcgtggggactcgaggaatcttcgtagccgttggattagacacgtggatcatctgtcgggagaggagcatttgttcagacgctaa

SEQ ID NO: 1463 - protein, 215 aa, Arabidopsis thaliana
  misc_feature (1)..(215): Ceres SEEDLINE ID no.ME16546
  misc_feature (1)..(215): Ceres ANNOT ID no.862321
  misc_feature (1)..(215): Bit score of 574.8 for HMM based on sequences of FIGURE 49.
  misc_feature (1)..(215): Pfam Name: DUF1442 Pfam Description: Protein of unknown function (DUF1442)
MKLVWSPETASDAYIDTVKSCKSDKESGVAEFLSATAAGWNARLIVETWSRGDPITTSVGLAVAATHTGGRHVCIVPDEQSKLEYVLAMRGFVTTEVVVVGESVENTMEEFPGVDFLVVDSKRREFVRTLRFAKLSNKGAVLVCKNAMHRAISGFKWHDVLKRGTRVVRSVFLPVGSGLDIVHVGATGRGDSRNLRSRWIRHVDHLSGEEHLFRR

SEQ ID NO: 1464 - DNA, 651 bp, Populus balsamifera subsp. trichocarpa
  misc_feature (1)..(651): Ceres ANNOT ID no.1444102
  misc_feature (1)..(651): Encodes the peptide sequence at SEQ ID NO 1465
atgaagctggtttggaccccagatacagctttgaaagcttatgtttgtactgtcaaaacatgtgaggattttaaggaatcgagtgtagcagaacttctctcggccatggctgccggttggaacgcaaagctaatagttgaatcctggtccaaggctggcccgatagcgacgagcatcggcctagccgtggcggctaagcatacgtgtggaagacatgtgtgtgtggtcccagatgaagggtcaagatcggagtatgtaaaggccatgcatggcgccggcatgagggagacagaggtgctggtaggagaagcagaagaggtgatggcagggcttgtgggggtggattttctggtggcggattgtaggcggagggattttgttagggtcttaaggtttgctaagttgagccataaaggtgccgtgttggcgtgcaagaatgcctttcaacagtctgtttctgggtttaaatggcatggggtgcttgagagagggacacgtgttgttaaaactgcgtatttgcctgttgggcaaggattggatatggctcatatagggagtaatggtggggataagcgttcaagaggtggtcctagccgttggattaagcatatcgatcgaaaatcaggtgaggaacatgtatttcgtgaataa

SEQ ID NO: 1465 - protein, 216 aa, Populus balsamifera subsp. trichocarpa
  misc_feature (1)..(216): Ceres ANNOT ID no.1444102
  misc_feature (1)..(216): Bit score of 574.1 for HMM based on sequences of FIGURE 49.
  misc_feature (1)..(216): Pfam Name: DUF1442 Pfam Description: Protein of unknown function (DUF1442)
  misc_feature (1)..(216): Functional Homolog Of Ceres SEEDLINE ID no. ME16546 at SEQ ID NO: 1463
MKLVWTPDTALKAYVCTVKTCEDFKESSVAELLSAMAAGWNAKLIVESWSKAGPIATSIGLAVAAKHTCGRHVCVVPDEGSRSEYVKAMHGAGMRETEVLVGEAEEVMAGLVGVDFLVADCRRRDFVRVLRFAKLSHKGAVLACKNAFQQSVSGFKWHGVLERGTRVVKTAYLPVGQGLDMAHIGSNGGDKRSRGGPSRWIKHIDRKSGEEHVFRE

SEQ ID NO: 1466 - DNA, 651 bp, Populus balsamifera subsp. trichocarpa
  misc_feature (1)..(651): Ceres ANNOT ID no.1470946
  misc_feature (1)..(651): Encodes the peptide sequence at SEQ ID NO 1467
atgaagctggtttggacccctgatacagctttaaaagcctatgtttgtactatcaaaacatgtgagaattttatagaatccagtgtagcggaactcctctcagccatggcggccggttggaacgcaaagctaatagttgaatcctggtccaagggtggcccgatagcgacgagcatcggcctagccgtggcggctcatcacacgtgtggaagacatgtgtgtgtggtaccagatgaagggtcaagatccgaatacgtgaaaaccatgcatgttgccggcatgttggagacggaggttctggttggcgaagtggaagaggtgatggcagggcttgttggcgtggattttttggtggtggattgtaaacggagggattttcttaggtttttaaggttagctaagttgagccctaaaggtgctgtcttggcatgcaagaatgcctttcaaaagtctgctgccgggtttagatggcacggggcgcttgcgagagggacacgtgtagttaagactgtgtttttgccggttggacaaggattggatatggctcatatagggagtcatagtgggagtgagagctcaaagaggggtcctagccgttggatcaggcatatcgatcaaaagtcaggtgaggagcatgtgttccgtggataa

SEQ ID NO: 1467 - protein, 216 aa, Populus balsamifera subsp. trichocarpa
  misc_feature (1)..(216): Ceres ANNOT ID no.1470946
  misc_feature (1)..(216): Bit score of 512.1 for HMM based on sequences of FIGURE 49.
  misc_feature (1)..(216): Pfam Name: DUF1442 Pfam Description: Protein of unknown function (DUF1442)
  misc_feature (1)..(216): Functional Homolog Of Ceres SEEDLINE ID no. ME16546 at SEQ ID NO: 1463
MKLVWTPDTALKAYVCTIKTCENFIESSVAELLSAMAAGWNAKLIVESWSKGGPIATSIGLAVAAHHTCGRHVCVVPDEGSRSEYVKTMHVAGMLETEVLVGEVEEVMAGLVGVDFLVVDCKRRDFLRFLRLAKLSPKGAVLACKNAFQKSAAGFRWHGALARGTRVVKTVFLPVGQGLDMAHIGSHSGSESSKRGPSRWIRHIDQKSGEEHVFRG

SEQ ID NO: 1468 - DNA, 654 bp, Populus balsamifera subsp. trichocarpa
  misc_feature (1)..(654): Ceres ANNOT ID no.1447294
  misc_feature (1)..(654): Encodes the peptide sequence at SEQ ID NO 1469
atgaagctagtctggtcccctgaaacagcattaaaggcctacatcgatactgtcaaatcttgtgaggttttccaagaatctagtgtggctgagcttatttcagccatggctgcaggatggaacgccaaacttatagttgaaacatggtcacaaggtggaattcttgccacaagtattggtctagccatagccagccgccacacagatggaagacacgtttgtgttgtgcctgatgagctatcaagatcagaatatgaggaagccatggcagaggctgggatgtcaccagaaattattgtcggggaagcagaagaagtggtggaggggctgtcgggcatcgacttcttggtggtggattcacggcaaagggattatgcaagagtattgaggctgacaaagctgagcagcaggggagcagttttggtgtgcaagaatgctagttcaaggaacggatcgagttttaaatggagaaatgtcgttgatgatggatcgcgacgacttgttcgttctgtatttcttccagtagggaagggattggatattgcacacgtagcaaccagcgggggcagttctagtaatccaggcaaggatgaaagccgatggatcaagcatgttgatagacaatcaggagaggagtacgttatccgaaagtga

SEQ ID NO: 1469 - protein, 217 aa, Populus balsamifera subsp. trichocarpa
  misc_feature (1)..(217): Ceres ANNOT ID no.1447294
  misc_feature (1)..(217): Bit score of 457.3 for HMM based on sequences of FIGURE 49.
  misc_feature (1)..(217): Pfam Name: DUF1442 Pfam Description: Protein of unknown function (DUF1442)
  misc_feature (1)..(217): Functional Homolog Of Ceres SEEDLINE ID no. ME16546 at SEQ ID NO: 1463
MKLVWSPETALKAYIDTVKSCEVFQESSVAELISAMAAGWNAKLIVETWSQGGILATSIGLAIASRHTDGRHVCVVPDELSRSEYEEAMAEAGMSPEIIVGEAEEVVEGLSGIDFLVVDSRQRDYARVLRLTKLSSRGAVLVCKNASSRNGSSFKWRNVVDDGSRRLVRSVFLPVGKGLDIAHVATSGGSSSNPGKDESRWIKHVDRQSGEEYVIRK

SEQ ID NO: 1470 - DNA, 879 bp, Glycine max
  misc_feature (1)..(879): Ceres CLONE ID no.582439
  misc_feature (1)..(879): Encodes the peptide sequence at SEQ ID NO 1471
acaaacacaaacacaaacacatcgcaactcaagaaatgaaactagcttggtcaccagagagagcatccaaagcatacatcgacacagtccaatcttgccaggttttccgcgaatccggagtggcggagtttatttcggccatggcggcggggtggaactcgcagctcatagtggagacgtggtcgcagggaggacttattgccaccagcgtgggattagccctggcgaggtctcacacgtgcggaagacacgtgtgcgtagttcccgacgagcgggcgaggtcggagtacgcggagagaatgggcgaggcgggcgtgacggcggagatcgtggtgggggaaccggaggaggtgatggagggtttggtcggcgtggacttcttggtggttgattctcgaaggaaggactttacgcgtgtgctgaggctcgcaaagttgagtaataaaggtgctgtcttgctctgcaagaacgctaattcaaactccaagggtttcatatggcggagcctcgtggcgaaaggttcttcgcggcgtgttgttcgttcggcgtttcttcctgtggggaagggacttgacatggcacacgtgtctgcctctggaggtaataatagctccggacatagatggattaagcatgttgatcaacattcaggggacgtgcattttattcgacgatgaatgattcttgtttcttatgttcagtttcaccgccatattaacccatttttcttcccttttgtaaatacaggactatgtgtatggatgtagtatatattacaaaattaaaggattaatgtttactcgtcgtgttacacggtgagaaggagctaaactcaatattgtttatattgcttctttctctcttgtaactcacaaatct

SEQ ID NO: 1471 - protein, 213 aa, Glycine max
  misc_feature (1)..(213): Ceres CLONE ID no.582439
  misc_feature (1)..(213): Bit score of 557.3 for HMM based on sequences of FIGURE 49.
  misc_feature (1)..(213): Pfam Name: DUF1442 Pfam Description: Protein of unknown function (DUF1442)
  misc_feature (1)..(213): Functional Homolog Of Ceres SEEDLINE ID no. ME16546 at SEQ ID NO: 1463
MKLAWSPERASKAYIDTVQSCQVFRESGVAEFISAMAAGWNSQLIVETWSQGGLIATSVGLALARSHTCGRHVCVVPDERARSEYAERMGEAGVTAEIVVGEPEEVMEGLVGVDFLVVDSRRKDFTRVLRLAKLSNKGAVLLCKNANSNSKGFIWRSLVAKGSSRRVVRSAFLPVGKGLDMAHVSASGGNNSSGHRWIKHVDQHSGDVHFIRR

SEQ ID NO: 1472 - DNA, 889 bp, Triticum aestivum
  misc_feature (1)..(889): Ceres CLONE ID no.579953
  misc_feature (1)..(889): Encodes the peptide sequence at SEQ ID NO 1473
ctagctagctagttcgctttctcccaaagtattcttttcttcgcgcagagcgagacagaaagagaggccgagatgaagctggtgtggtgcccggagaccgcgtcccaggccttcatcgccggcgtcagcgcgctgtcagacgccgagcacggccccgcggggtccgcgggcgtcgccgagctcgtctccgccatggtcgggggatggaacgcgcagctcgtcgtcgaggcgccggaggtctcggctcccgactcggccaccatgagcctcgccctcgccgccgccgccgggcgcacgggaggccgctacgcccgcgtgctgccggacgaggacgcggaccgggccatggcggagctggagggcgtggacttcttggtggtcgacgcgcggaggcgggacggggcggccgtgctggcggcggccaggcctgggccgagagggatggtggtggtgcgccacggcgacgagaggcggcctggcacgaaggcgctcgaagcgtccatggcagcaggcacgagggtagtgcggtccgtgtacctgccggtcgacaagggcgtcgaggtcctccacgtcggcgtaggcaaggggccgagcctacagtgccggcgcagccggagcgcgtcgagccgttggatccggcacgtcgaccacaaaaccggcgaggagcacctcttccgccggccgtaaattcaaccgctagcttttctgtacatcaatcgtttgtggacatgtagtcgtagtaccgtaccgtccaagggaattagctaggtggccatggtcatggtgtccagattctttgaatctgccggcatggtttaagatggagggaaactgcggtgagccatggtgtaaataaataaaaataccccgccaactggctagctttcct

SEQ ID NO: 1473 - protein, 204 aa, Triticum aestivum
  misc_feature (1)..(204): Ceres CLONE ID no.579953
  misc_feature (1)..(204): Bit score of 490.2 for HMM based on sequences of FIGURE 49.
  misc_feature (1)..(203): Pfam Name: DUF1442 Pfam Description: Protein of unknown function (DUF1442)
  misc_feature (1)..(204): Functional Homolog Of Ceres SEEDLINE ID no. ME16546 at SEQ ID NO: 1463
MKLVWCPETASQAFIAGVSALSDAEHGPAGSAGVAELVSAMVGGWNAQLVVEAPEVSAPDSATMSLALAAAAGRTGGRYARVLPDEDADRAMAELEGVDFLVVDARRRDGAAVLAAARPGPRGMVVVRHGDERRPGTKALEASMAAGTRVVRSVYLPVDKGVEVLHVGVGKGPSLQCRRSRSASSRWIRHVDHKTGEEHLFRRP

SEQ ID NO: 1474 - protein, 211 aa, Oryza sativa subsp. indica
  misc_feature (1)..(211): Public GI ID no.125539335
  misc_feature (1)..(211): Bit score of 475.8 for HMM based on sequences of FIGURE 49.
  misc_feature (2)..(210): Pfam Name: DUF1442 Pfam Description: Protein of unknown function (DUF1442)
  misc_feature (1)..(211): Functional Homolog Of Ceres SEEDLINE ID no. ME16546 at SEQ ID NO: 1463
MASKAYIDGVRALAGHDLAGAAADVAELVSAMAGGWNARLVVEAPDSAAPAAAATSLALAAVARRTGGRYALVLPDRDAAAASAAETAEVVVGEADEAMAGLHGVDLLVVDARRRDAAAVLRAARPGARGMVVVRHGDGRQRGAKDLAASMAAGTRVVRSVYLPIGKGVEVLHVGVGKGPSLQNHRDRRSTSRWIRHVDHDTGEEHVFRRQ

SEQ ID NO: 1475 - protein, 300 aa, Oryza sativa subsp. japonica
  misc_feature (1)..(300): Public GI ID no.47496918
  misc_feature (1)..(300): Bit score of 526.3 for HMM based on sequences of FIGURE 49.
  misc_feature (82)..(299): Pfam Name: DUF1442 Pfam Description: Protein of unknown function (DUF1442)
  misc_feature (1)..(300): Functional Homolog Of Ceres SEEDLINE ID no. ME16546 at SEQ ID NO: 1463
MPSHYTGESRTDGRAFLALTHEPTKTRRAVLLVSHSMPLTPLRCLLSTPTHHLYTRTIHLFPIVPVRILEVLVLFLLREAGMKLVWCPEMASKAYIDGVRALAGHDLAGAAADVAELVSAMAGGWNARLIVEAPDSAAPAAAATSLALAAAARRTGGRYALVLPDRDAAAASAAETAEVVVGEADEAMAGLHGVDLLVVDARRRDAAAVLRAARPGARGMVVVRHGDGRQRGAKDLAASMAAGTRVVRSVYLPIGKGVEVLHVGVGKGPSLQNHRDRRSTSRWIRHVDHDTGEEHVFRRQ

SEQ ID NO: 1476 - protein, 232 aa, Oryza sativa subsp. japonica
  misc_feature (1)..(232): Public GI ID no.115445987
  misc_feature (1)..(232): Bit score of 526.3 for HMM based on sequences of FIGURE 49.
  misc_feature (14)..(231): Pfam Name: DUF1442 Pfam Description: Protein of unknown function (DUF1442)
  misc_feature (1)..(232): Functional Homolog Of Ceres SEEDLINE ID no. ME16546 at SEQ ID NO: 1463
MAPPPPPAAQVVRMKLVWCPEMASKAYIDGVRALAGHDLAGAAADVAELVSAMAGGWNARLIVEAPDSAAPAAAATSLALAAAARRTGGRYALVLPDRDAAAASAAETAEVVVGEADEAMAGLHGVDLLVVDARRRDAAAVLRAARPGARGMVVVRHGDGRQRGAKDLAASMAAGTRVVRSVYLPIGKGVEVLHVGVGKGPSLQNHRDRRSTSRWIRHVDHDTGEEHVFRRQ

SEQ ID NO: 1477 - protein, 211 aa, Oryza sativa subsp. japonica
  misc_feature (1)..(211): Public GI ID no.125581986
  misc_feature (1)..(211): Bit score of 480.3 for HMM based on sequences of FIGURE 49.
  misc_feature (2)..(210): Pfam Name: DUF1442 Pfam Description: Protein of unknown function (DUF1442)
  misc_feature (1)..(211): Functional Homolog Of Ceres SEEDLINE ID no. ME16546 at SEQ ID NO: 1463
MASKAYIDGVRALAGHDLAGAAADVAELVSAMAGGWNARLIVEAPDSAAPAAAATSLALAAAARRTGGRYALVLPDRDAAAASAAETAEVVVGEADEAMAGLHGVDLLVVDARRRDAAAVLRAARPGARGMVVVRHGDGRQRGAKDLAASMAAGTRVVRSVYLPIGKGVEVLHVGVGKGPSLQNHRDRRSTSRWIRHVDHDTGEEHVFRRQ

SEQ ID NO: 1478 - DNA, 1839 bp, Arabidopsis thaliana
  misc_feature (1)..(1839): Ceres SEEDLINE ID no.ME17457
  misc_feature (1)..(1839): Ceres ANNOT ID no.839064
  misc_feature (1)..(1839): Genomic Sequence
  misc_feature (1)..(1839): Inplanta Sequence
  misc_feature (1)..(1839): Encodes the peptide sequence at SEQ ID NO. 1479
atggcgtctcttagccaaatcaccctgccacgcgcgccgtcgtcggagattggcctcttacgccgtcgattggagcggccgatcatcagaacccggatcggattcaacggccggattgcgagcgtattgactaacgcaggggaccaagcggtgtcggtaaaagcgagtgtgagccagaaggtgattgaagaggaagccaaagttattgtgggtacctacgcgcgagctccagtggttctctcgagtgggaaaggttgtaaattgttcgaccctgaaggaaaagagtatctggattgtgcatctggaatcgctgtgaatgctcttggtcatggagatcctgattggcttcgagctgtcactgagcaagctggtgttcttgcccatgtcagcaatgtttattacacgatccctcaggtatttattcgttactgtatttttgcattactgattctgttgatggctgacgaaagcttaaaacttttgttgtttttatcctctgtgtgattgagctatggcctatggaaacatgctagggaatgttggattagtcttctacttataatagcgagattattctatgacaagtacttgcactttgaaatttcatcaaattggattgtttctacgccttccctatagaaatttttatgagaagtatctgacctcattgtaaactcttagtgtacatatgctcctcaatgcccaattcctcgaaaaaaggaacctttatgctcatatctacttcatatgggttgttaaaatctgaaatgtttgaacttctctgcagatagagctcgcaaaacgcttggtggcgagttcttttgcagaccgtgtattcttttgtaactcgggaacggaagccaatgaagcagccattaagttttcaagaaaattccagagattcacccatccagaagacaaagaagtcgcgacaggtttcatcgcctttacaaacagcttccatggaagaaccttaggagctcttgccttgacaagcaaagaacaatacagaactcctttcgaacccatcatgcctggtgtaaccttcttagaatatggtaacattcaagcagccacagaccttatccgctcaggtaaaatagctgcagtttttgtggaaccaattcaaggagaaggcgggatttactctgctacaaaagagtttctgcaatctctgcgctctgcttgtgatgccgctggatctcttctcgtcttcgatgaggtaatatactctaccgtccatccaaaattttattttctttctttgtttctgttttttgattggtcttgcctcaactgggttcattgtcccaggttcaatgtggtttgggtcgaacgggtctcatgtgggcttatgaagccttcggtgtgactcctgacataatgacggttgcaaagcctttagctggtggtttacctattggagcggtgctggtgactgaaaaggttgcagagaccataaactacggagatcatggaagtacatttgcaggcagccctcttgtgtgcagtgcagccattgcagttatggataaagtatcgaaaccctctttcttgtccagtgtctcaaataaaggtcgatactttagagacctgttggtgaaaaaacttggaggaaactcgcacgtgaaggaagtgagaggcgaagggcttatcataggagtggagctcgatgtgccggcaagctcactggttgatgcttgccgagattcgggtcttctgatcttgacagcggggaaaggaaatgtcgtcaggattgttcctccgttggttatatcagaggaggaaatcgaacgtgcggttgagatcatgtctcaaaatttgactgcgcttgattga

SEQ ID NO: 1479 - protein, 457 aa, Arabidopsis thaliana; identical to SEQ ID NO: 85
  misc_feature (1)..(457): Ceres SEEDLINE ID no.ME17457
  misc_feature (1)..(457): Ceres ANNOT ID no.839064
  misc_feature (1)..(457): Bit score of 1041.8 for HMM based on sequences of FIGURE 3.
  misc_feature (79)..(404): Pfam Name: Aminotran_3 Pfam Description: Aminotransferase class-III

SEQ ID NO: 1480 - protein, 201 aa, Panicum virgatum
  misc_feature (1)..(201): Ceres CLONE ID no.1805493
  misc_feature (1)..(201): Bit score of 497.3 for HMM based on sequences of FIGURE 55.
  misc_feature (39)..(193): Pfam Name: Pyrophosphatase Pfam Description: Inorganic pyrophosphatase
  misc_feature (1)..(201): Functional Homolog Of Ceres SEEDLINE ID no. ME19182 at SEQ ID NO: 1577
MAGTAVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCYLRARAIGLMPMIDQGEKDDKIIAVCADDPEYRHYTDIKDLPPHRLQEIRRFFEDYKKNENKEVAVNEFLPAKDAIDAIRYSMDLYGSYIIEGLRK

SEQ ID NO: 1481 - protein, 213 aa, Oryza sativa subsp. japonica
  misc_feature (1)..(213): Public GI ID no.115461462
  misc_feature (1)..(213): Bit score of 538.9 for HMM based on sequences of FIGURE 55.
  misc_feature (51)..(205): Pfam Name: Pyrophosphatase Pfam Description: Inorganic pyrophosphatase
  misc_feature (1)..(213): Functional Homolog Of Ceres SEEDLINE ID no. ME19182 at SEQ ID NO: 1577
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPANTARDAIQYSMDLYAQYILQSLRQ

SEQ ID NO: 1482 - protein, 204 aa, Oryza sativa subsp. japonica
  misc_feature (1)..(204): Public GI ID no.115481936
  misc_feature (1)..(204): Bit score of 517.7 for HMM based on sequences of FIGURE 55.
  misc_feature (42)..(175): Pfam Name: Pyrophosphatase Pfam Description: Inorganic pyrophosphatase
  misc_feature (1)..(204): Functional Homolog Of Ceres SEEDLINE ID no. ME19182 at SEQ ID NO: 1577
MAEEKKTPCLNERILSSLSKRSVAAHSWHDLEIGPGAPQVFNVVVEITKGSKVKYELDKKTGMIKVDRVLYSSVVYPHNYGFIPRTLCEDGDPMDVLVLMQEPVIPGCYLRAKAIGLMPMIDQGEKDDKIIAVCVDDPEFRHFNDLKELSPHRLAEIRRFFEDYKKNENKEVAVNDFLPPATAQEAIKYSMDLYAEYILHSLRR

SEQ ID NO: 1483 - protein, 238 aa, Oryza sativa subsp. indica
  misc_feature (1)..(238): Public GI ID no.125531859
  misc_feature (1)..(238): Bit score of 397.6 for HMM based on sequences of FIGURE 55.
  misc_feature (98)..(230): Pfam Name: Pyrophosphatase Pfam Description: Inorganic pyrophosphatase
  misc_feature (1)..(238): Functional Homolog Of Ceres SEEDLINE ID no. ME19182 at SEQ ID NO: 1577
MGLIPVLCWGMRLSPCLASFSWVTIIDALVFNVCLNLAISLSRMAEEKKTPCLNERILSSLSKRSVAAHSWHDLEIADADAFSLSKCCIGPGAPQVFNVVVEITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 1484 - protein, 192 aa, Oryza sativa subsp. indica
  misc_feature (1)..(192): Public GI ID no.125550582
  misc_feature (1)..(192): Bit score of 389.8 for HMM based on sequences of FIGURE 55.
  misc_feature (54)..(174): Pfam Name: Pyrophosphatase Pfam Description: Inorganic pyrophosphatase
  misc_feature (1)..(192): Functional Homolog Of Ceres SEEDLINE ID no. ME19182 at SEQ ID NO: 1577
MAPAVEAVEKKTGSAPVKAPALNERILSSMSRRSIAAHPWHDLEIGPGAPTIFNCVIEIPRGSKVKYELDKKTGLIVVDRVLYSSVVYPHNYGFIPRTLCEDSDPLDVLVIMQEPVIPGCFLRAKAIGLMPMIDQGEADDKIIAVCADDPEYKHYNDIKELPPHRLAEIRRFFEDCILFYQLNIKFCILNEF

SEQ ID NO: 1485 - protein, 196 aa, Oryza sativa subsp. indica
  misc_feature (1)..(196): Public GI ID no.90399018
  misc_feature (1)..(196): Bit score of 464.7 for HMM based on sequences of FIGURE 55.
  misc_feature (51)..(156): Pfam Name: Pyrophosphatase Pfam Description: Inorganic pyrophosphatase
  misc_feature (1)..(196): Functional Homolog Of Ceres SEEDLINE ID no. ME19182 at SEQ ID NO: 1577
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDINKKNENKEVAVDAFLPANTARDAIQYSMDLYAQYILQSLRQ

SEQ ID NO: 1486 - protein, 192 aa, Panicum virgatum
  misc_feature (1)..(192): Ceres CLONE ID no.1805499
  misc_feature (1)..(192): Bit score of 397.2 for HMM based on sequences of FIGURE 55.
  misc_feature (52)..(172): Pfam Name: Pyrophosphatase Pfam Description: Inorganic pyrophosphatase
  misc_feature (1)..(192): Functional Homolog Of Ceres SEEDLINE ID no. ME19182 at SEQ ID NO: 1577
MSEEDKTAAAAEQPKRAPKLNERILSSLSRRSVAAHPWHDVEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDCILYNSSTAFLLYALVYFA

SEQ ID NO: 1487 - protein, 224 aa, Oryza sativa subsp. japonica
  misc_feature (1)..(224): Public GI ID no.115464117
  misc_feature (1)..(224): Bit score of 534.3 for HMM based on sequences of FIGURE 55.
  misc_feature (62)..(216): Pfam Name: Pyrophosphatase Pfam Description: Inorganic pyrophosphatase
  misc_feature (1)..(224): Functional Homolog Of Ceres SEEDLINE ID no. ME19182 at SEQ ID NO: 1577
MSSENGENGHGAADEVVEPYQQTPRPGPKLNERILSSLSRRSVAAHPWHDLEIGPDAPAVFNVVVEITKGSKVKYELDKKTGLIKVDRILYSSVVYPHNYGFIPRTLCEDNDPMDVLVLMQEPVLPGSFLRARAIGLMPMIDQGEKDDKIIAVCADDPEYRHFNNLSELSPHRLQEIRRFFEDYKKNENKEVAVNDFLPAPTAREAIQYSMDLYAQYILQSLKR

SEQ ID NO: 1488 - protein, 214 aa, Oryza sativa subsp. indica
  misc_feature (1)..(214): Public GI ID no.2570501
  misc_feature (1)..(214): Bit score of 412.9 for HMM based on sequences of FIGURE 55.
  misc_feature (52)..(148): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MAGEADGKAPLGSRYPPAALNERILSSMSQKHVAAHPWHDLEIGPGAPAVFNCVVEIPRGSKVKCELDKATGLIKVDRVLYSSVVYPHNYGFIPRTLCEDGDPMDVLVLMQEQVVPGCFLRARAIGLMPMIDQGEKDDKIIAVRADDLNTATSGTSRKSPFTAFKRSAVFFEDYKKNENKEVAVNEFFPAEDAINAIKYSMDFYGAHIIESSRK

SEQ ID NO: 1489 - DNA, 1081 bp, Panicum virgatum
  misc_feature (1)..(1081): Ceres CLONE ID no.1805499
  misc_feature (1)..(1081): Encodes the peptide sequence at SEQ ID NO 1486
caaaccaccgtcccgtcgcacgcacgcacgccttggttgtctctctcggtctcggcggcctttcctttccttgctagcgctagcggcgacgaccgggcgagtgccgccgtccgccacttcttcgtcggccgaccaccatctgaaaggggatgagtgaagaggacaagactgctgctgctgctgagcagccgaagcgagcccctaagctcaacgaaaggatcctctcttctttgtccaggagatctgtagctgctcatccatggcatgatgttgagatcggtcctggggctcccgctgtcttcaatgttgtcgttgagatcacaaagggaagcaaagttaaatatgagcttgacaagaaaactggactgattaaggttgatcgagtcctgtactcatcagttgtataccctcacaattatggtttcattccaaggactctttgtgaggacaatgacccaatggatgttttggtcctgatgcaggagcctgttattccgggttcattcctccgggcaagagcaattggccttatgcctatgattgaccagggtgaaaaggatgacaagataattgctgtctgtgctgatgatcctgaataccgtcactacaatgacatcagtgagctgtctcctcaccgcctgcaagaaatcaagcgcttctttgaagattgtatcctgtataattcatctactgctttcttactatatgctctagtatattttgcatgatcacattcacaggtacaagcttccttagcagtatctttaagacaagaaaaatgagaacaaagaggttgctgttgatgcattcttgcctgcgacaactgctcgagatgccattcagtactccatggatctgtatgcacagtatattttgcaaagcttgaggcagtagaatgccagcaactatttattgtggcgtctttgattgtgtgtgattttaagtggacgcttgaattgtgtgcaaccattacaactgaatgatgttgctggctgttatttccttctgcttttcccaggtcttgtataactttgttgttaaattatgaataagcaactttgttgttaaattatgaataaac

SEQ ID NO: 1490 - DNA, 982 bp, Arabidopsis thaliana
  misc_feature (1)..(982): Ceres SEEDLINE ID no.ME17567
  misc_feature (1)..(982): Ceres ANNOT ID no.864666
  misc_feature (1)..(982): Genomic Sequence
  misc_feature (1)..(982): Inplanta Sequence
  misc_feature (1)..(982): Encodes the peptide sequence at SEQ ID NO. 1491
atggcttttcttctttctaatctatcatctccgtcaatccatcttcaaaccggaaaatacccaaaccttaaacccattttcagtcaatctctatcgtcttcgtcttctgttagctacgaatttgtagaagagaatctatctacactctctctattgagcatccagtctcctcctcttaaagacacgcaagttcagacaagacacagttcgcaagataagcataataaccacgacagagatgaattctatatcaatcttggtgtcgctgtccgtacacttcgtgaagatttgcctttgctcttcactagagatcttaattacgacatctacaggtaaatttctcgtttgggtatttgataattgatgaaagaaagaatctttggatgctatcttcagaaatttatcattttggtataaaaaaggagcttcctttgatctctctgtttgtgaatgtttctcttagaaattcagaatattttttttgtttgacagggatgatataacatttgtggatccgatgaacacattcactgggatggacaactacaagattatcttctgggcactcagatttcatgggaagatattgttcagagatatctcacttgagatcttcagagtatggcaaccatcagagaacatgattctcatcaggtggaatctcaagggtgtgcctagagttccatgggaagctaaaggagagtttcaaggcacttctcggtataaactcgaccgtaatggcaaaatctatgagcataaagtcgataacttggccttcaatttccctcaacagctcaaacctgcagcttcggttttggatttggtgactgcttcccctgcaagcagtcctaatcctacgttctttttcagtcctgtggactcttattcatcttcatgggttaagttttatcaagcggtgagagggacattggagacagaggatatgtttgtaacaacagactgtttagtcacatgctcatag

SEQ ID NO: 1491 - protein, 273 aa, Arabidopsis thaliana
  misc_feature (1)..(273): Ceres SEEDLINE ID no.ME17567
  misc_feature (1)..(273): Ceres ANNOT ID no.864666
  misc_feature (1)..(273): Bit score of 692.7 for HMM based on sequences of FIGURE 50.
MAFLLSNLSSPSIHLQTGKYPNLKPIFSQSLSSSSSVSYEFVEENLSTLSLLSIQSPPLKDTQVQTRHSSQDKHNNHDRDEFYINLGVAVRTLREDLPLLFTRDLNYDIYRDDITFVDPMNTFTGMDNYKIIFWALRFHGKILFRDISLEIFRVWQPSENMILIRWNLKGVPRVPWEAKGEFQGTSRYKLDRNGKIYEHKVDNLAFNFPQQLKPAASVLDLVTASPASSPNPTFFFSPVDSYSSSWVKFYQAVRGTLETEDMFVTTDCLVTCS

SEQ ID NO: 1492 - DNA, 1026 bp, Gossypium hirsutum
  misc_feature (1)..(1026): Ceres CLONE ID no.1895876
  misc_feature (1)..(1026): Encodes the peptide sequence at SEQ ID NO 1493
aacttcattcctttcgtttaatcccaccttctctgctccaaattttctctagaaacgtacttcgagatgacatttctcatgccttcacctgaagtttccaccgcctttgcaaaaattttctctaaccctacccctcgccataaattcctcaagagctgcgcgatttcgaagaacgacgacgagaaagtttggtcaaagaccaacgctagggtcggtgttaaagatgtcggcagtactgtttcgggtttgagccaaaacttgaggttgtacgtacaattttcggctccggtgaagcgaggatcgaagtccagcaaagaggaagaggaaaagcaggattattacgtgaatatgggttatgctattcggaccttgagaaaggagttgccggacatcttctacagagagctcagttttgatatttacagggatgatattgtattcaaagatcctctcaatactttcatcggaatcgacaattataagtcattcttctcggcaccgcgattccatgggaggatatttttcaaagctctctggcttgacattgtcagtgtatggcagccaatggagaatgtcataatggttcgctggaccatccatggcattccacgagtcccatgggaaagtcatggtcgattcgatggcacttctgaatacaaactcgacaagaagggaaaaatatatgagcaccgagtcgacaacaccgcactgaattcaccccctaagtttcacgtgctagctgtggaagatctaatccgatccgtaggttgcccctcaaccccaaggccaacttacttcgagatctcatcggcttcacctccagaaaaaaacataataaaaccaccttaggttcttcataaattttggtaaataatgtgtctcatggtttgttgagctatatatagcatgaaatgggtgttattaatgtgtaaaaaacttgttttagatcacaaagctagcacttagtatttgcttgcttgagttgtattctcatattatgatatcaatcaagttgtatggttttgt

SEQ ID NO: 1493 - protein, 260 aa, Gossypium hirsutum
  misc_feature (1)..(260): Ceres CLONE ID no.1895876
  misc_feature (1)..(260): Bit score of 605.7 for HMM based on sequences of FIGURE 50.
  misc_feature (1)..(260): Functional Homolog Of Ceres SEEDLINE ID no. ME17567 at SEQ ID NO: 1491
MTFLMPSPEVSTAFAKIFSNPTPRHKFLKSCAISKNDDEKVWSKTNARVGVKDVGSTVSGLSQNLRLYVQFSAPVKRGSKSSKEEEEKQDYYVNMGYAIRTLRKELPDIFYRELSFDIYRDDIVFKDPLNTFIGIDNYKSFFSAPRFHGRIFFKALWLDIVSVWQPMENVIMVRWTIHGIPRVPWESHGRFDGTSEYKLDKKGKIYEHRVDNTALNSPPKFHVLAVEDLIRSVGCPSTPRPTYFEISSASPPEKNIIKPP

SEQ ID NO: 1494 - DNA, 816 bp, Populus balsamifera subsp. trichocarpa
  misc_feature (1)..(816): Ceres ANNOT ID no.1464522
  misc_feature (1)..(816): Encodes the peptide sequence at SEQ ID NO 1495
  misc_feature (771)..(771): n is a, c, t, g, unknown, or other
atggcttttcttttaccaaacctctccccttctctccttatcaattccaaatccttcaaagatagagagaaaccagtcctgtaccaaacccaaactttaccctctcattatcaaaccaccaccaccacaacatcaacaacaactaaaaaacccaccaatactaactcttccatgccccctccactgcaggttaagactccaccgggtgcacaggataaggagcagcaccaaagagatgagttttatgtaaaccttggcctagctgtgcggacactccgtgaggatttgcctgtgttattcacagaagacctcaattacgacatctatagggatgatatcacatttatcgaccctctgaatactttcactggaattgacaactataaattgatcttttgggcattgagatttcatggtaaaatgttgtttagagagatttcactcgaggtttataggatttggcaaccctcagagaatgtgatattgattagatggaacttaaagggtgttcctagggtcccatgggaggccaagggagagtttcagggcacttcaaggtataaattggatagaaatggaaaaatttatgaacataaagtggataatttggccttcaattttcctcagcagctcaaacctgctgcttctgtattggatttggtggctgcttgccctgctagtcctaatccaacgtttttgtggggacctgcggacgtctactcgtcttcatgggtggaattctatcgtgctgttagagagactttggaccgngagaacagtacaaattgcttttgcaagatggctacttgttcatag

SEQ ID NO: 1495 - protein, 271 aa, Populus balsamifera subsp. trichocarpa
  misc_feature (1)..(271): Ceres ANNOT ID no.1464522
  misc_feature (1)..(271): Bit score of 667.6 for HMM based on sequences of FIGURE 50.
  misc_feature (1)..(271): Functional Homolog Of Ceres SEEDLINE ID no. ME17567 at SEQ ID NO: 1491
  misc_feature (257)..(257): Xaa is any aa, unknown or other
MAFLLPNLSPSLLINSKSFKDREKPVLYQTQTLPSHYQTTTTTTSTTTKKPTNTNSSMPPPLQVKTPPGAQDKEQHQRDEFYVNLGLAVRTLREDLPVLFTEDLNYDIYRDDITFIDPLNTFTGIDNYKLIFWALRFHGKMLFREISLEVYRIWQPSENVILIRWNLKGVPRVPWEAKGEFQGTSRYKLDRNGKIYEHKVDNLAFNFPQQLKPAASVLDLVAACPASPNPTFLWGPADVYSSSWVEFYRAVRETLDXENSTNCFCKMATCS

SEQ ID NO: 1496 - DNA, 1119 bp, Arabidopsis thaliana
  misc_feature (1)..(1119): Ceres CLONE ID no.21947
  misc_feature (1)..(1119): Encodes the peptide sequence at SEQ ID NO 1497
gctcttctcaactcgtcatcctctccctctgattctcttaagtcgccttgaaaaattaagacaaaacaacaacaaaagaacaagagaagctctaaaatccagcagctatggcgtttcttctccccaatctctctccttctttccttcttccgaccggaaaatcactcaaagagaaacccatttccaaccaagctttatcatcatcatcatcatcgtccaatagctacgagtttgaagaagatagtctctctccactttctctctttagcgtccaggctcctcctcctgttcgaggtgcgcaggttaagaccaaaccaagtgcgcaggataagtaccagcacggcagcaaagatgacttctacatcaatctcggtttagctgtacgtacccttcgcgaagatttgcctctcctcttcaccaaagatctcaattacgacatttacagggatgatataacattagtggatccaatgaacacgttctctgggattgacaactacaaattgatcttctgggcacttagatttcatggcaagattctcttcagggatatctcacttgagatcttcagggtttggcaaccatcagagaacatgattctcatcaggtggaatcttaaaggtgtacctagagtcccatgggaggcaaagggagagtttcagggtacttctcgctataaactcgaccgaaatggcaaaatctatgagcataaggtcgataacttggccttcaacttccctcaccagctcaaacctgccacttctgttttggatatggtcaccgcttgccctgcaagtcccaatccaactttcatgtttggcgccatggattcatactcatcttcttggattgagttctacaaagcagtgcaaaggacactagacaagcaagaagagcaaatgcttgtgcaagaccatttcgtcccatgctcataatgccattaggtcacactcaggtgtatatatatatactgttacattgaagatacaatacatatatctatgtgtgcaggcatatgcatatgagtagatgtggttgacttagatatcaaagagggtagggaaccaagaatactcatgagcttgtacaacttgcctattgaatgtaaacagaattccg

SEQ ID NO: 1497 - protein, 275 aa, Arabidopsis thaliana
  misc_feature (1)..(275): Ceres CLONE ID no.21947
  misc_feature (1)..(275): Bit score of 644.6 for HMM based on sequences of FIGURE 50.
  misc_feature (1)..(275): Functional Homolog Of Ceres SEEDLINE ID no. ME17567 at SEQ ID NO: 1491
MAFLLPNLSPSFLLPTGKSLKEKPISNQALSSSSSSSNSYEFEEDSLSPLSLFSVQAPPPVRGAQVKTKPSAQDKYQHGSKDDFYINLGLAVRTLREDLPLLFTKDLNYDIYRDDITLVDPMNTFSGIDNYKLIFWALRFHGKILFRDISLEIFRVWQPSENMILIRWNLKGVPRVPWEAKGEFQGTSRYKLDRNGKIYEHKVDNLAFNFPHQLKPATSVLDMVTACPASPNPTFMFGAMDSYSSSWIEFYKAVQRTLDKQEEQMLVQDHFVPCS

SEQ ID NO: 1498 - DNA, 1090 bp, Brassica napus
  misc_feature (1)..(1090): Ceres CLONE ID no.968434
  misc_feature (1)..(1090): Encodes the peptide sequence at SEQ ID NO 1499
  misc_feature (539)..(539): y is t/u or c
  misc_feature (541)..(541): y is t/u or c
  misc_feature (543)..(543): y is t/u or c
  misc_feature (551)..(551): y is t/u or c
  misc_feature (600)..(600): y is t/u or c
aaagcacttcgtgcatcatcctcttccccctgtctgtctgattcttcgccgtgaaaaaagtaaagacaatagaaggctcagctcagctagttatggcgtttcttctcccgaatctctctccttcattccttcttcaaactggaaaatccctcaaagagaaacccatttcaacccattctctatccatatcatcatcttcttcttcttccaatagctacgagttcgaagaaggtagtctctctcttctatctcttcctgtccaggctcctcctgctccaggcgcgcaggtcaagaccatgccgagtgagcaagataagcaccagcagcatggcaaagatgagttctacatcaatctcggtttagctatacgcacccttcgtgaagatttgcctttgctcttctccaaagatctcaattacgacatttacagggatgatataacactggtggatccagcgaacactttctctgggattgagaactacaaactgatcttctgggcactcaggtttcatggcaagattctcttcagagatatytytyttgagatytacagggtttggcaaccatcagagaacatgatcctcataaggtggaatytcaaaggtgtgcctagagttccatgggaggccaaaggagagtttcagggaacttctcgctataaactggaccgtaatggcaaaatctatgagcataaagttgataacttggctttcaacttccctcaccagctcaagcctgccacttctgttttggatttggtcactgcttgccctgccagtcccaatccaacattcatgtttggctcttcgtactcgtcttcttggattgagttctatcaagctgtgcaaaggacactagacaagcaacaagaccaaatcgttatgcaagaccgttttgttatatgtttatagagccgttgatgtgatcacactcagatgtatatgtatatatacactcttgcattaatgataatatacatacaatgtgcaggcatatgtagatgtggttgacttagggaagcaaacctgtgtaacccatgagcttgtacaactttgcctatcgaatgtaaacagaattcattatagtt

SEQ ID NO: 1499 - protein, 273 aa, Brassica napus
  misc_feature (1)..(273): Ceres CLONE ID no.968434
  misc_feature (1)..(273): Bit score of 657.5 for HMM based on sequences of FIGURE 50.
  misc_feature (1)..(273): Functional Homolog Of Ceres SEEDLINE ID no. ME17567 at SEQ ID NO: 1491
  misc_feature (149)..(149): Xaa is any aa, unknown or other
  misc_feature (150)..(150): Xaa is any aa, unknown or other
  misc_feature (151)..(151): Xaa is any aa, unknown or other
  misc_feature (153)..(153): Xaa is any aa, unknown or other
  misc_feature (170)..(170): Xaa is any aa, unknown or other
MAFLLPNLSPSFLLQTGKSLKEKPISTHSLSISSSSSSSNSYEFEEGSLSLLSLPVQAPPAPGAQVKTMPSEQDKHQQHGKDEFYINLGLAIRTLREDLPLLFSKDLNYDIYRDDITLVDPANTFSGIENYKLIFWALRFHGKILFRDXXXEXYRVWQPSENMILIRWNXKGVPRVPWEAKGEFQGTSRYKLDRNGKIYEHKVDNLAFNFPHQLKPATSVLDLVTACPASPNPTFMFGSSYSSSWIEFYQAVQRTLDKQQDQIVMQDRFVICL

SEQ ID NO: 1500 - DNA, 1287 bp, Triticum aestivum
  misc_feature (1)..(1287): Ceres CLONE ID no.686479
  misc_feature (1)..(1287): Encodes the peptide sequence at SEQ ID NO 1501
gaagcttctacatggaacacctcaacctagggccggcagccgcaggagaagaagacaagccgcggtagacatcgagatcagccggagagaaaaatcgaggggacacgatacgagagcaggaagccatggccttcctcctccccaagctcaccacgcctccctgcagatcgccgccgcccagtcccctcaagccccagctcggcctgcccagccacggaggcggcaggctccacggggccggctcggcgcaggccgcggcgccgacccacctcaacctcccgctcctcctcagcgcctcgcagcaagaagcccccacggccaagtccgccgagaccaggaacagggctgcgagcggcggcggcggcggcggcggggacccgcgaaggtcggatttttacctcaaccttggggcggcggtgcgcgcgctgcgggacgacctgccggccgtgtttctccgggaacccaactacgacatctaccgcgaagacatcacatttgttgatccgctgaacactttccatgggattgacaactacaaaacaatcttctgggctctcagattccacggacgtctactattcagtgaaattgggctcgacgtatcacgcatttggcaactaacagaaacctcgatagttgtccggtgggaactgtggggcacaccgcgtgtcccgtgggaatcatatggctgcttcagtggcacatccaggtacaaagtcgacaggaacgggaaaatttacgagcataaagtcgacaacctggcattggacttcccccggccggctgtcaaagtgagcagcattactaacttagtagttgctgcatacccaccgagccccaatccaactttctgggatgtagttgggacaggcgatggatgctcatggacaaagctttaccgagcggtgctggagacagtagagcgggaaggtgacattcccgcaggcatttgcatggaaggtctactcacttgttcatagatggaatcaacttcaggactagctgcttcggtagtgagttttgctagaaaaaatgtatagaatgtggatacatattaatcacatcactgtcagttctctgtttgtataatgtagctcagcactagaacaactttagatcaaattcatggtagatgactatacctcatcatcattgttgtgtattttaggatattactgccacttgcttacatcttatgagatatgaatacaaagttgtagattttctcatgggttaggaaaactctgttccctaaattatttaggaaaatggaagatcttgaagaac

SEQ ID NO: 1501 - protein, 284 aa, Triticum aestivum
  misc_feature (1)..(284): Ceres CLONE ID no.686479
  misc_feature (1)..(284): Bit score of 706.0 for HMM based on sequences of FIGURE 50.
  misc_feature (1)..(284): Functional Homolog Of Ceres SEEDLINE ID no. ME17567 at SEQ ID NO: 1491
MAFLLPKLTTPPCRSPPPSPLKPQLGLPSHGGGRLHGAGSAQAAAPTHLNLPLLLSASQQEAPTAKSAETRNRAASGGGGGGGDPRRSDFYLNLGAAVRALRDDLPAVFLREPNYDIYREDITFVDPLNTFHGIDNYKTIFWALRFHGRLLFSEIGLDVSRIWQLTETSIVVRWELWGTPRVPWESYGCFSGTSRYKVDRNGKIYEHKVDNLALDFPRPAVKVSSITNLVVAAYPPSPNPTFWDVVGTGDGCSWTKLYRAVLETVEREGDIPAGICMEGLLTCS

SEQ ID NO: 1502 - DNA, 1244 bp, Zea mays
  misc_feature (1)..(1244): Ceres CLONE ID no.1564962
  misc_feature (1)..(1244): Encodes the peptide sequence at SEQ ID NO 1503
gagcctcgtagacgaagcagaggaaaccagcgaaatcaaagagcaaggaagcaagaagcagggagccatggcgttcctccttcccaagctcacaacgccgtcctgcaagttgcccccaagtcccctcctcaagccccagctcgctcagccggtccacggcggcggcaagattcaaggctccgtcttcggctctgttgcggcgcaggtcgcggccccgggccacctcagtctcctgctcctgctcagcgcctcgcagcaggcagccgccccggcggccaaatccacggcgaccaagaaccggggcaagggcggcggggatccgcaaaggtcggatttttacctcaacctcgggacggcggtgcgcacgctgcgggacgacctgcccgacgtcttcgtccgggaacccaactacgatatctaccgtgaagacatcacatttgtcgacccactaaacacttttcatgggattgacaactacaagactatcttctgggcgcttagattccacgggcgcctactattcagagaaattgggcttgatgtatcacgcatttggcaactgacagagaattcaatagttgtccggtgggagctgtggggcactccacgtgttccatgggaatcgtatggctgcttcagtgggacgtcgagatacaaggttgacaggaacgggaaaatttacgagcacaaagtcgacaacttggcattggacttcccacgatcagtagcgaaagtgggcagcattgctgacatggtagtcgccacaccgagccccaatttaacgttctggaacgtggttgggacaggtgatggttgctcatggacaaagctgtatgaagccgtgctggaagctgtggaacgggaagagcatagttccacaggcattggcgttggagctctaggccctgttggctgcggatgtggctgcagtttttgaactggaaaactactgtagcttgaactgctgcagccagttcaagcgaagagggcccttaatcactagttcataggatggaatgagctccgggactagttgcttggtagtagttcttaggggaaatgtatagaagaatatatatatatatgggcacatgaatcacgataccactaatatttctctgtatactgtagctataggacagcaaatttagataaaacacatactaggtggctacatttgattacccttgtgaccttgtctcatacagtcatactgaggtagtgctttcactgctttcatatgc

SEQ ID NO: 1503 - protein, 289 aa, Zea mays
  misc_feature (1)..(289): Ceres CLONE ID no.1564962
  misc_feature (1)..(289): Bit score of 702.7 for HMM based on sequences of FIGURE 50.
  misc_feature (1)..(289): Functional Homolog Of Ceres SEEDLINE ID no. ME17567 at SEQ ID NO: 1491
MAFLLPKLTTPSCKLPPSPLLKPQLAQPVHGGGKIQGSVFGSVAAQVAAPGHLSLLLLLSASQQAAAPAAKSTATKNRGKGGGDPQRSDFYLNLGTAVRTLRDDLPDVFVREPNYDIYREDITFVDPLNTFHGIDNYKTIFWALRFHGRLLFREIGLDVSRIWQLTENSIVVRWELWGTPRVPWESYGCFSGTSRYKVDRNGKIYEHKVDNLALDFPRSVAKVGSIADMVVATPSPNLTFWNVVGTGDGCSWTKLYEAVLEAVEREEHSSTGIGVGALGPVGCGCGCSF

SEQ ID NO: 1504 - protein, 281 aa, Oryza sativa subsp. indica
  misc_feature (1)..(281): Public GI ID no.125549699
  misc_feature (1)..(281): Bit score of 687.2 for HMM based on sequences of FIGURE 50.
  misc_feature (1)..(281): Functional Homolog Of Ceres SEEDLINE ID no. ME17567 at SEQ ID NO: 1491
MAFLLPKLTTPSCKSPPSPLKSQLGLPGGGKLQPAQAVAPSHLNLLLLLGASQQEAAAVPTPKSRSKNGGGRSGGGGGEDPRRSDYYLNLGTAVRTLRDDLPAVFVREPNYDIYREDITFVDPLNTFHGIDNYKTIFWALRFHGRLLFREIGLDISRIWQLTENSIVVRWELWGTPRVPWESYGCFSGTSRYKVDRNGKIYEHKVDNLALDFPRPAAKVGSIADIVVATCPPSPNLTFWDMVGSTGDGCSWANLYQAVVETVEQEGNDPAGIAIEGLLTCS

SEQ ID NO: 1505 - protein, 281 aa, Oryza sativa subsp. japonica
  misc_feature (1)..(281): Public GI ID no.125591612
  misc_feature (1)..(281): Bit score of 688.1 for HMM based on sequences of FIGURE 50.
  misc_feature (1)..(281): Functional Homolog Of Ceres SEEDLINE ID no. ME17567 at SEQ ID NO: 1491
MAFLLPKLTTPSCKSPPSPLKSQLGLPGGGKLQPAQAVAPSHLNLLLLLGASQQEAAAVPTPKSRSKNGGGRSGGGGGEDPRRSDYYLNLGTAVRTLRDDLPAVFVREPNYDIYREDITFVDPLNTFHGIDNYKTIFWALRFHGRLLFREIGLDISRIWQLTENSIVVRWELWGTPRVPWESYGCFSGTSRYKVDRNGKIYEHKVDNLALDFPRPAAKVGSIADIVVASCPPSPNLTFWDMVGSTGDGCSWANLYQAVVETVEREGNDPAGIAIEGLLTCS

SEQ ID NO: 1506 - protein, 281 aa, Oryza sativa subsp. japonica
  misc_feature (1)..(281): Public GI ID no.115460506
  misc_feature (1)..(281): Bit score of 687.9 for HMM based on sequences of FIGURE 50.
  misc_feature (1)..(281): Functional Homolog Of Ceres SEEDLINE ID no. ME17567 at SEQ ID NO: 1491
MAFLLPKLTTPSCKSPPSPLKSQLGLPGGGKLQPAQAVAPSHLNLLLLFGASQQEAAAVPTPKSRSKNGGGRSGGGGGEDPRRSDYYLNLGTAVRTLRDDLPAVFVREPNYDIYREDITFVDPLNTFHGIDNYKTIFWALRFHGRLLFREIGLDISRIWQLTENSIVVRWELWGTPRVPWESYGCFSGTSRYKVDRNGKIYEHKVDNLALDFPRPAAKVGSIADIVVASCPPSPNLTFWDMVGSTGDGCSWANLYQAVVETVEREGNDPAGIAIEGLLTCS

SEQ ID NO: 1507 - DNA, 888 bp, Sorghum bicolor
  misc_feature (1)..(888): Ceres ANNOT ID no.6006969
  misc_feature (1)..(888): Encodes the peptide sequence at SEQ ID NO 1508
atggcgttcctccttcccaagctcacaacgccgtcaggcccgtcatgcaagttgcccccgagtcccctcctcaagccccagctagcccagccgggccacagcggcggcaagatccaaggctccgtctccggcgctggcgctgcgcaggtcgcggccccgggccacctcagtctccttctcctactcagcgccccgcagcaggcagcggacccagcgtccaagtccacggcgaccaagaaccggggcaagggcggcggggatccgcaaaggtcggatttttacctcaacctcgggacggcggtgcgcacgctgcgggacgacctgcccgacgtcttcgaccgggaacccaactacgatatctaccgtgaagacatcacatttgtcgacccactaaacacttttcatgggattgacaactacaagactatcttctgggcacttagattccatgggcgcctactattcagagaaattgggcttgatgtatcacgcatttggcaactgacagagacttcaatagttgtccggtgggagctgtggggcactccacgtgtcccatgggaatcatatggctgcttcagtgggacgtcgagatacaaggttgacaggaatgggaaaatttacgagcacaaagtcgacaacttggcattggacttcccacgatcagtagcgaaagtgggcagcattgctgacatggtagtcgccacaccaagccccaatttaacgttttggaatgtggttgggccaggtgatggttgctcatggacaaagctttatgaagccgtggtggaagctgtggaacgggaagaacatggttccactggcattggcgttggaggtctacctgtaccctgcagctttggctgcggctgtggcagcagtttttga

SEQ ID NO: 1508 - protein, 295 aa, Sorghum bicolor
  misc_feature (1)..(295): Ceres ANNOT ID no.6006969
  misc_feature (1)..(295): Bit score of 696.0 for HMM based on sequences of FIGURE 50.
  misc_feature (1)..(295): Functional Homolog Of Ceres SEEDLINE ID no. ME17567 at SEQ ID NO: 1491
MAFLLPKLTTPSGPSCKLPPSPLLKPQLAQPGHSGGKIQGSVSGAGAAQVAAPGHLSLLLLLSAPQQAADPASKSTATKNRGKGGGDPQRSDFYLNLGTAVRTLRDDLPDVFDREPNYDIYREDITFVDPLNTFHGIDNYKTIFWALRFHGRLLFREIGLDVSRIWQLTETSIVVRWELWGTPRVPWESYGCFSGTSRYKVDRNGKIYEHKVDNLALDFPRSVAKVGSIADMVVATPSPNLTFWNVVGPGDGCSWTKLYEAVVEAVEREEHGSTGIGVGGLPVPCSFGCGCGSSF

SEQ ID NO: 1509 - DNA, 1023 bp, Arabidopsis thaliana
  misc_feature (1)..(1023): Ceres SEEDLINE ID no.ME17932
  misc_feature (1)..(1023): Ceres ANNOT ID no.875012
  misc_feature (1)..(1023): Inplanta Sequence
  misc_feature (1)..(1023): Encodes the peptide sequence at SEQ ID NO. 1510
atggagtctctggggaagctacagctacatcaccagccatttcacctttccttcactcacacctcttcttcaacattccccaaaaacctcttcaaatcctcaattcaaccaatttcatctctcaaatccgcttcaattaaagcttcgtcctccaaatttcaaaactctatcacccctctcccaaagtccacacctttccgtctcttcaaatccacatgcatcactctaacaaccgccgcggctctgcttttggcgaatctccatctcaaatcgccggcgattgcagctcccatcgcgcctccgccgtcagttgaaagcaaagaaaacgttaccttggaagaagaagagagagcgcttgatgagcatttgattactcacccttctgatgtcgacgctcttcgttcattgatggaggtaaagatcaaatctcgaaagcttacagaagcagtagaagtgatcgatcgtttgataaaattggaacctgaagaaaaagaatggccagttttgaaagctaacatctttacctacagtggagatctagacttggctaaaactggatttgaagagattctggctaaagatccgcttcgtgttgaagcttatcacggcttgcttatggcttattcagatgcaggtcttgatttgaaagaggtggagagtagaattgaggaagcaatgttgaagtgcaaaaaggagaataatcaaaacgattttcgggattttaagctactcgtggcgcagattcgggtcattgaaggaaaacatagtgaagcattgaagctttatcaagagcttgtaaaggaggaaccaagagattttaggccgtatctttgtcagggaattatatacacattgctgaagaagaaagacaaggcagaagaacagtttgataactttcggaaacttgttccaaagaatcatccttatagagagtattttatggataatatgatagcaacaaagcttttttccgagaaggcgcagcgtgagatggctgaggagatggctggatcaactagttga

SEQ ID NO: 1510 - protein, 340 aa, Arabidopsis thaliana
  misc_feature (1)..(340): Ceres SEEDLINE ID no.ME17932
  misc_feature (1)..(340): Ceres ANNOT ID no.875012
  misc_feature (1)..(340): Bit score of 882.4 for HMM based on sequences of FIGURE 51.
  misc_feature (273)..(306): Pfam Name: TPR_2 Pfam Description: Tetratricopeptide repeat
MESLGKLQLHHQPFHLSFTHTSSSTFPKNLFKSSIQPISSLKSASIKASSSKFQNSITPLPKSTPFRLFKSTCITLTTAAALLLANLHLKSPAIAAPIAPPPSVESKENVTLEEEERALDEHLITHPSDVDALRSLMEVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 1511 - DNA, 1354 bp, Gossypium hirsutum
  misc_feature (1)..(1354): Ceres CLONE ID no.1842178
  misc_feature (1)..(1354): Encodes the peptide sequence at SEQ ID NO 1512
aatcctcagtgattgaagggcttcgaacttctctgctttatcttcaatcagggttttagagaataaaaaatcacaaagccttctctttttcactaagaaatggagtctcttactaaactacactgccgtcttcaacctctgcatctctctttcaatcaccaacgtccgtcatttgctaaacccatatcatcttctgtgtctttcaggacttcatcgtcatcgtcaccgttcaaattaacctccatcagagctttatcttcctcatcatcttcatcagttccgctccatcaaacccccaaaccttccctcctccaaacgctagcccctctactcaaaaccacttgcattaccataactgccggcgccgcactcctcttcatgcgcttccaccagaaacccgccctcgccgccaccccaacggtaacacccacggtagagcctgctcaaacggactcgaatgtctccttagaagatcaagagaaaaccattgaggaacacttgactcagtacccaaatgacgttgaagctctacagtcactcatggaggtccgaatcaaatcaagaaaactcccacaagctatcgaagttatcgaccgtttgatccagctcgagcccgaagacaccgaatggccaatgttaagagcccaaattcatagctacagtggcgatttcgcgctagccaagaacgagttcgaagagatattagctaaagacccagttcgtgtcgaggcttttcacggccttgtaatggcttcttcggagtcgggtcaaaagttgaaagagctggaaaaaagaattgaaggggcgatggagaagtgcaagaaagagaagaaaaacaaagattttagagattttaagttattaattgcacaaattcgggtgattgaaggggaccatttggaagctttgaaggtttatgagggtttagttaaggaagaaccaagggattttaggccatatttgtgtatgggaattatttactctttaatgaagaagaaagatgaggctgagaagcattttgaaaaggttaggaaacttgttcctaggaatcacccttatagagagtactttgttgataacatggtggccacaaagcttttctctgaaagggctgagagggaaggcgcttgaaagagttgggacacatttgctttgcttgaatgatggtttttacaaagaggtgcccttttttgtcatacttttaatcagtcacttggttttttttccccctttttagttatttttcaatgtttttgcagcaatttggatatttgtttatagttaggtcggtatttagtgcagtaatatgcatagtgatgaaaaggcataatcgatataattgagttggttgtct

SEQ ID NO: 1512 - protein, 343 aa, Gossypium hirsutum
  misc_feature (1)..(343): Ceres CLONE ID no.1842178
  misc_feature (1)..(343): Bit score of 919.1 for HMM based on sequences of FIGURE 51.
  misc_feature (250)..(283): Pfam Name: TPR_2 Pfam Description: Tetratricopeptide repeat
  misc_feature (1)..(343): Functional Homolog Of Ceres SEEDLINE ID no. ME17932 at SEQ ID NO: 1510
MESLTKLHCRLQPLHLSFNHQRPSFAKPISSSVSFRTSSSSSPFKLTSIRALSSSSSSSVPLHQTPKPSLLQTLAPLLKTTCITITAGAALLFMRFHQKPALAATPTVTPTVEPAQTDSNVSLEDQEKTIEEHLTQYPNDVEALQSLMEVRIKSRKLPQAIEVIDRLIQLEPEDTEWPMLRAQIHSYSGDFALAKNEFEEILAKDPVRVEAFHGLVMASSESGQKLKELEKRIEGAMEKCKKEKKNKDFRDFKLLIAQIRVIEGDHLEALKVYEGLVKEEPRDFRPYLCMGIIYSLMKKKDEAEKHFEKVRKLVPRNHPYREYFVDNMVATKLFSERAEREGA

SEQ ID NO: 1513 - DNA, 1285 bp, Gossypium hirsutum
  misc_feature (1)..(1285): Ceres CLONE ID no.1808091
  misc_feature (1)..(1285): Encodes the peptide sequence at SEQ ID NO 1514
aatataccaaagaaaacctctcttttttctctttctgtaaccatggagtcttttgctacgttacactgccgtcaccaaccgctccacctctctttcattcaccaccgtccctatttccataaacccatcttctctctttccttcagggcttcgtcttcgttcaaattatcctccatcagggcttcctcttcctccactcccttctttgaacccccaaagccttcgccttcgctcctccaaacgctgacgcccctcctcaaaaccacctgcattaccgtcaccgctgctgccgcgcttttcttcgcccgcttctaccagaaacccgctctcgccgccctgacgacacccatcgtggagaccgccacgagggaatcgatggtctccttagaagagcaagagaaaaccctggtacaaaaattagggaagactccgaatgacgttgaaacgctgcggtctctgatggaggtccggatcaaattaaagaaactgcaacaagctatcgatgttatcgagcgtttgattcgtctcgaaccccaagacccggaatggcccatgttaagagcccaaattcatagctacgctggcaatttcgagctagccaaggaggagttcgaagaaatattggctaaagacccagatcgggtggaagcttttcacggccttgtaatggcttattcggattcgggtcagaaattgaaagaactggaaaaaagaattgaaggggcaatggagaagtgcaagaaagagaagaagaataaagatttcagggatttcaagctattaattgctcaaattcgggtcattgaagggagacattcagaagctttgaaggtttatgaaggtttggttaaggaggaaccaaaggattttaggccatatttgtgtatggggattatctacacgttactgaagaagaaagctgaagctgagaaacagtttgaaaagttcaggaaacttgttcctaagaatcacccttacagggagtactttgttgataacatgatcgccactaggctttttgccgaaaaagccgaaagggaaggcgcagtgaagcgttgagtgtcttggggtttattcattttctgagaagaagattcatgttcttacaaagaggtccctttttgtttttcttccttttaatttccttttatttctcttatttttcctaccgttttattcaatgttgcattacataagtttttttgggtttagtataaagttaaacattgcttagttgagctaagcttatctattatggaagttaactgcaagctcctgttatccg

SEQ ID NO: 1514 - protein, 338 aa, Gossypium hirsutum
  misc_feature (1)..(338): Ceres CLONE ID no.1808091
  misc_feature (1)..(338): Bit score of 741.9 for HMM based on sequences of FIGURE 51.
  misc_feature (276)..(309): Pfam Name: TPR_2 Pfam Description: Tetratricopeptide repeat
  misc_feature (1)..(338): Functional Homolog Of Ceres SEEDLINE ID no. ME17932 at SEQ ID NO: 1510
MESFATLHCRHQPLHLSFIHHRPYFHKPIFSLSFRASSSFKLSSIRASSSSTPFFEPPKPSPSLLQTLTPLLKTTCITVTAAAALFFARFYQKPALAALTTPIVETATRESMVSLEEQEKTLVQKLGKTPNDVETLRSLMEVRIKLKKLQQAIDVIERLIRLEPQDPEWPMLRAQIHSYAGNFELAKEEFEEILAKDPDRVEAFHGLVMAYSDSGQKLKELEKRIEGAMEKCKKEKKNKDFRDFKLLIAQIRVIEGRHSEALKVYEGLVKEEPKDFRPYLCMGIIYTLLKKKAEAEKQFEKFRKLVPKNHPYREYFVDNMIATRLFAEKAEREGAVKR

SEQ ID NO: 1515 - DNA, 1023 bp, Populus balsamifera subsp. trichocarpa
  misc_feature (1)..(1023): Ceres ANNOT ID no.1475265
  misc_feature (1)..(1023): Encodes the peptide sequence at SEQ ID NO 1516
atggagtcagttgctaaactgcactgccgtcaccaacccttcaacctctcactcaatccccaccgtccatcatttccaaaacccatcatttccctctccttcaaaaccccacctccctcatcatcgtcacccttcaaactctcctctacctccatcagagcctcctcctcctcctcctcccgcatcaccccactcaataaaaaccttggcaccatcatcaaaatcacttcaatcactctcaccgcggcagccgctttattcttcactcgcctcaatatcaaaccagcaatcgcctccccgcttaccgcgtcatccacagtagaccccacagaggaatcttcgaaagaaaatgtttcgtatgaagaacaagagagagctcttcaagattatctgtctcaaaaccccaatgatattgaagctctacggtctctcatggaggtgaggatcaaatcaaagaaacttgttgaagcaattgaagttgttgatcgattaatcgagctggagccaaatgaagatgaatggccattgttgaaatcacaaatttacacttacagtggagattttgagtctgctaaagatgggtttgaagcgattttaaaaaaagatccacttcgcgtggaggcttatcacggccttgtaatggcgaattcggaatccggtggttccttggaagttgtgttgaaaagaatagagagtgcaatggataaatgtaaaaaagaaaagaagacttcggatttgcgggattttaagttgttggttgcgcaagttagagtaatggaggagaagtatcttgatgcattgaaggtttatgaggagttggtgaaagaggaaccgagggattttaggccgtatttgtgtcaagggatcatttatactttgttaaggaagaaagatgaagcggagaaaaagtttgagcagtttaaaaagcttgttccgaagaatcatccttatagggagtatttggttgataatatgtttgctactaagttcttttcggacaaggtagagagggagaggagttga

SEQ ID NO: 1516 - protein, 340 aa, Populus balsamifera subsp. trichocarpa
  misc_feature (1)..(340): Ceres ANNOT ID no.1475265
  misc_feature (1)..(340): Bit score of 898.9 for HMM based on sequences of FIGURE 51.
  misc_feature (281)..(314): Pfam Name: TPR_2 Pfam Description: Tetratricopeptide repeat
  misc_feature (1)..(340): Functional Homolog Of Ceres SEEDLINE ID no. ME17932 at SEQ ID NO: 1510
MESVAKLHCRHQPFNLSLNPHRPSFPKPIISLSFKTPPPSSSSPFKLSSTSIRASSSSSSRITPLNKNLGTIIKITSITLTAAAALFFTRLNIKPAIASPLTASSTVDPTEESSKENVSYEEQERALQDYLSQNPNDIEALRSLMEVRIKSKKLVEAIEVVDRLIELEPNEDEWPLLKSQIYTYSGDFESAKDGFEAILKKDPLRVEAYHGLVMANSESGGSLEVVLKRIESAMDKCKKEKKTSDLRDFKLLVAQVRVMEEKYLDALKVYEELVKEEPRDFRPYLCQGIIYTLLRKKDEAEKKFEQFKKLVPKNHPYREYLVDNMFATKFFSDKVERERS

SEQ ID NO: 1517 - DNA, 990 bp, Populus balsamifera subsp. trichocarpa
  misc_feature (1)..(990): Ceres ANNOT ID no.1455046
  misc_feature (1)..(990): Encodes the peptide sequence at SEQ ID NO 1518
atggagtccattgctaaacaaccccttaatctctctctcaatccccaccgtccatcatttccaaaccccatcgtttccctcaccttcaaaaccccacctccctcgtcatcacccttcaaactctccacctctatcagagcctcatcctcctcccgcatcaccccactcaatcaatctctcaccaccatcatcaaaacgacttccatcactctcaccgccgctgccgtattattcttcacgcgcttcaactccaaacccgcaatcgcctctccggtcgccgcgtcgtcatccactgcagaccccacaaaagaatcgtccaaagaaaatgtttcgtttgaagaacaagaaagagctcttcaagatcatctggctcaaaaccccagtgatgtcgaagctttacggtctctcatggaggtgaggatcaaatcaaagaaacttcaagaggcaattgaagttgttgaccgattaatcgagctggaaccaaatgaagatgaatggccattgttgaaatcgcaaatttatacttacagtggagattttgagtctgctaaagatgggtttgaagcagttttgcaaaaagacccacttcgggtcgaggcttatcatggccttgtaatggcgaattcggaatccggtggttcgttggaagttgtgttgaaaagaattgagagtgcaatgaataaatgtaagaaagaaaagaagaactcggatttgagggattttaagttattgattgcgcaagttagagtaatggaggagaagtattttgatgcgttgaaggtttatgaggagttggtgaaagaggaaccgagggattttaggccgtatttgtgtcaagggatgatttatactttattgaggaagaaagatgaagcagaaaagaagtttgagcagtttaaaaagcttgttccgaagaatcatccttatagggagtatttggttgaaaatatgtttgctactaacttcttttcggagaaggtagagagatag

SEQ ID NO: 1518 - protein, 329 aa, Populus balsamifera subsp. trichocarpa
  misc_feature (1)..(329): Ceres ANNOT ID no.1455046
  misc_feature (1)..(329): Bit score of 773.9 for HMM based on sequences of FIGURE 51.
  misc_feature (273)..(306): Pfam Name: TPR_2 Pfam Description: Tetratricopeptide repeat
  misc_feature (1)..(329): Functional Homolog Of Ceres SEEDLINE ID no. ME17932 at SEQ ID NO: 1510
MESIAKQPLNLSLNPHRPSFPNPIVSLTFKTPPPSSSPFKLSTSIRASSSSRITPLNQSLTTIIKTTSITLTAAAVLFFTRFNSKPAIASPVAASSSTADPTKESSKENVSFEEQERALQDHLAQNPSDVEALRSLMEVRIKSKKLQEAIEVVDRLIELEPNEDEWPLLKSQIYTYSGDFESAKDGFEAVLQKDPLRVEAYHGLVMANSESGGSLEVVLKRIESAMNKCKKEKKNSDLRDFKLLIAQVRVMEEKYFDALKVYEELVKEEPRDFRPYLCQGMIYTLLRKKDEAEKKFEQFKKLVPKNHPYREYLVENMFATNFFSEKVER

SEQ ID NO: 1519 - DNA, 1312 bp, Glycine max
  misc_feature (1)..(1312): Ceres CLONE ID no.1044646
  misc_feature (1)..(1312): Encodes the peptide sequence at SEQ ID NO 1520
gttgcagtaagtacccaaatcaatgttcacactcacttctccttcttccagggccttacccatggattctcttcccaaattgcgccacccttctccatttcccactcccttatcctcttccctctccttccgctctttaccgccaccccattttccttcgtcgtcgtttaggttaccctccatcagagcctcctcctcaccctcccaaaacgaccccgcttttcgcaccccgagaaacacgccctccctcccccccctcctccaaaccctaacctccttcctctcccccctcctcgaaaccacctgcatcgtcatcgccgccgccgccttcttcttcatgcgcttccaccacacgcccgccgtcatcgccgctccgctcacttcccccgccgcggaaaccgacaccgccttcacccaggaggaagccgagaggcttctcgaagagcgtctgagcaccaaccctcgcgataccgaggcgctccacgcgctcatggaggtcaaaatcaaagcgcgtaagatggacgaagcgttcgaggttttgaaccgtctgattgagctcgaaccggaggagcaggagtggccgctcctgaaggcaaacatgcacatctacaacgacgaccacgccagcgcgcgcaaactgttcgaggaaatcctcaagaaagacccgctccgcgtggaagcgtttcacggcctcgtcatggcgactgcgcagtccaacgagcccttgaaaagtttgttgaagagagtggaagaagcaattgaggtgtgcaaaaagcaaaagaaggattccgatgttagagacttcaggctcttgattgcgcagattaaagtcatggaaggagattacactgaagcactcaaggcttatcaggaattggtgaaggaagagcctagggattttagaccttacttgtgtcagggtattatttatactctccttaggaagaaagatgaagctgataaacaattcaataagtttcgcaggcttgttcccaaggaccatccttacaaggactatttcgaggacaacatgttcgctaccaagttcttctcgcagaaattggagagggagggagctggtgctaggggctgagaaaggttatcactcttgtgattgtcacagagctcctaatgagtttttttttgtcttatcttgtcccttttccttatactgatattcaggtgttgccataggaggttattagtttaatagtttttagtttttcctcgtaataatggttcgaaattactgttggttaggtttctggtggatataaatggtagggttaatgaagagaatctatttttgtgc

SEQ ID NO: 1520 - protein, 343 aa, Glycine max
  misc_feature (1)..(343): Ceres CLONE ID no.1044646
  misc_feature (1)..(343): Bit score of 887.6 for HMM based on sequences of FIGURE 51.
  misc_feature (246)..(279): Pfam Name: TPR_2 Pfam Description: Tetratricopeptide repeat
  misc_feature (1)..(343): Functional Homolog Of Ceres SEEDLINE ID no. ME17932 at SEQ ID NO: 1510
MDSLPKLRHPSPFPTPLSSSLSFRSLPPPHFPSSSFRLPSIRASSSPSQNDPAFRTPRNTPSLPPLLQTLTSFLSPLLETTCIVIAAAAFFFMRFHHTPAVIAAPLTSPAAETDTAFTQEEAERLLEERLSTNPRDTEALHALMEVKIKARKMDEAFEVLNRLIELEPEEQEWPLLKANMHIYNDDHASARKLFEEILKKDPLRVEAFHGLVMATAQSNEPLKSLLKRVEEAIEVCKKQKKDSDVRDFRLLIAQIKVMEGDYTEALKAYQELVKEEPRDFRPYLCQGIIYTLLRKKDEADKQFNKFRRLVPKDHPYKDYFEDNMFATKFFSQKLEREGAGARG

SEQ ID NO: 1521 - DNA, 1259 bp, Glycine max
  misc_feature (1)..(1259): Ceres CLONE ID no.1043110
  misc_feature (1)..(1259): Encodes the peptide sequence at SEQ ID NO 1522
actcgaagggggttttaggttgctcttcttcttcaaccttagccatggagtctctcccaaaaattcgtcattctcacatctcactcaatcactcactacttcaacgaggttctcagtgccatcgttcttcatttccgacacccttctcttccctctctccaccactccctccattctctcctatcagagtctcatcttcaccatcaccgtcacccaaaccccaaaaccccttaaccctaaaccttcttctccctcctctcgtcaaacccacctgcatcgccatagccgcgaccgcattcttcttcatgcgcctccactctccccccgttgcattcgcatcgacgccggtcgctccaccggaatccgccgagtcggaaactctacccaacgaaagcgccactgaggagcaacttcgcaccaccgacaccgacgcgcttcaatcgctccttcaaaccaagatcagagccctcgaaatcaacgaagcgattcgcgttttagaccgtctgtccgagctcgagcccgaggagtccgagtacccgctcctaaaggctcacctgcacatgcgctacggcgagcacgagctcgccgcgaaggtgttcgaggaattgcttcacagagatccgttccacgtggaggcctatcgcggcctcttaatgctgacttcagagacgaacaagccaacggaggaactattgaagagaatcgaagaggccgccgcgaaggtttgcgaggaacaagagagggattccgatgtgagggaccttaagttgttaattgcgcagataaaggttatcaatggggatttatccgaagcactgaaggtgtatgaggagcttgttaaggaagagcctaaggattttagaccttacttgtgtcagggtattgtgtattccatgctgagaaagaaggatgaagctgagaaacagtttgagaagtatcgtgctcttgtcccagaggatcatccttataagcatcattttgaggaaaatactcagtttttggagaggagaggagtaggtggtgcaaagagctgagattgagagtaaggttctttgtttaggaaaatgaagaatatgttttttttttttatgctgatagcttagttttgttaaataattcggatggtgatccgggtatccgggtgaatggtgttattttatttttaggtgattaggtttgctgagtgggattgtttcgcaaataaaaatatatccaattgtttcccggaaaatttttgaaatgaaaaagaagtgttcgac

SEQ ID NO: 1522 - protein, 329 aa, Glycine max
  misc_feature (1)..(329): Ceres CLONE ID no.1043110
  misc_feature (1)..(329): Bit score of 404.5 for HMM based on sequences of FIGURE 51.
  misc_feature (272)..(305): Pfam Name: TPR_2 Pfam Description: Tetratricopeptide repeat
  misc_feature (1)..(329): Functional Homolog Of Ceres SEEDLINE ID no. ME17932 at SEQ ID NO: 1510
MESLPKIRHSHISLNHSLLQRGSQCHRSSFPTPFSSLSPPLPPFSPIRVSSSPSPSPKPQNPLTLNLLLPPLVKPTCIAIAATAFFFMRLHSPPVAFASTPVAPPESAESETLPNESATEEQLRTTDTDALQSLLQTKIRALEINEAIRVLDRLSELEPEESEYPLLKAHLHMRYGEHELAAKVFEELLHRDPFHVEAYRGLLMLTSETNKPTEELLKRIEEAAAKVCEEQERDSDVRDLKLLIAQIKVINGDLSEALKVYEELVKEEPKDFRPYLCQGIVYSMLRKKDEAEKQFEKYRALVPEDHPYKHHFEENTQFLERRGVGGAKS

SEQ ID NO: 1523 - protein, 333 aa, Glycine max
  misc_feature (1)..(333): Public GI ID no.92873189
  misc_feature (1)..(333): Bit score of 107.0 for HMM based on sequences of FIGURE 51.
  misc_feature (266)..(299): Pfam Name: TPR_2 Pfam Description: Tetratricopeptide repeat
  misc_feature (1)..(333): Functional Homolog Of Ceres SEEDLINE ID no. ME17932 at SEQ ID NO: 1510
MASTATTTLFISSEFKPNLPNSLLLPRIRICNKPLSISLQPSKFRATHLSLCNCSRTPLTPSTIFSPQTTLTNFISQKISFFLIGSFIFVACFSRKPAFAVSVPSVDSAEILEEKILEKDSRNVEALKVIVYGKIRRGKCKEAEKFVKRLIDEEPNEVEWRLLLALCYETMGYLSKAKGLYLEILENWPLFVRALHGLAMVMHKNKEGPAVFEMLNKAVELAINENKVTEERNIKILTAQMRVVQGDLEEGLKRCQDLIDQNPRDFRPYLCQGIIYSLLDKKEEAAKQFETYQALVPEEFPQRGFLDDITLAAKGTSPVQFQKEFRNQFSDQK

SEQ ID NO: 1524 - DNA, 1026 bp, Arabidopsis thaliana
  misc_feature (1)..(1026): Ceres SEEDLINE ID no.ME17936
  misc_feature (1)..(1026): Ceres ANNOT ID no.874016
  misc_feature (1)..(1026): Inplanta Sequence
  misc_feature (1)..(1026): Encodes the peptide sequence at SEQ ID NO. 1525
atggcttttcctcagagaaaacgaacaccttctttctcttcttctgttcttgactctgtttaccgttctatcgacgaatctgacggtctccaaagtgacctaaaaggatccatcaacgaaaatgtatcttcatcatcatcctcaccatcaccaaacaagaaagacgacaagcttacaactctaaggcgagcaatcatggacgaagaacactggctttacgcccgaagcagcaccactaccactaactcctctgattcctcttctttttcctcttccgaggcagagtcatatcgaacaaagagaaggttgagaaagcttgcggaacaaggtaaaagatcaggtgatgagagacagagaacaaagagaacggtaatggacaacgatagtagattgttttccaagtccgatgatgataagaagcctaaagccgtgaagataattgaggagctaaagagatcgaagcagccagtgtctcctggagcgcgtctcactagcttcctcaactcgatcttccaatctaacgccaagaaagtgaagctttgttctgtcggtaagacaacagacgttaagtcctcatcctcaaagtcttgcttcagtcgaacaagaaataaaaccgacaacaacaacaacaactgcaagaagttggaaaggtctataagattctatccggttagagtaaccattgatggagactgcagagactatgctcaaaaacacattactcgcgtgaggaaaccaattccagaatttaccgctaagaagagtgtcaaagaggagattaagaccaacgatcatcacactgagtttacttgcatcacaagaaatataggtttgaaggattttgtgagaagtaacaaatatgaaggtaaagaagaggagggggatgcttggagtcactcaagttcggatctgtttgagcttgatagttaccggatcggtatggggcggtacttaaaagaacttccagtctatgaaactactgatttcaagactaatcaagccattgctagaagcttgcttttgtag

SEQ ID NO: 1525 - protein, 341 aa, Arabidopsis thaliana
  misc_feature (1)..(341): Ceres SEEDLINE ID no.ME17936
  misc_feature (1)..(341): Ceres ANNOT ID no.874016
  misc_feature (1)..(341): Bit score of 844.1 for HMM based on sequences of FIGURE 52.
MAFPQRKRTPSFSSSVLDSVYRSIDESDGLQSDLKGSINENVSSSSSSPSPNKKDDKLTTLRRAIMDEEHWLYARSSTTTTNSSDSSSFSSSEAESYRTKRRLRKLAEQGKRSGDERQRTKRTVMDNDSRLFSKSDDDKKPKAVKIIEELKRSKQPVSPGARLTSFLNSIFQSNAKKVKLCSVGKTTDVKSSSSKSCFSRTRNKTDNNNNNCKKLERSIRFYPVRVTIDGDCRDYAQKHITRVRKPIPEFTAKKSVKEEIKTNDHHTEFTCITRNIGLKDFVRSNKYEGKEEEGDAWSHSSSDLFELDSYRIGMGRYLKELPVYETTDFKTNQAIARSLLL

SEQ ID NO: 1526 - DNA, 1137 bp, Populus balsamifera subsp. trichocarpa
  misc_feature (1)..(1137): Ceres ANNOT ID no.1454324
  misc_feature (1)..(1137): Encodes the peptide sequence at SEQ ID NO 1527
atgtacaagaaggagagatcttcaagggaaagcacattccatccaagaagaagaaccccgtctttctcttcaactcttcttgactctatttaccgttcgattgacgaatccaacggtgaagaacagcatgtgctggggatcaagaaacagagttgcaactctgtttctacaaccaggcgtgatacgtcgtttcttgaagaggagaaagaggtatctactactcttagacgagctgtcaggactgagagctggatggagaagaaaagcactcgtggctccatgcaatataattcgacttcaagctcttcagattctagctctgcaggaggaggaggaagcggaggaggtgtgttctcgtcctccgaaaacgagtcaagtgtcagaggaaactcaagttcttgccaacagagaacaaaaccactttcagacaaaccacatcagaaaccgaaatgtgaaggaggagggtttcataagacgaagctaagagcattaaaaatctacggtgaattaaagaaggtaaagcagccgatttcaccaggtggtcgcattgcaagctttctaaattctattttcaattcagcaagtgctgcaaaaaaagtgaaaatgtgctctattggggccatggatgatgtaagttttgagcgtaaatcaaagtctgcttgctcatcggctacttccttttcaaggtcctgtttgagcaaaacacctcctccaagagggaaaccaagtaatggcacaaaaaggtcagttcgattctatcctgttggtgtcattgttgatgaggattcaagaccttgtgggcataaaagtatttatgaagatgatccaggattgatgccaacgcctcgaaaagttgtcaaaagtagttctgtcaaggaattagaggttgctaaaggagcagcagcagattatttaagaagttatcaccaaaggaagaatgttagtgaatttgatttcaggggtttccacaattatgttgcagatgacagtgacagtgacgacgagagttgtacaagctccgatcttttcgagctcgatcatcttattgggattggaaggtacagagaggagctcccagtgtatgaaaccactaacttcaaaactaatcaggccattgctaatggctttttcccgtaa

SEQ ID NO: 1527 - protein, 378 aa, Populus balsamifera subsp. trichocarpa
  misc_feature (1)..(378): Ceres ANNOT ID no.1454324
  misc_feature (1)..(378): Bit score of 974.1 for HMM based on sequences of FIGURE 52.
  misc_feature (1)..(378): Functional Homolog Of Ceres SEEDLINE ID no. ME17936 at SEQ ID NO: 1525
MYKKERSSRESTFHPRRRTPSFSSTLLDSIYRSIDESNGEEQHVLGIKKQSCNSVSTTRRDTSFLEEEKEVSTTLRRAVRTESWMEKKSTRGSMQYNSTSSSSDSSSAGGGGSGGGVFSSSENESSVRGNSSSCQQRTKPLSDKPHQKPKCEGGGFHKTKLRALKIYGELKKVKQPISPGGRIASFLNSIFNSASAAKKVKMCSIGAMDDVSFERKSKSACSSATSFSRSCLSKTPPPRGKPSNGTKRSVRFYPVGVIVDEDSRPCGHKSIYEDDPGLMPTPRKVVKSSSVKELEVAKGAAADYLRSYHQRKNVSEFDFRGFHNYVADDSDSDDESCTSSDLFELDHLIGIGRYREELPVYETTNFKTNQAIANGFFP

SEQ ID NO: 1528 - DNA, 1179 bp, Populus balsamifera subsp. trichocarpa
  misc_feature (1)..(1179): Ceres ANNOT ID no.1476980
  misc_feature (1)..(1179): Encodes the peptide sequence at SEQ ID NO 1529
atgtacaagaaggagagatcttcaagggaaaccacattccctcagagaagaaggaccccatctttctcttcgactcttcttgattctatttaccgttcgattgatgattccaacggcgaagaacatgtgttggggcgatactctagagaaacaaccatgatcaagaaacagggttgcaactctgtttcaacaaccaggcgtgatgcatcatttcttgaaggggagaaacaagcatctcctactcttcgtcgagctgtcatgattgaaagctggatggagaagcgaagctctcgtggctctaagcattataacgcgacctcaagctcttcagactctagctctgcaggaggagggggcggaggagggggaggaggagatgtgttctcgtcctccgaaaatgagtccagtgtcaaagaaaattcgagttttgcccaacaaagaaccaaaccactttcagatacgccacaactgaagccaaggtgtgaaggcggaggctttagtaagacaaagttaagagcattaaaaatctatggtgaattaaagaaggtaaaacagccaatttcaccaggtggtcgcattgcaagcttcctaaattctattttcaattcagcaagtgctgcaaagaaggtgaaaatgtgctctattggggccatggaagatgtaagtttcgagcgtaaatcaaagtctgcttgctcatcggttacttccttttcaaggtcttgtttaagcaaaacaccccctccaagagggaaaccaagcaatggcacaaaaaggtcagttcgattctatccagtcagtgtcattgttgacgaggattctagaccttgtgggcataaatgtatttatgaagatgatccaggattgatgccagtgccccaaaaagctgtcaagagtacttctgtcagggaattagaggttgctagaggagcagcagcaggttattggagaaggagttgtcatcaaaagaagagtgttagtgaatttgatttcaggggttttcacagctatgttgaaggtgatggtgatagcaacagtgatgatgatgagagttgttcaagctctgatctctttgagctcgatcatctgattgggattggaaggtacagagaggagctcccagtgtatgaaaccactaatttcaaaactaatcagtccattgccaatggcttcattctgtaa

SEQ ID NO: 1529 - protein, 392 aa, Populus balsamifera subsp. trichocarpa
  misc_feature (1)..(392): Ceres ANNOT ID no.1476980
  misc_feature (1)..(392): Bit score of 812.2 for HMM based on sequences of FIGURE 52.
  misc_feature (1)..(392): Functional Homolog Of Ceres SEEDLINE ID no. ME17936 at SEQ ID NO: 1525
MYKKERSSRETTFPQRRRTPSFSSTLLDSIYRSIDDSNGEEHVLGRYSRETTMIKKQGCNSVSTTRRDASFLEGEKQASPTLRRAVMIESWMEKRSSRGSKHYNATSSSSDSSSAGGGGGGGGGGDVFSSSENESSVKENSSFAQQRTKPLSDTPQLKPRCEGGGFSKTKLRALKIYGELKKVKQPISPGGRIASFLNSIFNSASAAKKVKMCSIGAMEDVSFERKSKSACSSVTSFSRSCLSKTPPPRGKPSNGTKRSVRFYPVSVIVDEDSRPCGHKCIYEDDPGLMPVPQKAVKSTSVRELEVARGAAAGYWRRSCHQKKSVSEFDFRGFHSYVEGDGDSNSDDDESCSSSDLFELDHLIGIGRYREELPVYETTNFKTNQSIANGFIL

SEQ ID NO: 1530 - protein, 341 aa, Arabidopsis thaliana
  misc_feature (1)..(341): Public GI ID no.15229158
  misc_feature (1)..(341): Bit score of 842.4 for HMM based on sequences of FIGURE 52.
  misc_feature (1)..(341): Functional Homolog Of Ceres SEEDLINE ID no. ME17936 at SEQ ID NO: 1525
MAFPQRKRTPSFSSSVLDSVYRSIDESDGLQSDLKGSINENVSSSSSSPSPNKKDDKLTTLRRAIMDEEHWLYARSSTTTTNSSDSSSFSSSEAESYRTKRRLRKLAEQGKRSGDERQRTKRTVMDNDSRLFSKSDDDKKPKAVKIIEELKRSKQPVSPGARLTSFLNSIFQSNAKKVKLCSVGKTTDVKSSSSKSCFSRTRNKTDNNNNNCKKLERSIRFYPVRVTIDGDCRDYAQKHITRVRKPIPEFTAKKSVKEEIKTNDHHTEFTCITRNIGLKDFVRSNKYEGKEEEEDAWSHSSSDLFELDSYRIGMGRYLKELPVYETTDFKTNQAIARSLLL

SEQ ID NO: 1531 - DNA, 1118 bp, Arabidopsis thaliana
  misc_feature (1)..(1118): Ceres CLONE ID no.152934
  misc_feature (1)..(1118): Encodes the peptide sequence at SEQ ID NO 1532
ctctctcatggcttttcctcagagaaaacgaacaccttctttctcttcctctgttcttgactctgtttaccgctctatcgacgaatccgacggtctacaaagtgacctaaaaggatccatccacgaaaatgtatcttcatcatcatcctcaccatcgccaaacaagagagacgacaagcttacaactccaaggcgagcaatcatggaagaagaaaactggccttacgcccgaagcagcaccactaccactaactcctcggattcctctgctttttcgtcttccgaggcagagtcctatcgaacaaagagaaggttgagaaaacttgcggaacaaggtaaaagatcaggtgatgagagacagagaacaaagagaacatcggtaatggacaacgatagtagattgttttgcaagtcggatgatgataagaagcctaaaggcgtgaatatgattgaggagataaagagatcgaagcagccagtctctcctggagcgcgtctcacgagcttccttaactcgatcttccaatctaacgccaagaaagtgaagctttgttctgtcggtaagacaacagacgttaagtcctcatcctcaaagtcttgcttcagtcgaacaagaaataaaaccgacaacaacaacaacaactgcaagaagttggaaaggtctataagattctatccggttagagtaaccattgatggagactgcagagactatgctcaaaaacacattactcgcgtgaggaaaccaattccagaatttaccgctaagaagagtgtcaaagaggagattaagaccaacgatcatcacactgagtttacttgcatcacaagaaatataggtttgaaggattttgtgagaagtaacaaatatgaaggtaaagaagaggaggaggatgcttggagtcactcaagttcggatctgtttgagcttgatagttaccggatcggtatggggcggtacttaaaagaacttccagtctatgaaactactgatttcaagactaatcaagccattgctagaagcttgcttttgtagtgtttttttttgttcctataacttttttccttatcattgaaattaatttactacttacgccaaagaagatatcaatttactc

SEQ ID NO: 1532 - protein, 342 aa, Arabidopsis thaliana
  misc_feature (1)..(342): Ceres CLONE ID no.152934
  misc_feature (1)..(342): Bit score of 804.2 for HMM based on sequences of FIGURE 52.
  misc_feature (1)..(342): Functional Homolog Of Ceres SEEDLINE ID no. ME17936 at SEQ ID NO: 1525
MAFPQRKRTPSFSSSVLDSVYRSIDESDGLQSDLKGSIHENVSSSSSSPSPNKRDDKLTTPRRAIMEEENWPYARSSTTTTNSSDSSAFSSSEAESYRTKRRLRKLAEQGKRSGDERQRTKRTSVMDNDSRLFCKSDDDKKPKGVNMIEEIKRSKQPVSPGARLTSFLNSIFQSNAKKVKLCSVGKTTDVKSSSSKSCFSRTRNKTDNNNNNCKKLERSIRFYPVRVTIDGDCRDYAQKHITRVRKPIPEFTAKKSVKEEIKTNDHHTEFTCITRNIGLKDFVRSNKYEGKEEEEDAWSHSSSDLFELDSYRIGMGRYLKELPVYETTDFKTNQAIARSLLL

SEQ ID NO: 1533 - DNA, 1476 bp, Glycine max
  misc_feature (1)..(1476): Ceres CLONE ID no.1652842
  misc_feature (1)..(1476): Encodes the peptide sequence at SEQ ID NO 1534
acatttctctgtttcaacttgcattattttctattccctccttcaacccttttgacattctctgcgcggacaatgccacagccttttctcactttaccctcttaaactaaactccattgtcttctcttctccccccccatcatcatcatcacctctcttctcattttcactataataaataacttcttcttcccattctctcttcccctgtagtagccaacaaacaccccaaaaatgcacgagagatcgatgaaagaagctgctggcacgtgcccacaaaggagaagaaccccttccttctcctcttctcttctcgacgccatttaccgttccatcgacgaatcaaaatccaaccttcacgacgatcaacaactgggtctccaccaccacgatcaaaccacacacagtttcacctctgaaaaaggtggcaaaaaagaaagaatgaatcttcgccgagccgtgatgttggaagattggatggagaagcacggttcccattccctcaatgctcagttgctaaactcgagttcaagctcctcagaatgcagctctgcagggggcatattctcctcttcagaaacagacacaacaacaaccctaacgttgaagaaacaaagaccagcaaggctcacatcggagaagaagaagaagaagcaggaccgtattatgagttcagaaaagcagaacaaagaaagtggttttacaaggaccaagttgagggcgttgaaaatttacggcgaattgaaccagagagtgaagcaacccatttcaccggggagtagaatagctagcttccttagctccatcttcaactcacagaacgtgaagaaagccaaaatgtgttacgctggagccgttgaagatgtaagcttcgagcacaaatcaaattccccttgtttctcttccatcccctcttccttttctagaaggtcttgcatgagcaaaacaccctcttcggctaaaaaatccaacaacaacgaagtcaaaagatccgtgaggttttaccccgttagcgtaatcctaggtgaggattctgaaccacaatctagttatcataaatgtaacatcatttacgagagtgaacctaatcttggtgtgagaagttcttccataaaggagctgaagaagaacactgctcggggaaatgaaaatggagctgaagaagcagcagcgcgtggttttgtaaaaggttatcgaaattctggtcagggtgaatttgattttagaggtttttatgatgatgatgatgaagatgatgatgatgatgtgagttgttcaagttcagatttgtttgagctggatcatcttattggagctgcaaggtaccaagaagagcttcctgtctatgaaactaccaatttggaaacaaataaagccattgctagtggtctatgtttgtagtttagttcttaaaaaaaaaaacaaccattaattgtaattatttccatagtttgtggaactcgtgaatttaaaaac

SEQ ID NO: 1534 - protein, 388 aa, Glycine max
  misc_feature (1)..(388): Ceres CLONE ID no.1652842
  misc_feature (1)..(388): Bit score of 1005.8 for HMM based on sequences of FIGURE 52.
  misc_feature (1)..(388): Functional Homolog Of Ceres SEEDLINE ID no. ME17936 at SEQ ID NO: 1525
MHERSMKEAAGTCPQRRRTPSFSSSLLDAIYRSIDESKSNLHDDQQLGLHHHDQTTHSFTSEKGGKKERMNLRRAVMLEDWMEKHGSHSLNAQLLNSSSSSSECSSAGGIFSSSETDTTTTLTLKKQRPARLTSEKKKKKQDRIMSSEKQNKESGFTRTKLRALKIYGELNQRVKQPISPGSRIASFLSSIFNSQNVKKAKMCYAGAVEDVSFEHKSNSPCFSSIPSSFSRRSCMSKTPSSAKKSNNNEVKRSVRFYPVSVILGEDSEPQSSYHKCNIIYESEPNLGVRSSSIKELKKNTARGNENGAEEAAARGFVKGYRNSGQGEFDFRGFYDDDDEDDDDDVSCSSSDLFELDHLIGAARYQEELPVYETTNLETNKAIASGLCL

SEQ ID NO: 1535 - protein, 340 aa, Arabidopsis pumila
  misc_feature (1)..(340): Public GI ID no.75214620
  misc_feature (1)..(340): Bit score of 852.4 for HMM based on sequences of FIGURE 52.
  misc_feature (1)..(340): Functional Homolog Of Ceres SEEDLINE ID no. ME17936 at SEQ ID NO: 1525
MALPQRQRTQSFSSSVLDSIYRSIDESDGLQSDLRGTINSNNNENVSSSSSSSPSPNKKDDKLTTLRRAIMDEEHWLYGRSSTTTTTTTTNSSDSSAFSSSEAESFRTKRRLRKLAEQGNRLGEERQRTKSDDDIKVKAVKMFEELKRSKQPVSPGARLTSFLNSIFQSNAKKVKFCSVGKTTDVKSSSSSRSCFSRTRNKTNNNNNNNNNFKKLERSIRFYPVRVTIDGDCRDYAHKNITRPIPTKVHQTELMKEEIKTKVHQTELTCITRKIGLKDYVRSSNIDEGKEEEDDVWSYSSSDLFELDHYRIGMGRYLKELPVYETTDFKINQAIARGLLL

SEQ ID NO: 1536 - DNA, 1425 bp, Arabidopsis thaliana
  misc_feature (1)..(1425): Ceres SEEDLINE ID no.ME18275
  misc_feature (1)..(1425): Ceres ANNOT ID no.858984
  misc_feature (1)..(1425): Genomic Sequence
  misc_feature (1)..(1425): Inplanta Sequence
  misc_feature (1)..(1425): Encodes the peptide sequence at SEQ ID NO. 1537
atgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggtttgtaagatcaaaattttggataaaaactttgttttgagacatggtttttgatattttttattaataatgtcttaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggtaataaaaataaataagtttcttgtgatacaagaatcatgatatatctagggtttctgaatggatttggatttgcaggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgaggtaagcaatgaaaccatgattctctgtaacttaacttcactattaaccaaagagaataagtctaattcttaaagagccatactttgcagttcctgtcgatgaaacttgctgtcttgaacccggaactagagcttgccgtggaagatgtatccgtaaaacaggtgaaaacacattgtctagaccctcaaagtcatattgatattgctcaacaaacttaagggttatgaaattttcagtttcaggcttactttacaaatgtagttgcttcaaagcaatcaataatggttgatgtgccattgtttccgttagaccagcaaggatctctagatttgtctgcgataaacccgaaccaaacgacatctatcgaagctgtaagtacagctttatatgaaactgaaaaacttgtcagagtttttgttccttgtcagtgaagtaacctgtctctgtatctctctatttcagccatctggaagctgggaaactcaatcacagagtctctacaacacatctagcctcggttttcattactaa

SEQ ID NO: 1537 - protein, 335 aa, Arabidopsis thaliana
  misc_feature (1)..(335): Ceres SEEDLINE ID no.ME18275
  misc_feature (1)..(335): Ceres ANNOT ID no.858984
  misc_feature (1)..(335): Bit score of 687.1 for HMM based on sequences of FIGURE 53.
  misc_feature (192)..(242): Pfam Name: HLH Pfam Description: Helix-loop-helix DNA-binding domain
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 1538 - DNA, 1296 bp, Populus balsamifera subsp. trichocarpa
  misc_feature (1)..(1296): Ceres ANNOT ID no.1514086
  misc_feature (1)..(1296): Encodes the peptide sequence at SEQ ID NO 1539
atgttgcactgtactgacataacagtgctcgagagacaaagagcttgtatcaaatggcaacaagaacagcagcagcagcaacaggttcaactacaacagcaagagattagttattttactgaactgaccggtgtgtttcaacaagctgggtttcatgagggtggtttaagtgaggtggtgacccggtctgtgaaacctgacccgggtttggtggataatggttggaataatgaccatgttgtggggcttggtgttggcccgctgtatgataatgggtcaggttttgagttgaattatggtgccatttctaggatttctagctgcccgccggcggcggtcgctgctgtggcagcggctacagtgaaaggctcagagtctgttgtgtcagataagattagttccggggttggaagagagagttccaagaagagaaaggttgataataaacaaaacaactcaaaggttgatgcagaagaagacaccagggacaaaaggatcaaaggatgtgcagaggaaggagagtcaaagatcacagagaaaaataacaacaaaaacagtcgcaacaataacaccaacaaaaacaataacagtaacaaagaaagttctgctgggaattcgaaggacaattccaaagtaactgaggttcaaaagccggattacattcatgtcagggcacgtcgcggtcaagctactgatagccacagcttagctgaaagagtgaggagggaaaaaatcagtgaaagaatgaagtatcttcaagatttggtaccagggtgtaacaaaatcactggtaaggcaggcatgcttgatgagatcattaactatgttcaatcacttcagagacaagtagagttcttgtcaatgaaactagctgctgtaaatccaaggcttgacttcaactttgacaacttatttgccagagaggcctttcctgcttgttcagtcaattttcccaccattgggatgtcatcagatatgactaatcctgcataccttcagtttaatccagcacaacaacaattagttacatgctgtggattggatatggggacagatcctcctgatatggggcttaaaaggaccaccagttctcctgaatctattcctgaaacatttcttgactcatcctgcttcactcaagcccatcccccaccagcctgggatgctgatctacaaaatctttacaatgtagcttttgatcaaggaagacaaacatccttcccaactcagccatttacaggcaagataaaattatcatgttctattgaagctagcaatctgaagatggagatgtga

SEQ ID NO: 1539 - protein, 431 aa, Populus balsamifera subsp. trichocarpa
  misc_feature (1)..(431): Ceres ANNOT ID no.1514086
  misc_feature (1)..(431): Bit score of 901.6 for HMM based on sequences of FIGURE 53.
  misc_feature (230)..(280): Pfam Name: HLH Pfam Description: Helix-loop-helix DNA-binding domain
  misc_feature (1)..(431): Functional Homolog Of Ceres SEEDLINE ID no. ME18275 at SEQ ID NO: 1537
MLHCTDITVLERQRACIKWQQEQQQQQQVQLQQQEISYFTELTGVFQQAGFHEGGLSEVVTRSVKPDPGLVDNGWNNDHVVGLGVGPLYDNGSGFELNYGAISRISSCPPAAVAAVAAATVKGSESVVSDKISSGVGRESSKKRKVDNKQNNSKVDAEEDTRDKRIKGCAEEGESKITEKNNNKNSRNNNTNKNNNSNKESSAGNSKDNSKVTEVQKPDYIHVRARRGQATDSHSLAERVRREKISERMKYLQDLVPGCNKITGKAGMLDEIINYVQSLQRQVEFLSMKLAAVNPRLDFNFDNLFAREAFPACSVNFPTIGMSSDMTNPAYLQFNPAQQQLVTCCGLDMGTDPPDMGLKRTTSSPESIPETFLDSSCFTQAHPPPAWDADLQNLYNVAFDQGRQTSFPTQPFTGKIKLSCSIEASNLKMEM

SEQ ID NO: 1540 - protein, 337 aa, Arabidopsis thaliana
  misc_feature (1)..(337): Public GI ID no.30680338
  misc_feature (1)..(337): Bit score of 688.4 for HMM based on sequences of FIGURE 53.
  misc_feature (192)..(242): Pfam Name: HLH Pfam Description: Helix-loop-helix DNA-binding domain
  misc_feature (1)..(337): Functional Homolog Of Ceres SEEDLINE ID no. ME18275 at SEQ ID NO: 1537
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQFQAYFTNVVASKQSIMVDVPLFPLDQQGSLDLSAINPNQTTSIEAPSGSWETQSQSLYNTSSLGFHY

SEQ ID NO: 1541 - protein, 320 aa, Arabidopsis thaliana
  misc_feature (1)..(320): Public GI ID no.20127068
  misc_feature (1)..(320): Bit score of 625.9 for HMM based on sequences of FIGURE 53.
  misc_feature (175)..(225): Pfam Name: HLH Pfam Description: Helix-loop-helix DNA-binding domain
  misc_feature (1)..(320): Functional Homolog Of Ceres SEEDLINE ID no. ME18275 at SEQ ID NO: 1537
MSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQFQAYFTNVVASKQSIMVDVPLFPLDQQGSLDSFAINPNQTTSIEAPFGSWETQSQSLYNTSSLGFHY

SEQ ID NO: 1542 - DNA, 1515 bp, Brassica napus
  misc_feature (1)..(1515): Ceres CLONE ID no.1087909
  misc_feature (1)..(1515): Encodes the peptide sequence at SEQ ID NO 1543
ctctttcatctcttctaagcaacctacccaaacaacattacataaatctaaatctctcctcatacatttatagcaaatcatctcttgctttaagcacacactctcacacacaaaatcagagcgtttctccccgtcctctattctgtttgtacttttggtctcactttaaagatcaaatccgtaaattcaagtttagagattttttgcagagaacgatatgttggaaagtcttgtctctctagaaagcatgtccttgagctccatggatgtgtctgtacttgaaaggcttaaatggctgcaacaacaacaacaacaagttctgagcactactaatgcttcacctgaacttcttcagttccatggaaccaacaatgatgagttgttgcagaataccttcagccattttcaaatgcttcgatctggttttggaccaaactatagcatgggttttggtccttcacatgaagctatggatggctgcatttcaataacaaatagctgccagatggatcaagccgatacagtgggggtaatgttgaagaacagtgaagaaaacataactatttccttgaaaaacaagagaaaatcagaggttaagacaagggaagaggaaaagacagagaagaagatcaaagtagaggctgagactgagttaaacatgaaagtaaaatcaaacttgagtaacacggaagcatcttcagaaacttcaaagcagaaatcaaaggcagcttcagagaaccagaaattggattatatccacgttagagctcgtcgaggccaagcaacagacagacacagtttagcagaaagggcaagaagagaaaagatcagcaagaagatgaagtatctgcaagatcttgtccctggatgcaacaaagtcactggaagagctggtatgcttgatgagataattaattatgttcaatctctccagaggcaagttgagttcttgtcgatgaaactggctgtcctaaacccagaactcgagcttgctatggaggacttatctgtaaaacagtttcaggcgtactttacaaatcttcctgtagtagttgcttcaaagccatcactaatggttgatgcgccattgtttccgctggatcagcaaggatctctagatttatcagtgataaacccgaaccaagcaacaactattgaagctccatctgcaagctgggaaactcaatcacagagtctctacaacacatctagcctcggatttcagtactaagaaaatattcattgaagcaatgaagttgacatcatcaggatcagattcagaaccatattctactttatatgcggataaaagtgacaactacgtgttcatggaatatttttcagcttttgcattatcttttgatccttgttttctgatatttaaaccagaagaactggagacagcaatttaatggtcttgtcaccatcaatctttgtataaatcttggtttataagataatatatagagagagagaggaaaagagtaaataaacactatgttttacaggacttat

SEQ ID NO: 1543 - protein, 337 aa, Brassica napus
  misc_feature (1)..(337): Ceres CLONE ID no.1087909
  misc_feature (1)..(337): Bit score of 687.5 for HMM based on sequences of FIGURE 53.
  misc_feature (189)..(239): Pfam Name: HLH Pfam Description: Helix-loop-helix DNA-binding domain
  misc_feature (1)..(337): Functional Homolog Of Ceres SEEDLINE ID no. ME18275 at SEQ ID NO: 1537
MLESLVSLESMSLSSMDVSVLERLKWLQQQQQQVLSTTNASPELLQFHGTNNDELLQNTFSHFQMLRSGFGPNYSMGFGPSHEAMDGCISITNSCQMDQADTVGVMLKNSEENITISLKNKRKSEVKTREEEKTEKKIKVEAETELNMKVKSNLSNTEASSETSKQKSKAASENQKLDYIHVRARRGQATDRHSLAERARREKISKKMKYLQDLVPGCNKVTGRAGMLDEIINYVQSLQRQVEFLSMKLAVLNPELELAMEDLSVKQFQAYFTNLPVVVASKPSLMVDAPLFPLDQQGSLDLSVINPNQATTIEAPSASWETQSQSLYNTSSLGFQY

SEQ ID NO: 1544 - DNA, 1466 bp, Glycine max
  misc_feature (1)..(1466): Ceres CLONE ID no.1359070
  misc_feature (1)..(1466): Encodes the peptide sequence at SEQ ID NO 1545
aacaacatttcactcctaattctccttcacttgacaaaagcttcgtgtgtatccacctctgtctttcctttcctctaaagtattcttttacaatatataactgtaactacttatttcctaagaattataacttacgtaaaacatgttgggctatgcgaacccgtcggggaatctggctgtggatggagacatgacagtgttggaaagacagagggcgaggatgaagtggcaagaagagcaagagtacttttctggaaacagcttcaacggtgttttttcttcttcttcttctctgcacgttccagattccattatggtggctgctgactccggttgtgcacttgctgaggtcgtggctcaggctcagcctcgctcaatcaataagccatctgctgctcctgggcttcatgccaattcttcttctatttcaaggacttttagttgtccacctgctctggtggaccccgagcccaagcccactgactcctcaattgggaaagacagtttcaagaagaggaaaactgacaagcctcacaatcccaaggttgttgcagaaaatgagaacaaagacaagaggatcaaagtcggcgctgatgatggagaatccaaaatcaccaagtgtaacacaataaacacaaataccaacaacaaagaaacttgcacagatacttcaaattcaaagcaaaattcaaaagcctccgaaaaacctgattacattcatgtccgagcacgtcggggccaagccaccgatagtcatagcttagccgaaagagttagaagggaaaaaattagtgagagaatgaactatttgcaagatttagtacccggttgcaacaaagtcacgggaaaagctggaatgcttgatgaaatcatcaactatgttcaatctcttcaacgacaagttgagtttctctcaatgaaattagctgctgtgaacccaaggcttgacttcagtatggatgatctatttgacaaagatgtgtttcctacttgtgctgcaaattttccaaacattggaatgtcatcaacatcatcagacattactaaccctgcctatcttccgtttaattcaccgcagcaaatttttcaatatgatggattagacacggggattaacccttctgatgtggggcttagaaggaccataagtgcccccgtatcaatgcctgaaacatatcttcaatcgtcctgtttcacacaaatgctaccctcctcaacatgggaaggtgatttccaaaacctttgcaattttgatgttgatcaagcacgagccacatctttcccttctcagctgttatcaggtctggttgaagctggcaatctaaagatggagatgtagactagagcttctatttcctactgcaacttatcaagattctttttgttttattttcaagtacatagcatatataaattgtttgtaactgctccataatataaataaaatttattaattaatacctgtc

SEQ ID NO: 1545 - protein, 398 aa, Glycine max
  misc_feature (1)..(398): Ceres CLONE ID no.1359070
  misc_feature (1)..(398): Bit score of 880.4 for HMM based on sequences of FIGURE 53.
  misc_feature (201)..(251): Pfam Name: HLH Pfam Description: Helix-loop-helix DNA-binding domain
  misc_feature (1)..(398): Functional Homolog Of Ceres SEEDLINE ID no. ME18275 at SEQ ID NO: 1537
MLGYANPSGNLAVDGDMTVLERQRARMKWQEEQEYFSGNSFNGVFSSSSSLHVPDSIMVAADSGCALAEVVAQAQPRSINKPSAAPGLHANSSSISRTFSCPPALVDPEPKPTDSSIGKDSFKKRKTDKPHNPKVVAENENKDKRIKVGADDGESKITKCNTINTNTNNKETCTDTSNSKQNSKASEKPDYIHVRARRGQATDSHSLAERVRREKISERMNYLQDLVPGCNKVTGKAGMLDEIINYVQSLQRQVEFLSMKLAAVNPRLDFSMDDLFDKDVFPTCAANFPNIGMSSTSSDITNPAYLPFNSPQQIFQYDGLDTGINPSDVGLRRTISAPVSMPETYLQSSCFTQMLPSSTWEGDFQNLCNFDVDQARATSFPSQLLSGLVEAGNLKMEM

SEQ ID NO: 1546 - DNA, 1466 bp, Glycine max
  misc_feature (1)..(1466): Ceres CLONE ID no.479774
  misc_feature (1)..(1466): Encodes the peptide sequence at SEQ ID NO 1547
gaacaacatttcactcccactactcctaaatcctaattctccttcatttcctaaaagcttcgtgtgttgggcatgacggtgtattggtcctactttccttttctctaaagtattcctctgtttgaacacgaagctataagcctacaactataattgttgctagttattcactgataattactataattaacgtaaaacatgttgcactgcgccaacacgtcggggaatctggctgtggctggggacatgacagtgttggaaagacagagggcgaggatgaagtggcaagaagagcaagggtacttttctggcaacagcttcaacggtgttttttcttcttcttctctgcacgttcatgattccattatggtggctgctgactccggttgtgcactcgctgaggtcgtggctcaggcccaggctcgctcaaccaattcttcttcaatttcaaggacttttagttgtccacctgctctggtggagcccgagtccgagtccaagcccaagcccaagcccaccgactcctctgttgggaaagacggtttcaagaagaggaaacctgacaagcctcaccatccgaaggttgttgcagaaaatgataacaaagacaagaggatcaaattcggctctgatgatggagaatccaaaatcaccaagagtaacacaacaaacacaaataccaacaacaacaaagaaacttgcgcagagacttcaaattccaaggcctccgaaaagcctgattacattcatgtccgagcacgtcgtggccaagccaccgatagtcatagcttagccgaaagagttagaagggaaaaaattagtgagagaatgaagtatttgcaagatttagtgcccggttgcaacaaagtcacgggaaaagctggaatgcttgatgaaatcatcaactatgttcaatctcttcaacgacaagttgagtttctctcaatgaaattagctgctgtgaacccaaggcttgacttgagtattgatgatctatttgacaaagatgttttttctacttgtgctacaaattttccaaacataggaatttcatcaacatcagacatttctaaccctgcctatcttcagtttaattccccacaacaaattttttcatatgatggattagacccatccgatatggggctcagaaggaccataagtgctcctgtatcaatgcctgaaacatatcttcaatcgtcctgtttcacacaaatgctaccctcctcaacatgggaaggtgatttccaaaacctttgcaattttgattttgatcaagcacgggctacatctttcccttctcagctgttatcaggtctggttgaagctggcaatctaaagatggagatgtagactagagcttctatttccttctgcaacttatcaagattctttttgttttgttttcaagtacatagcatatataaattgtttgtaactgctccataatataaataaaatttatt

SEQ ID NO: 1547 - protein, 384 aa, Glycine max
  misc_feature (1)..(384): Ceres CLONE ID no.479774
  misc_feature (1)..(384): Bit score of 764.3 for HMM based on sequences of FIGURE 53.
  misc_feature (192)..(242): Pfam Name: HLH Pfam Description: Helix-loop-helix DNA-binding domain
  misc_feature (1)..(384): Functional Homolog Of Ceres SEEDLINE ID no. ME18275 at SEQ ID NO: 1537
MLHCANTSGNLAVAGDMTVLERQRARMKWQEEQGYFSGNSFNGVFSSSSLHVHDSIMVAADSGCALAEVVAQAQARSTNSSSISRTFSCPPALVEPESESKPKPKPTDSSVGKDGFKKRKPDKPHHPKVVAENDNKDKRIKFGSDDGESKITKSNTTNTNTNNNKETCAETSNSKASEKPDYIHVRARRGQATDSHSLAERVRREKISERMKYLQDLVPGCNKVTGKAGMLDEIINYVQSLQRQVEFLSMKLAAVNPRLDLSIDDLFDKDVFSTCATNFPNIGISSTSDISNPAYLQFNSPQQIFSYDGLDPSDMGLRRTISAPVSMPETYLQSSCFTQMLPSSTWEGDFQNLCNFDFDQARATSFPSQLLSGLVEAGNLKMEM

SEQ ID NO: 1548 - protein, 344 aa, Medicago truncatula
  misc_feature (1)..(344): Public GI ID no.92880913
  misc_feature (1)..(344): Bit score of 741.3 for HMM based on sequences of FIGURE 53.
  misc_feature (150)..(200): Pfam Name: HLH Pfam Description: Helix-loop-helix DNA-binding domain
  misc_feature (1)..(344): Functional Homolog Of Ceres SEEDLINE ID no. ME18275 at SEQ ID NO: 1537
MLHCLNTSGNLVGGIISDMTVLERQRARKKFQHEHEQDQQFFMVGCDSALGEVVANSMKPGDLGFENVEETVKKRKADHKVDMKSKDKRIKVSVEEGESKITEQIKGNKNTKLKNRENCDDVGSKENSKGSEIQNHKPDYIHVRARRGQATDSHSLAERVRREKISERMKYLQDLVPGCNKIAGKAGMLDEIINYVQSLQRQVEFLSMKLAAVNPRLDFNIDELFAKEVFTQNFQMMQSEMSNPAYLQFNSAQQQVSCCGGLINNMGILPPEIGVRRNINAPASASLPEIFLDPSCFTHILPSSTWEGDFQNLHSVDFDQGRSTSFPSQPFTGMIEASNLKMEM

SEQ ID NO: 1549 - DNA, 2004 bp, Triticum aestivum
  misc_feature (1)..(2004): Ceres CLONE ID no.932449
  misc_feature (1)..(2004): Encodes the peptide sequence at SEQ ID NO 1550
aagaagaaccagtagtagtactagcagtgtagtcctacaaatgccacaagcctttgcctccacactccctctagctatgtaagcatggtctatgcgtctccctcttttcctagctcatcttcttccctacgcctctcgccggcacacctagcgccacaatctgcagcggccgcccctccttttcttgccgtttctgtccatagtctcgctgccttaagagcttttgcccatcgcattgcccatacggccctgcccgaccagagcacttcgtcttctctcccggctgcctctcaggttctttcggccagcggaggaatccatttgctcagcttgttgttggagcaggagccatggacatgaacgagagcagcgagaaagggatggagggcaatgggtcctctggcccaggcggtggcatccccgtggagtggcagagccaattcagcggcggcggcttctcggcgcaccagcaccagcagcatccccacatgatggactccttcgggtccggcatgtggtcggcggcctcgcagcacggcgcggggttcctggcgccggtgcccgggttcctcccgccgcctggcctaggtggccatttcccggtggactcgggcttcatcgagcgcgccgcgcgatcgtcgtgcttcgtcggccccggcgccggtggcgggatgatgggcgctggcgccttcggtggggcgggcgatcagcagatgggcagcgctttcggggaggggtacttggatcatcgtaggaaggaaggcggggacaaggccgagccggagctcgcagggagcggcggcgtgccgagctcggaggcagccggcggagactgctcgtccaaagggtcggactccaagaagaggagaaggcccagcgaggtgatgggaggcgatcaggttcagtcttccaacgtggccgctgactccgcaaacgagagcgcccagagcaaagataaaggcgaggagagcagcccggcgacggggacgacgaccggcggcaagtccaaggggaagggtgccaaggagagctccgagaaggaagactacatccatgtccgagcccggcgcgggcaggctaccaacagccacagccttgccgaaaggctaagaagggagaagatcagtgagaggatgaagcttctacaggaccttgttcccggctgcagcaaggtcaccgggaaggcggtgatgctcgacgagatcatcaactacgttcagtccctgcaaagacaagttgagttcttatcgatgaagctggcgacagtaaacccgaggcttgacctcaacatagaagggcttctctcaaaggatcttcttcgcttccctggggtgtcttcgtcgtcgatggggttctctccggagatgatgcacccgcagctgcagctgtcgcagccggggctgatgcagggaggcgccgccgccatggcaaactcggacgtgttcagaagaatcatgcaagcgcaactaggagcaaaagatggatcccattcacagatggcccacgcattgaatggcccgttcagcgatcacgttgcgcagatggcgtacccgtccatgggctcctcgcactcccactcgcaggacctcagcatcaggccgtcccaggacgcctaccaaatgtgacgggagatgccattgccagccccgcgcgtgacctgaggctgagagccacccgacccgagtttgtttgtccagctagccggcctagctatcaatcatctgaccgccaacgggacgggctgcagaggccacatgcacgagcaatatgaccactgaagctgctgctgctgctgcccgtgcgtgcgtgcgtgcagtgcacagctggagcctttaactcctcccgtgcgccgtgcgtgcgtggccgtgtgtaaatcgatccatggatcatggatggatcggtcgtgttcttgttgtattcggggctggaactggaaaaaggggtcgagcagccccacggggtgaaatgaaatcctgtggcgtggaatggacgggaattgtgctc

SEQ ID NO: 1550 - protein, 424 aa, Triticum aestivum
  misc_feature (1)..(424): Ceres CLONE ID no.932449
  misc_feature (1)..(424): Bit score of 909.4 for HMM based on sequences of FIGURE 53.
  misc_feature (243)..(293): Pfam Name: HLH Pfam Description: Helix-loop-helix DNA-binding domain
  misc_feature (1)..(424): Functional Homolog Of Ceres SEEDLINE ID no. ME18275 at SEQ ID NO: 1537
MDMNESSEKGMEGNGSSGPGGGIPVEWQSQFSGGGFSAHQHQQHPHMMDSFGSGMWSAASQHGAGFLAPVPGFLPPPGLGGHFPVDSGFIERAARSSCFVGPGAGGGMMGAGAFGGAGDQQMGSAFGEGYLDHRRKEGGDKAEPELAGSGGVPSSEAAGGDCSSKGSDSKKRRRPSEVMGGDQVQSSNVAADSANESAQSKDKGEESSPATGTTTGGKSKGKGAKESSEKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVSSSSMGFSPEMMHPQLQLSQPGLMQGGAAAMANSDVFRRIMQAQLGAKDGSHSQMAHALNGPFSDHVAQMAYPSMGSSHSHSQDLSIRPSQDAYQM

SEQ ID NO: 1551 - DNA, 1831 bp, Panicum virgatum
  misc_feature (1)..(1831): Ceres CLONE ID no.1788695
  misc_feature (1)..(1831): Encodes the peptide sequence at SEQ ID NO 1552
gcacttccagcttgctctattgctccctctccttctgtgagctctggtgatgcggaagtatttctccaagctttcacatttgttgttcattccaagattatgaagaaattacaggctgatcgataatcctctgtggaggcagcttcatcttttctatgtgcccctgaagatgatagtcctgtgactattactcatccaaaaagatttggtttgttcccaaaggctatggctatgtatgatgcacatcttctccagctgtaatacagttccagcaggcctttgtctggacggtggatcgttcttttgcccttcttttgatctgtcgatagggatagtggctgttcttgaagggactggctgcttttcatctctgataggattatcagttgcatgatattattttccctcaacctcaatcaaaccagctgaggggtatgtatatgtgaaataaaaggggattaaggaacgttggtgtttctggacaattggagatgtactcaggccagcaatctgatcagtgtcctagtgcaaatagtggcagagaattctccgaggcaaatcggaatactgtcacaatgcatcagaagatgggctataacagtggaccgtatggatttggaccttacaacatgggtttagaagaaagacccgggttgtatcaatcttcatctggtacattcagtcagaacatccaaatgagtgatgagcatagcgggggtgtgaagaagaggaaaggaatggatgattgcgtcgcgatgttgcaaaatgctggtgatcaacaaacagaaggttcttctcagccagaacggaattcattggaggggaacagaaagatttcgcccaaaatgcaaagcaaggaagattcttctgatggtgatggtactaaagaggattatgttcatgtccgggcaaaacaaggccaagccaccaacagccacagccttgcagaaagactgaggagaaaaaagataagtgagagaatgaaactgcttcaagatcttgttcctggatgcagtaagatcactggcaaggcagtcatgcttgatgagattatcaactatgtgcagtcattgcaacgacaggtcgagttcttgtcaatgaaactagcaactgtcaacccagagctgggctttgacattgagcagattctatccaaacaaatgatgctttcacaagacagacattttgctttctatggagtggatccaggatcaagcagccttgcttctcagtttagccaaggaatcatgcagccacaaatgatgtgcaacatttccaatcctgctgatgttttgcagggaacaattcatgatgtctcaacaatgaaccagatacctgcaatgtgggaaggacttcaaaacctgccgcagatgaacttcaaccctggtgtggcagccgatagcagcgccaacaactctggttccatgaagatagaacagtgagctgccaatattgctcccaaattgttctgtgaatcactgaatcaccgtaaagcgcttgcggaatgaagcttttttgtatagctggaggcctaaccattcattgctggtttccttctgttgctccccatactatggctcatcgtttatggtatggatgaggatcatgtatagcaggagctgaagaaaaattgattccactgtaaatttctgttgagctttggcctgtggaaattcggatggaaacccagtatcatccatgaactccaagggcagaagcttgttgggaccaagtgctgaatgctgatgggcctaaacgtagtactagtagaatgaaatcgtaggtacaaaaatgcagagtttgaagactaatgcattgtcagaaattccat

SEQ ID NO: 1552 - protein, 316 aa, Panicum virgatum
  misc_feature (1)..(316): Ceres CLONE ID no.1788695
  misc_feature (1)..(316): Bit score of 604.0 for HMM based on sequences of FIGURE 53.
  misc_feature (145)..(195): Pfam Name: HLH Pfam Description: Helix-loop-helix DNA-binding domain
  misc_feature (1)..(316): Functional Homolog Of Ceres SEEDLINE ID no. ME18275 at SEQ ID NO: 1537
MYSGQQSDQCPSANSGREFSEANRNTVTMHQKMGYNSGPYGFGPYNMGLEERPGLYQSSSGTFSQNIQMSDEHSGGVKKRKGMDDCVAMLQNAGDQQTEGSSQPERNSLEGNRKISPKMQSKEDSSDGDGTKEDYVHVRAKQGQATNSHSLAERLRRKKISERMKLLQDLVPGCSKITGKAVMLDEIINYVQSLQRQVEFLSMKLATVNPELGFDIEQILSKQMMLSQDRHFAFYGVDPGSSSLASQFSQGIMQPQMMCNISNPADVLQGTIHDVSTMNQIPAMWEGLQNLPQMNFNPGVAADSSANNSGSMKIEQ

SEQ ID NO: 1553 - DNA, 1786 bp, Arabidopsis thaliana
  misc_feature (1)..(1786): Ceres SEEDLINE ID no.ME18924
  misc_feature (1)..(1786): Ceres ANNOT ID no.869192
  misc_feature (1)..(1786): Genomic Sequence
  misc_feature (1)..(1786): Inplanta Sequence
  misc_feature (1)..(1786): Encodes the peptide sequence at SEQ ID NO. 1554
atggctgaagaacctactactaccactctcgttacaccggaaaagctaccttctccgagcctcacgccttctgaagtatctgaatctactcaagatgccctaccgacagagacagaaactctggagaaagtgactgagactaatccaccggaaactgcagataccaccaccaagccagaagaagaaaccgcggcagagcatcatccaccgacagtgacggaaacagaaactgcatcgacggagaaacaagaggttaaagacgaagcatcgcagaaagaagtagctgaagagaaaaagagtatgattccacagaatcttggttcattcaaagaagaaagcagcaaactttctgatctatctaattccgagaagaaatcactcgatgaactaaaacatctagttcgagaagctctagacaatcaccaattcaccaacacaccagaagaagtcaagatttgggggattccattacttgaagacgatagaagcgacgtcgttttgttaaaattcctaagagctagggagttcaaggtgaaagattcgtttgctatgctcaagaacacaatcaagtggagaaaggagttcaagatcgatgaattggtcgaggaagatcttgtggatgatcttgacaaggttgtgtttatgcatggacatgaccgagaaggtcaccctgtttgttacaatgtctatggtgagtttcagaacaaggagctttataataagacgttttctgatgaggaaaagaggaaacatttcttgaggactaggattcagttcttggagaggagtataaggaagctagattttagctctggtggggtttctactatttttcaggttaatgatatgaagaattctccggggttagggaagaaagagcttagatcagctactaagcaagctgttgagttgcttcaggacaattaccctgagtttgtcttcaaacaggtaacattttcctgtggacctttagctctaaactagagtagatatctgttttaggtttcttagcattaagacatgttcgtgttgaatgttttgttgatcaatattttcaggcttttatcaatgttccttggtggtaccttgtgttttatactgtgattggtccgttcatgacaccaagatcaaagagcaagcttgtgtttgctggtccttcgcgttcagctgaaaccctattcaagtaacattgagtccgtttgttttgtttcttgaaaccatttatgtttagtctcttaactctgtttgaaaaatgtggactatagatacatatcacccgagcaagttccagtacaatatggtggattgagtgttgatccttgcgactgcaatccagacttttcgttggaagattcagcctctgagatcactgttaagcccggaacaaaacaaactgttgagatcataatctatgaggttagagcattcacatatttaactctgtcattatgtgaaaggtgacatccaaggttggttagtcatgatatttattacaactctatgaatgtttgatttcaagttttttttgttggcgtagaaatgtgaacttgtgtgggagataagggtaactggatgggaagtgagctacaaggctgaatttgtgccggaagagaaagatgcttacacggtggttatacaaaaaccgaggaagatgagaccatccgatgaaccggtgttaacccatagcttcaaagtgaatgagcttggcaaggttttactcacagtagacaacccaacctctaagaagaagaagctcgtttacaggttcaatgtcaaacctctctaa

SEQ ID NO: 1554 - protein, 490 aa, Arabidopsis thaliana
  misc_feature (1)..(490): Ceres SEEDLINE ID no.ME18924
  misc_feature (1)..(490): Ceres ANNOT ID no.869192
  misc_feature (1)..(490): Bit score of 1041.5 for HMM based on sequences of FIGURE 54.
  misc_feature (161)..(200): Pfam Name: CRAL_TRIO_N Pfam Description: CRAL/TRIO, N-terminus
  misc_feature (214)..(381): Pfam Name: CRAL_TRIO Pfam Description: CRAL/TRIO domain
  misc_feature (406)..(487): Pfam Name: EMP24_GP25L Pfam Description: emp24/gp25L/p24 family/GOLD
MAEEPTTTTLVTPEKLPSPSLTPSEVSESTQDALPTETETLEKVTETNPPETADTTTKPEEETAAEHHPPTVTETETASTEKQEVKDEASQKEVAEEKKSMIPQNLGSFKEESSKLSDLSNSEKKSLDELKHLVREALDNHQFTNTPEEVKIWGIPLLEDDRSDVVLLKFLRAREFKVKDSFAMLKNTIKWRKEFKIDELVEEDLVDDLDKVVFMHGHDREGHPVCYNVYGEFQNKELYNKTFSDEEKRKHFLRTRIQFLERSIRKLDFSSGGVSTIFQVNDMKNSPGLGKKELRSATKQAVELLQDNYPEFVFKQAFINVPWWYLVFYTVIGPFMTPRSKSKLVFAGPSRSAETLFKYISPEQVPVQYGGLSVDPCDCNPDFSLEDSASEITVKPGTKQTVEIIIYEKCELVWEIRVTGWEVSYKAEFVPEEKDAYTVVIQKPRKMRPSDEPVLTHSFKVNELGKVLLTVDNPTSKKKKLVYRFNVKPL

SEQ ID NO: 1555 - protein, 604 aa, Cucurbita pepo
  misc_feature (1)..(604): Public GI ID no.82469976
  misc_feature (1)..(604): Bit score of 1338.8 for HMM based on sequences of FIGURE 54.
  misc_feature (277)..(314): Pfam Name: CRAL_TRIO_N Pfam Description: CRAL/TRIO, N-terminus
  misc_feature (328)..(491): Pfam Name: CRAL_TRIO Pfam Description: CRAL/TRIO domain
  misc_feature (518)..(599): Pfam Name: EMP24_GP25L Pfam Description: emp24/gp25L/p24 family/GOLD
  misc_feature (1)..(604): Functional Homolog Of Ceres SEEDLINE ID no. ME18924 at SEQ ID NO: 1554
MAEETQKPAAAEAPTSTQPVPEEPAVVPPPVPAAEIQLPDSAPAPPQPEASPAKPDSVAEVAEDEKPKASEEFEKISQSVSFKEESNVVGELPESQRKALADLKVLIQEALNKHEFTAPPAPLPPKEEEKPAEEKKEDTEKPAEQPQIDEPAKEPVIEEPPKTEAEPEPVTETVTVKVEETITPHPAPETSLAPEADEKAAEPSTVVEKVAVIDEDGAKTVEAIEESVVAVSTPPPEESAPSKEEAEVEVEAAEAVPPPPPEEVFIWGIPLLGDERSDVILLKFLRARDFKVKDAFTMIKNTVRWRKQFDIEALLDEDLGNQWDKVVFSHGVDREGHPVCYNVFGEFENKDLYQITFSDDEKSLKFLRWRVQFLEKSIRKLDFSPNGISTIVQVNDLKNSPGLTKWELRNATKRALQLFQDNYPEFAAKQVFINVPWWYLAVNRMISPFFTQRTKSKFVFAGPSKTAETLFKYVTPEQVPVQYGGLSREGEQEFSIDDPVTEVAIKAATKHTVEFPISEPSLLVWELRVVGWDVSYGAEFLPSAEGGYTVIVQKTAKLGPADEPVISNSYRVGEAGKIVLTIDNLSSKKKKILLYRSKTKPISD

SEQ ID NO: 1556 - DNA, 1710 bp, Populus balsamifera subsp. trichocarpa
  misc_feature (1)..(1710): Ceres ANNOT ID no.1486825
  misc_feature (1)..(1710): Encodes the peptide sequence at SEQ ID NO 1557
atggccgaagaatcctctccaccaccaccagtacttgagcaagctccaccttctccagccatagagaaagataaagaagacttgccacccccagcaccagttgaggaagctgaatcacaagctgtacaggagaaggaagaggtgccaccacaaccagctgcagcagaacaaaaggagtctagatcatcatccttggcggcgatgattgagaaagaagagtcattttcaccaccaccacaaccacttttttctcctgaggagaaaaccgaggtaactgaaaaatcagtagctactaaagaagaggttgctgttgttcctgacactgggaaagagaaaaaagttcctctaactttggtttctttcaaggaagagagtaacgcactggctgatctctctcatattgagagaagggctttagaagaactgaaacagttagttcaagaagctctcagctctcaccagtttagcagtgctccaccaaaaaaagaagagaaacaaagtgtcagtgttattcaagaaacttcaaaaactgaagcacccgttccagattctgatgttggtactgatatgaaaccatcagcagagaatcaagaatcgaaagttgaaaaaaccccagaaaaagaatcgcaagaagtggcgaaagaagagcaaaaggttgcatcttcttcaccagaggaagtccctatatgggggattcctctcttgaaagatgatagaagtgatgtggttctcttgaaattcttgagggcaagggattttaaggtaagagatgcatttgtaatgatcaagaacacaattcaatggaggagggacttcaaaattgatgagcttgttgatgaagatctaggtgatgatttggagaaagttgtgtttatgcatggttatgatagggaagggcatcctgtgtgttacaacgtatatggtgagtttcaaaataaagaattgtatcagaagacattctccgatgaggagaaaagattgaagtttctgaggtggcggattcagttcttggagaggagtattaggaagcttgatttcagtcctggtggtatttctaccatctttcaggttaatgatctgaagaactctccaggacctggaaagagagagcttaggttggctactaaacaggctctcctttcgcttcaggacaattaccctgagtttgttgccaaacaggtgtttatcaatgtcccttggtggtatcttgcattttatacagtgatgagtccattcatgacgcaaaggaccaaaagcaaatttgtttttgcaggcccatcaaattctgctgagacacttttcaaatatatatctcctgagcaagtgcctattcagtatggtggcttgtgcgtggatttctgtgactgcaaccctgaatttactattgctgatcctgctactgatataactgtaaaaccagcaaccaagcaaactgtggaaattataatttacgagaaatgtatccttgtttgggagttgcgagttgtcggatgggaggtgagttacagcgctgagttcatgcccgaagctaaagatgcatacacgattataataacgaaacccacaaaaatgtccccaactgatgagccagtggtgtctaacagcttcaaagttggtgaactggggaaaatattgctcacagttgacaaccccacctcaaagaagaagaaacttctttacaggttcaagatcaaccccttctcagattga

SEQ ID NO: 1557 - protein, 569 aa, Populus balsamifera subsp. trichocarpa
  misc_feature (1)..(569): Ceres ANNOT ID no.1486825
  misc_feature (1)..(569): Bit score of 999.3 for HMM based on sequences of FIGURE 54.
  misc_feature (235)..(277): Pfam Name: CRAL_TRIO_N Pfam Description: CRAL/TRIO, N-terminus
  misc_feature (291)..(475): Pfam Name: CRAL_TRIO Pfam Description: CRAL/TRIO domain
  misc_feature (483)..(564): Pfam Name: EMP24_GP25L Pfam Description: emp24/gp25L/p24 family/GOLD
  misc_feature (1)..(569): Functional Homolog Of Ceres SEEDLINE ID no. ME18924 at SEQ ID NO: 1554
MAEESSPPPPVLEQAPPSPAIEKDKEDLPPPAPVEEAESQAVQEKEEVPPQPAAAEQKESRSSSLAAMIEKEESFSPPPQPLFSPEEKTEVTEKSVATKEEVAVVPDTGKEKKVPLTLVSFKEESNALADLSHIERRALEELKQLVQEALSSHQFSSAPPKKEEKQSVSVIQETSKTEAPVPDSDVGTDMKPSAENQESKVEKTPEKESQEVAKEEQKVASSSPEEVPIWGIPLLKDDRSDVVLLKFLRARDFKVRDAFVMIKNTIQWRRDFKIDELVDEDLGDDLEKVVFMHGYDREGHPVCYNVYGEFQNKELYQKTFSDEEKRLKFLRWRIQFLERSIRKLDFSPGGISTIFQVNDLKNSPGPGKRELRLATKQALLSLQDNYPEFVAKQVFINVPWWYLAFYTVMSPFMTQRTKSKFVFAGPSNSAETLFKYISPEQVPIQYGGLCVDFCDCNPEFTIADPATDITVKPATKQTVEIIIYEKCILVWELRVVGWEVSYSAEFMPEAKDAYTIIITKPTKMSPTDEPVVSNSFKVGELGKILLTVDNPTSKKKKLLYRFKINPFSD

SEQ ID NO: 1558 - DNA, 1788 bp, Populus balsamifera subsp. trichocarpa
  misc_feature (1)..(1788): Ceres ANNOT ID no.1479687
  misc_feature (1)..(1788): Encodes the peptide sequence at SEQ ID NO 1559
atggcccaagaatctactccaccgcccgtaacaccgccgccgccgccatcacttgagcaagctccaccttctccagccatggtgaaagataaaggagacttgccaccagcaccagcaccagcaccagcaccagcaccggaaccagctgatgaagctgaatcaccgggagcaaaggggaaggagttacaggggccaacactaccaccgccaccggaaggtgagcaaaaggactctagatcatcatcattggcggcgatgatggggaaagaagaatcagtttcatcaccacaaccacctcctgaggagaaaactgaggtaactgaaaagtcagcagctactaaagaagaggttgttgctgttgccgttgccgacactgggaaggagaagcaagtacaagagcataaagttcctcaaactttagtttcttttaaggaagagagtaacctagtgtctgatctctctggtattgagagaaaagctttagaagaactgaagcagttggttcaagaagctctcaatactcaccagtttagcactgcaccaaaaaaagacgagagacaaagtgttattgtcacccaagaagcacaaacaactcaagaaacctccaaaaatgaagcatcagcatcagaatctgatgttagtactgagattaaaccaccagcagagactcaggaatcaaaagttgaagaaaccccagaaaaagaatcacaagaagtggcaaaagaagagcaaaaggctgcaccttcaccagaggagatcactatatgggggatccctcttctgaaagatgatagaagtgatgtggttctcttgaagttcttgagggcaagggattttaaggtaagcgatgcatttgtaatgatcaagaacacaattcaatggaggagagactttaaaattgatgagcttgttgatgaagatctaggtgatgatttggagaaagttgtgtttatgcatggttatgacagggaagggcatcctgtgtgttataatgtgtatggggagtttcaaaataaagagttgtatcagaagacattctctgatgaggagaaaagattgaagtttttgaggtggcggattcagttcttggagaggagtattaggaagcttgattttagtcctagtggtatttccaccgtcttccaggttaatgatctcaagaactctccaggacccggaaagagagagcttaggttggctactaaacaggctctcctattgcttcaggacaattaccctgagtttgtggccaaacaggtgttcatcaatgtcccttggtggtatcttgcattttatacaatgatcagtccatttatgacacaaagaaccaaaagcaaatttgtattcgcaggcccatcaaaatctgctgagacacttttcaaatatgtatctcctgagcaagttcctattcagtatggtggcttgagcgtggatttctgcgactgcaaccccgaatttacttttgctgatcctgctacggagataactgtaaaaccagcaaccaagcaaactgtggaaattataatttatgagaaatgtttcattgtttgggagttgcgagttgttggatgggaggtgagttatagtgctgaattcgtgcccgattctaaagatgcatacacaattataatgacaaaacccacaaaaatgaccccaaccaatgagccagtggtgtctaacagcttcaaagttggtgagctgggaaaaatattgctcacagttgacaactctacctcaaagaagaagaaacttctctacaggttcaagataaaccccttctcagattga

SEQ ID NO: 1559 - protein, 569 aa, Populus balsamifera subsp. trichocarpa
  misc_feature (1)..(569): Ceres ANNOT ID no.1479687
  misc_feature (1)..(569): Bit score of 1015.7 for HMM based on sequences of FIGURE 54.
  misc_feature (235)..(277): Pfam Name: CRAL_TRIO_N Pfam Description: CRAL/TRIO, N-terminus
  misc_feature (291)..(475): Pfam Name: CRAL_TRIO Pfam Description: CRAL/TRIO domain
  misc_feature (483)..(564): Pfam Name: EMP24_GP25L Pfam Description: emp24/gp25L/p24 family/GOLD
  misc_feature (1)..(569): Functional Homolog Of Ceres SEEDLINE ID no. ME18924 at SEQ ID NO: 1554
MVKDKGDLPPAPAPAPAPAPEPADEAESPGAKGKELQGPTLPPPPEGEQKDSRSSSLAAMMGKEESVSSPQPPPEEKTEVTEKSAATKEEVVAVAVADTGKEKQVQEHKVPQTLVSFKEESNLVSDLSGIERKALEELKQLVQEALNTHQFSTAPKKDERQSVIVTQEAQTTQETSKNEASASESDVSTEIKPPAETQESKVEETPEKESQEVAKEEQKAAPSPEEITIWGIPLLKDDRSDVVLLKFLRARDFKVSDAFVMIKNTIQWRRDFKIDELVDEDLGDDLEKVVFMHGYDREGHPVCYNVYGEFQNKELYQKTFSDEEKRLKFLRWRIQFLERSIRKLDFSPSGISTVFQVNDLKNSPGPGKRELRLATKQALLLLQDNYPEFVAKQVFINVPWWYLAFYTMISPFMTQRTKSKFVFAGPSKSAETLFKYVSPEQVPIQYGGLSVDFCDCNPEFTFADPATEITVKPATKQTVEIIIYEKCFIVWELRVVGWEVSYSAEFVPDSKDAYTIIMTKPTKMTPTNEPVVSNSFKVGELGKILLTVDNSTSKKKKLLYRFKINPFSD

SEQ ID NO: 1560 - DNA, 1386 bp, Populus balsamifera subsp. trichocarpa
  misc_feature (1)..(1386): Ceres ANNOT ID no.1532284
  misc_feature (1)..(1386): Encodes the peptide sequence at SEQ ID NO 1561
atggcagaggtggcacaaaacgtgagtcaagaacaagtggtggtggtaactgatgttccacaagctgagaaaacaacaccagtgccaccaacaatgccagtggtggggaaagagctaccattgcccgtgcctgagactgaggaggtgccaatgaagccaaagcaggttgaggaggctgttgtggagactgaggatttgaaagctagtggaggtgatgatgagaagatgcctcagttggtttcttttaaggaagaaagtactaaagttgctgatcttcttgagtctgagaagaaagcacttcaagaatttaagaaacttgttcaggaagcacttaacaagcatgaatttatgacaccagaggaagtatcaatctggggcataacgcttcttgctgatgacagaagtgatgtgattctattgaaatttctcagagccagggatttcaaggtgaaagatgccttcaccatgctcaagaacacaattcgctggagaaaggagctcggcattgatgaattgcttgaacaagatttgggctgtgatgatttggggaaggtggtatttatgcatggtcttgacaaagagggacacccagtttgctacaatgtctacggggagttccaaaacaaggagctttacaagaattcattttctgatgaagagaagaggcagagattcttgaggtggagaattcaattcctggaaaggagtattaggaaattggatttcagtcctggtggagtctctaccattgttcaggttaatgacttgaaaaattctcctggaccagctaagagagagcttagacaagctactagacaggcacttcaattgcttcaagacaactatccagaatttgtggccaaacagatcttcatcaatgtgccctggtggtacctcacagtcaatagaatgataagtccatttttaactcagagaaccagaagcaagtttgtctttgctggtccttccaaatctgcagaaaccctcaccaggtacataactgctgagcaaataccagtgaagtatggaggactaagcaaagatggtgaattttgcacagctgatgctgttactgagattacagtgaaggcatcagcaaagcacactgtagaattcccagttactgagacatgccttctgacttgggaaatgagagttgtgggatgggatgtgagctatggcgccgaattcgtaccaaatgctgaggatagctacacagtgatcatccaaaaggctagaaaggttgctataactgaagaaccagtggttagcaacagttttaaagttggtgaacctggtaaagttgttctcaccattgacaataccacttccaagaagaagaagaagctcctctatcgcttgaaaaccaaaccttgctctgattaa

SEQ ID NO: 1561 - protein, 461 aa, Populus balsamifera subsp. trichocarpa
  misc_feature (1)..(461): Ceres ANNOT ID no.1532284
  misc_feature (1)..(461): Bit score of 1011.1 for HMM based on sequences of FIGURE 54.
  misc_feature (187)..(368): Pfam Name: CRAL_TRIO Pfam Description: CRAL/TRIO domain
  misc_feature (374)..(456): Pfam Name: EMP24_GP25L Pfam Description: emp24/gp25L/p24 family/GOLD
  misc_feature (94)..(172): Pfam Name: CRAL_TRIO_N Pfam Description: CRAL/TRIO, N-terminus
  misc_feature (1)..(461): Functional Homolog Of Ceres SEEDLINE ID no. ME18924 at SEQ ID NO: 1554
MAEVAQNVSQEQVVVVTDVPQAEKTTPVPPTMPVVGKELPLPVPETEEVPMKPKQVEEAVVETEDLKASGGDDEKMPQLVSFKEESTKVADLLESEKKALQEFKKLVQEALNKHEFMTPEEVSIWGITLLADDRSDVILLKFLRARDFKVKDAFTMLKNTIRWRKELGIDELLEQDLGCDDLGKVVFMHGLDKEGHPVCYNVYGEFQNKELYKNSFSDEEKRQRFLRWRIQFLERSIRKLDFSPGGVSTIVQVNDLKNSPGPAKRELRQATRQALQLLQDNYPEFVAKQIFINVPWWYLTVNRMISPFLTQRTRSKFVFAGPSKSAETLTRYITAEQIPVKYGGLSKDGEFCTADAVTEITVKASAKHTVEFPVTETCLLTWEMRVVGWDVSYGAEFVPNAEDSYTVIIQKARKVAITEEPVVSNSFKVGEPGKVVLTIDNTTSKKKKKLLYRLKTKPCSD

SEQ ID NO: 1562 - DNA, 1311 bp, Populus balsamifera subsp. trichocarpa
  misc_feature (1)..(1311): Ceres ANNOT ID no.1533704
  misc_feature (1)..(1311): Encodes the peptide sequence at SEQ ID NO 1563
atgagtcaagaacaagatgttgtggtggtaactgatgttccacaagctgagaaaacagctccagtgccaccaacaatgccagtggtggtggagaaagagccaccagtgccagtccctgagactgaagaggagccaatgaagccaaagcaggttgaggagggtgctgtagagactcaggtgttgaaacctagtggaggtgacgatgaaaagatgcctcagttggtttcttttaaggaggaaagtactaaagttgctgatcttcttgattctgagaagaaagcacttcaagaatttaagcagcttgttcaagaagcacttaacaaaagtgatgtgattctcttgaaatttctcagagccagagatttcaaggtgaaagatgcattcaccatgctcaagagcacaattcgctggagaaaggagtttggcattgatgaattgcttgaacaagatttaggctttgatgatttggggaaggtggtatttatgcatggtcttgataaagagggacacccagtgtgctataatgtctatggagaattccaaaacaaggaactttacaagaattcattttctgatgaggagaagaggcagagattcttaaggtggaggattcaattcctggaaaaaagtatcaggacattggatttcagtcccggtggaatttccacaattgttcaggttaatgacttgaaaaattctcctggaccagctaagagagagcttagacaagctactagacaggcacttcaattgcttcaagacaactatccagaatttgtggccaaacagatcttcatcaatgttccctggtggtacctaacagtaaatagaatgataagtccatttttaacccagaggaccagaagcaagtttgtctttgttggtccttccaaatctgccgaaacccttatcaggtacatagccgctgagcaaataccagtgaagtacggaggactaagcaaagatggtgaatttggctcagctgatgctgttactgagattaccgtgaagccagcagcaaagcacactgtagaattcccagttactgagacatgccttttaacatgggaagtgagagttgcgggatgggatgtgagctatagtgcagaatttgtaccaagtgctgaagatagctacacagtgatcatccaaaaggctagaaaggttgctgcaactgaagaaccagtggtttgcaacagtttcaaaattggtgaacctggtaaagttgttctcaccattgacaactccacatccaagaagaagaagaagctcctctatcgcttgaaaaccaagcccgcttcttctgattaa

SEQ ID NO: 1563 - protein, 436 aa, Populus balsamifera subsp. trichocarpa
  misc_feature (1)..(436): Ceres ANNOT ID no.1533704
  misc_feature (1)..(436): Bit score of 1003.5 for HMM based on sequences of FIGURE 54.
  misc_feature (161)..(321): Pfam Name: CRAL_TRIO Pfam Description: CRAL/TRIO domain
  misc_feature (348)..(430): Pfam Name: EMP24_GP25L Pfam Description: emp24/gp25L/p24 family/GOLD
  misc_feature (91)..(146): Pfam Name: CRAL_TRIO_N Pfam Description: CRAL/TRIO, N-terminus
  misc_feature (1)..(436): Functional Homolog Of Ceres SEEDLINE ID no. ME18924 at SEQ ID NO: 1554
MSQEQDVVVVTDVPQAEKTAPVPPTMPVVVEKEPPVPVPETEEEPMKPKQVEEGAVETQVLKPSGGDDEKMPQLVSFKEESTKVADLLDSEKKALQEFKQLVQEALNKSDVILLKFLRARDFKVKDAFTMLKSTIRWRKEFGIDELLEQDLGFDDLGKVVFMHGLDKEGHPVCYNVYGEFQNKELYKNSFSDEEKRQRFLRWRIQFLEKSIRTLDFSPGGISTIVQVNDLKNSPGPAKRELRQATRQALQLLQDNYPEFVAKQIFINVPWWYLTVNRMISPFLTQRTRSKFVFVGPSKSAETLIRYIAAEQIPVKYGGLSKDGEFGSADAVTEITVKPAAKHTVEFPVTETCLLTWEVRVAGWDVSYSAEFVPSAEDSYTVIIQKARKVAATEEPVVCNSFKIGEPGKVVLTIDNSTSKKKKKLLYRLKTKPASSD

SEQ ID NO: 1564 - DNA, 1510 bp, Glycine max
  misc_feature (1)..(1510): Ceres CLONE ID no.524404
  misc_feature (1)..(1510): Encodes the peptide sequence at SEQ ID NO 1565
tctctagctagctttcttctccactctctcaaatggcccaaaatgattccaaccctactccgcctccggaaccccatgtagcggcggaacccattactgaggatttggtccaagacaaagaagaagaggatgatagtagtaagattgttattccagtcccagagagcgagtccttgtcattgaaggaggatagcaatagggtttctgattccgagaaaaatgccattgatgagctgaagaagctcctgaaagaggaattagaggacgaggaggtttccatctggggcgtccctctctttaaggatgacaggactgacgtcattctcctcaagtttctcagagctcgtgagctcaaagtgaaggacgcccttgtcatgtttcaaaacactctccgatggaggaaggacttcaacatcgacgcccttctggatgaagatctgggcgaccacttggagaaggttgtcttcatgcacggacacggcagagagggccatcccgtctgttacaacgtctacggcgagttccagaacaaggacctctaccacaaggccttctcctctcaggataatcgaaacaagtttctccgatggcgtattcagttgttggagcgcagtattcggcacctcgacttcactccttcctccggcatcaacaccattttccaagtcaatgacctcaaaaactcccctggccctgctaaacgtgagcttcgccttgccaccaaacaagctttgcagttgcttcaggacaactatcccgaatttgttgccaaacaggtttttatcaacgtcccatggtggtatcttgctttctataccatgatcaatcccttcttgacttcgaggaccaaaagcaaatttgtctttgctggaccatccaagtcccccgatactcttttcaagtatatttttcctgagcaagtgcccgttcagtatggtggcctcagtgtagatttctgtgactgcaaccccgatttcactatgtctgatcctgtcaccgaaattcctataaagcctaccactaagcaaactgtggaaattgctatttatgagaagtgcattattgtttgggagctgcgcgtggtgggctgggaggttagctacaatgctgaattcaagcctgatgttgaagatgcatatacggttatcatacagaaggccacaaagatgtcccccaccgatgaaccagttgtttccaatagctttaaagttgttgaactgggaaaattgttgctcaccatagacaatcctaccttgaaaaaaaagaggcttctttacaggttcaagatcaaaccctactctgattgagagaaaataacctctggtggtggttttgggtacatgaaggaaattgaacttgaagagtaagaaatatgcatgtcatcatttgttcggtccatttttcatctatagttttggtcgtgagttgtttgcagattgtctttctctgtctttgttgtttgttgtgttgtatgtaacactttattgctagtctaaattgttcttttatt

SEQ ID NO: 1565 - protein, 424 aa, Glycine max
  misc_feature (1)..(424): Ceres CLONE ID no.524404
  misc_feature (1)..(424): Bit score of 957.1 for HMM based on sequences of FIGURE 54.
  misc_feature (145)..(313): Pfam Name: CRAL_TRIO Pfam Description: CRAL/TRIO domain
  misc_feature (338)..(419): Pfam Name: EMP24_GP25L Pfam Description: emp24/gp25L/p24 family/GOLD
  misc_feature (59)..(131): Pfam Name: CRAL_TRIO_N Pfam Description: CRAL/TRIO, N-terminus
  misc_feature (1)..(424): Functional Homolog Of Ceres SEEDLINE ID no. ME18924 at SEQ ID NO: 1554
MAQNDSNPTPPPEPHVAAEPITEDLVQDKEEEDDSSKIVIPVPESESLSLKEDSNRVSDSEKNAIDELKKLLKEELEDEEVSIWGVPLFKDDRTDVILLKFLRARELKVKDALVMFQNTLRWRKDFNIDALLDEDLGDHLEKVVFMHGHGREGHPVCYNVYGEFQNKDLYHKAFSSQDNRNKFLRWRIQLLERSIRHLDFTPSSGINTIFQVNDLKNSPGPAKRELRLATKQALQLLQDNYPEFVAKQVFINVPWWYLAFYTMINPFLTSRTKSKFVFAGPSKSPDTLFKYIFPEQVPVQYGGLSVDFCDCNPDFTMSDPVTEIPIKPTTKQTVEIAIYEKCIIVWELRVVGWEVSYNAEFKPDVEDAYTVIIQKATKMSPTDEPVVSNSFKVVELGKLLLTIDNPTLKKKRLLYRFKIKPYSD

SEQ ID NO: 1566 - DNA, 2166 bp, Triticum aestivum
  misc_feature (1)..(2166): Ceres CLONE ID no.846541
  misc_feature (1)..(2166): Encodes the peptide sequence at SEQ ID NO 1567
aacaccccaagctttctctctctacctccctcccgtgctctctccccctctccctcctgctctatctttctcaccgcaaaagcttgaaacaccccgcggagatggcagaggagccgcagccacaggccgccgccgcccccgccgccgcggccacggaggtggtcgtcgccgagaaggcgccggcggaggtggagaagaaggccgaggagcccgcggcggaggcggaggccgaggagacggccgccgttgccgacgacgggggcgccgtcgaggccaccggctctttcaaggaggagagcaacctcgtcgccgacctgcctgacccggagaagaaggcgctcgacgagttcaaggagctgatcgtcgccgcgctcgccgccggtgagttcaatctgccccctcccccgccgccgccgaaggccaagactgaggccgccgcagaggagaccaagacggaggcgccggccaaggaggaggccaagaccgaggagccggccaaggcggaagaaccagccaaggaggagcccaaggctgaagagccggccaaggccgaggcggcagcggcggagccagcagccgaggagcccaaggccgtggtcgctgccgaggcagcagccgaggagccggccaaggaggaacccaaggccgaggaggccaagccggccgagccaaagaaggaggaggaagcagtcgtggtcgccgaggagggcaccaagacggcggaaccggtcgaggaggccgccgccgccgccaccaccacagagcaggcagcggcgccggaaccggaggcggaggcagccgcgcccgagccggtgttcatctggggcgtgccgctggtgggcgacgacgagcgcacggacgcggtgctgctcaagttcctgcgcgcgcgggagttcaaggtgaaggaggcgatggcgatgctccggtccgccgtgctgtggcggaagcgcttcggcatcgagtcgctcctggaggccgacctggccttcccggagctggagaaggtggtgttctaccgcggcgccgaccgggagggccacccggtgtgctacaacgtgtacggcgagttccaggacaaggaggtgtacgagaaggcgttcggcgacgaggagaagcgcgagcggttcctcaagtggcgcatccagctgctggagcgcggcatcctgtcgcagctggacttcgcgcccagcggcatctgctccatggtgcaggtcaccgacctcaagaactcgccgcccatgctcggcaagcaccgcgccgtcacccgccaggccgtcgccctgctccaggacaactaccccgagttcatcgccaagaaggtgttcatcaacgtgccatggtggtatctcgctgccaacaaaatgatgagccctttcctcacccagcgcaccaagagcaagttcgtgttcgccagccaggccaagtcccctgagacccttttcagatacatcgcgccggagcaagtccccgtccaattcggaggcctcttcaaggaagatgaccctgatttcacaacctctgactctgtcaccgagctcaccatcaaagcttcttccaaagaaaccattgagatccctgtcaccgagaactcaacgattgtatgggagctccgggtgctcggctgggaggtcagccacggcgcggagttcacccccgacgctgagggcgcgtacacggtcatcgtgcagaagacaaggaaggtccccgcgaatgaggagcccatcatgaagggcagcttcaaggccggcgaggccggcaagatcgtgctcacggtcagcaacgccgcgtcgaagaagaagaagctcctctacagatccaaggtgaagtgcagcaccggcgagtccgttgaggccgacattccatgaccaccattggagtcagtccctgatgatgatagaagaagaagaagaagaagaagataaaccgcctttttggtttttgttctttgattccattggttttgtggtttttggttcgcattcccgcatttgtttaattattaaaattaaaaacccaaagtgagcttgattttgtgacggtacagtagttgggagaggaaggttggtatggatgggatgatataatggcatcgtgatggttgttgagggtagggcaagaggagaaaaatggatgatacaatctgctgctgctctgtaaatttgtctg

SEQ ID NO: 1567 - protein, 587 aa, Triticum aestivum
  misc_feature (1)..(587): Ceres CLONE ID no.846541
  misc_feature (1)..(587): Bit score of 1276.5 for HMM based on sequences of FIGURE 54.
  misc_feature (249)..(289): Pfam Name: CRAL_TRIO_N Pfam Description: CRAL/TRIO, N-terminus
  misc_feature (304)..(467): Pfam Name: CRAL_TRIO Pfam Description: CRAL/TRIO domain
  misc_feature (493)..(574): Pfam Name: EMP24_GP25L Pfam Description: emp24/gp25L/p24 family/GOLD
  misc_feature (1)..(587): Functional Homolog Of Ceres SEEDLINE ID no. ME18924 at SEQ ID NO: 1554
MAEEPQPQAAAAPAAAATEVVVAEKAPAEVEKKAEEPAAEAEAEETAAVADDGGAVEATGSFKEESNLVADLPDPEKKALDEFKELIVAALAAGEFNLPPPPPPPKAKTEAAAEETKTEAPAKEEAKTEEPAKAEEPAKEEPKAEEPAKAEAAAAEPAAEEPKAVVAAEAAAEEPAKEEPKAEEAKPAEPKKEEEAVVVAEEGTKTAEPVEEAAAAATTTEQAAAPEPEAEAAAPEPVFIWGVPLVGDDERTDAVLLKFLRAREFKVKEAMAMLRSAVLWRKRFGIESLLEADLAFPELEKVVFYRGADREGHPVCYNVYGEFQDKEVYEKAFGDEEKRERFLKWRIQLLERGILSQLDFAPSGICSMVQVTDLKNSPPMLGKHRAVTRQAVALLQDNYPEFIAKKVFINVPWWYLAANKMMSPFLTQRTKSKFVFASQAKSPETLFRYIAPEQVPVQFGGLFKEDDPDFTTSDSVTELTIKASSKETIEIPVTENSTIVWELRVLGWEVSHGAEFTPDAEGAYTVIVQKTRKVPANEEPIMKGSFKAGEAGKIVLTVSNAASKKKKLLYRSKVKCSTGESVEADIP

SEQ ID NO: 1568 - DNA, 1915 bp, Panicum virgatum
  misc_feature (1)..(1915): Ceres CLONE ID no.1727755
  misc_feature (1)..(1915): Encodes the peptide sequence at SEQ ID NO 1569
actctctctctgtctctctctctctccgccgccgctgccgcattgattacttgggatctgcacacctgcctcgtgccgagtttcggtgttgcgagttgtgagtgtgagcgccatggccgtggaggctgtgtccgggaacggcggcgaggcggtggcgccggtgaaggaggtgagcgccaaggtggaggccaaggaggcggctgcggtcaccaagaatgcgtcgttcagggaggagagcaacttcctggatgacctcaaggagagcgagcggaaggcgctcgccgagctccgcgacaaggtggaggccgccatcctggagggcaagctgttcgacgacggcaagccggaggtgaaggagaagagggaggccaagaagaaggccgagaaggcgcccgaggagaagaaagaggaggaggaggaagggaagaaggagcccgaagccgtggagaagaaaggggaggaggacgccaagaaggaggccgaggtcgagggcaagaaagaggaggaagaaagcaagaaagaggctgagaaggagatggagcaggaggaagctggcgaggccgagaaggttgctgcggcggcggaggagaaaccggcggagacggcggccgtcgtcgtggacaaggacatcgccctgtggggcgtgcccctgctcccgagcaagggcgacgaggccaccgacgtcgtgctcctcaagttcctccgcgcgcgcgacttcaaggccggcgccgcgttcgagatgctccgccgcaccctccgctggcgcagggactggcccggcttcgacgccgacgccgacgccgatctccccgaggagctcgcgggcgcgtgctacctcgacggcgcggaccgcgagggccacccggtgtgctacaacgcgctcggggtgttcgccgacgacgccttgtacaagaaggcgctcggcaccgaggaaggcaaggcgcggttcctccggtggcgggtgcgcgccatggagcgccacgtcgcggagctggacttgaagcccggcggcgccgcgtcgctgctgcaggtgaccgacctcaagaactcgccggggccggccaagaaggacttccgcgtcgccgtcaagcaggtgctcgacctgttccaggacaactaccccgagctcgtcgcaagaaacatcttgatcaacgtgccgttctggtactacgcgttcagcaccctgttctacccgttcctgacgcagcggaccaagagcaagttcgtcattgctcgcccgtccaaggtcaccgagaccctcctcaagtacattccgattgaggccatcccggtgaagtacggcggcctgaaacgcgacgacgacactgaattctcctccgccgatgacggcgaagtcgcagagctcactgtcaagggaagctccaccgagaccattgagattgaagccactgaggctgatgccaccctgacatgggacctgacggtgctgggctgggaggtgaactacaaggaggagttcgtgccggccgacgagagctcctacaccatcatcgtcaggaagggcaagaagatgggggcgggcgaggaggctgtccgcaactcgttccgcgccggcgagcccggcaaggtggtgctcaccgtcgagaacacctcgcacaagaagaagaaggtgctgttcaggcacaagtccaagagcgccttcgccaagaagtgctgaggctcgatcgaaacctgcctgcaagccgaattcttcggagggtgtgatgtgctgagctcctatgccaaggagtgaattggttggtcgtgtggatccaatattcaattattcattacattctttatgtgtgtgtgtaagaaagaagagagcattgtttgtattcatggtgattaatttgaggttgggtgttgcggcatgacattcatgattcctgagaatataaagagctggtatcgc

SEQ ID NO: 1569 - protein, 521 aa, Panicum virgatum
  misc_feature (1)..(521): Ceres CLONE ID no.1727755
  misc_feature (1)..(521): Bit score of 1033.5 for HMM based on sequences of FIGURE 54.
  misc_feature (189)..(220): Pfam Name: CRAL_TRIO_N Pfam Description: CRAL/TRIO, N-terminus
  misc_feature (325)..(424): Pfam Name: CRAL_TRIO Pfam Description: CRAL/TRIO domain
  misc_feature (433)..(513): Pfam Name: EMP24_GP25L Pfam Description: emp24/gp25L/p24 family/GOLD
  misc_feature (1)..(521): Functional Homolog Of Ceres SEEDLINE ID no. ME18924 at SEQ ID NO: 1554
MAVEAVSGNGGEAVAPVKEVSAKVEAKEAAAVTKNASFREESNFLDDLKESERKALAELRDKVEAAILEGKLFDDGKPEVKEKREAKKKAEKAPEEKKEEEEEGKKEPEAVEKKGEEDAKKEAEVEGKKEEEESKKEAEKEMEQEEAGEAEKVAAAAEEKPAETAAVVVDKDIALWGVPLLPSKGDEATDVVLLKFLRARDFKAGAAFEMLRRTLRWRRDWPGFDADADADLPEELAGACYLDGADREGHPVCYNALGVFADDALYKKALGTEEGKARFLRWRVRAMERHVAELDLKPGGAASLLQVTDLKNSPGPAKKDFRVAVKQVLDLFQDNYPELVARNILINVPFWYYAFSTLFYPFLTQRTKSKFVIARPSKVTETLLKYIPIEAIPVKYGGLKRDDDTEFSSADDGEVAELTVKGSSTETIEIEATEADATLTWDLTVLGWEVNYKEEFVPADESSYTIIVRKGKKMGAGEEAVRNSFRAGEPGKVVLTVENTSHKKKKVLFRHKSKSAFAKKC

SEQ ID NO: 1570 - DNA, 1903 bp, Panicum virgatum
  misc_feature (1)..(1903): Ceres CLONE ID no.1769321
  misc_feature (1)..(1903): Encodes the peptide sequence at SEQ ID NO 1571
actctctctgtctctctctctctctctctctatctctctctccgccgccgctgccgcattgattacttggggatctgcacacctgcctcgtgccgagtttcggtgttgcgagttgtgagtgtgagcgccatggccgtggaggctgtgtccgggaacggcggcgaggcggtggcgccggcgccggcgccggtgaaggaggtgagcgccaaggtggaggccaaggaggcggctgcggtcaccaagaacgcgtcgttcagggaggagagcaacttcctggatgacctcaaggagagcgagcggaaggcgctcgccgagctccgcgacaaggtggaggccgccatcctggagggcaagctgttcgacgacggcaagccggaggtgaaggagaagagggaggccaagaagaaggccgagaaggcgcccgaggagaagaaagaggaggaggaggaagggaagaaggagcccgaagccgtggagaagaaaggggaggaggacgacaagaaggaggccgaggtcgagggcaaggaagaggaggaagaaagcaagaaagaggctgagaaggagatggagcaggaggaagctggcgaggccgagaaggttgctgcggcggcggaggagaaaccggcggagacggcggccgtcgtcgtggacaaggacatcgccctgtggggcgtgcccctgctcccgagcaagggcgacgaggccaccgacgtcgtgctcctcaagttcctccgcgcgcgcgacttcaaggccggcgccgcgttcgagatgctccgccgcaccctccgctggcgcagggactggcccggcttcgacgccgacgccgacgccgatctccccgaggagctcgcgggcgcgtgctacctcgacggcgcggaccgcgagggccacccggtgtgctacaacgctctccgggtgttcgccgacgacgccgtgtacaagaaggcgctcggcaccgaggaaggcaaggcgcggttcctccggtggcgggtgcgcgccatggagcgccacgtcgcggagctggacttgaagcccggcggcgccgcgtcgctgctgcaggtgaccgacctcaagaactcgccggggccggccaagaaggacttccgcgtcgccgtcaagcaggtgctcgacctgttccaggacaactaccccgagctcgtcgcaagaaacatcttgatcaacgtgccgttctggtactacgcgttcagcaccctgttctacccgttcctgacgcagcggaccaagagcaagttcgtcattgctcgcccgtccaaggtcaccgagaccctcctcaagtacattccgattgaggccatcccggtgaagtacggcggcctgaaacgcgacgacgacactgaattctcctccgccgatgacggcgaagtcgcagagctcactgtcaagggaagctccaccgagaccattgagattgaagccgctgaggctgatgccaccctgacatgggacctgacggtgctgggctgggaggtgaactacaaggaggagttcgtgccggccgacgagggctcctacaccatcatcgtcaggaagggcaagaagatgggggccggcgaggaggctgtccgcaactcgttccgcgccggcgagcccggcaaggtggtgctcaccgtcgagaacacctcgcacaagaagaagaaggtgctgttcaggcacaagtccaagagcgccttcgccaagaagtgctgaggctcgatcgaaacctgcctgcaagccgaattcttcggagggtgtgatgtgctgagctcctatgccaaggagtgaattggttggtcgtgtggatccaatattcaattattcattacattctttatgtgtgtgtgtaagaaagaagagagcattgtttgtattcatgattcctgagaatataaagagctggtatcgc

SEQ ID NO: 1571 - protein, 525 aa, Panicum virgatum
  misc_feature (1)..(525): Ceres CLONE ID no.1769321
  misc_feature (1)..(525): Bit score of 1047.4 for HMM based on sequences of FIGURE 54.
  misc_feature (193)..(224): Pfam Name: CRAL_TRIO_N Pfam Description: CRAL/TRIO, N-terminus
  misc_feature (329)..(428): Pfam Name: CRAL_TRIO Pfam Description: CRAL/TRIO domain
  misc_feature (437)..(517): Pfam Name: EMP24_GP25L Pfam Description: emp24/gp25L/p24 family/GOLD
  misc_feature (1)..(525): Functional Homolog Of Ceres SEEDLINE ID no. ME18924 at SEQ ID NO: 1554
MAVEAVSGNGGEAVAPAPAPVKEVSAKVEAKEAAAVTKNASFREESNFLDDLKESERKALAELRDKVEAAILEGKLFDDGKPEVKEKREAKKKAEKAPEEKKEEEEEGKKEPEAVEKKGEEDDKKEAEVEGKEEEEESKKEAEKEMEQEEAGEAEKVAAAAEEKPAETAAVVVDKDIALWGVPLLPSKGDEATDVVLLKFLRARDFKAGAAFEMLRRTLRWRRDWPGFDADADADLPEELAGACYLDGADREGHPVCYNALRVFADDAVYKKALGTEEGKARFLRWRVRAMERHVAELDLKPGGAASLLQVTDLKNSPGPAKKDFRVAVKQVLDLFQDNYPELVARNILINVPFWYYAFSTLFYPFLTQRTKSKFVIARPSKVTETLLKYIPIEAIPVKYGGLKRDDDTEFSSADDGEVAELTVKGSSTETIEIEAAEADATLTWDLTVLGWEVNYKEEFVPADEGSYTIIVRKGKKMGAGEEAVRNSFRAGEPGKVVLTVENTSHKKKKVLFRHKSKSAFAKKC

SEQ ID NO: 1572 - protein, 610 aa, Oryza sativa subsp. indica
  misc_feature (1)..(610): Public GI ID no.125528559
  misc_feature (1)..(610): Bit score of 1372.1 for HMM based on sequences of FIGURE 54.
  misc_feature (278)..(318): Pfam Name: CRAL_TRIO_N Pfam Description: CRAL/TRIO, N-terminus
  misc_feature (333)..(504): Pfam Name: CRAL_TRIO Pfam Description: CRAL/TRIO domain
  misc_feature (522)..(603): Pfam Name: EMP24_GP25L Pfam Description: emp24/gp25L/p24 family/GOLD
  misc_feature (1)..(610): Functional Homolog Of Ceres SEEDLINE ID no. ME18924 at SEQ ID NO: 1554
MAEEPQPEAAPAAVAATTEVAVAEKAPVEAEKEKKVEEETPAVEAEAKEEKKDEAAAAGGDEAGAIEGTGSFKEESNLVADLPDPEKKALDEFKQLIAAALAACEFNLPPPPPPPKAKVEAAVEETKAEESKAEEEPKAEEPAKEEEPKAEVAAAAAAPPEAGTEEPKAEASSEEAKTEEPKAEAAADEPAKQESKAEAAPAEEAKPAEPEPEEKTVVVTEEEAATKTVEAIEETVVPAAAAPAAAATEEAAAPEPEVQAAAAPEPVLIWGVPLVGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 1573 - protein, 613 aa, Oryza sativa subsp. japonica
  misc_feature (1)..(613): Public GI ID no.115441357
  misc_feature (1)..(613): Bit score of 1369.3 for HMM based on sequences of FIGURE 54.
  misc_feature (281)..(321): Pfam Name: CRAL_TRIO_N Pfam Description: CRAL/TRIO, N-terminus
  misc_feature (336)..(507): Pfam Name: CRAL_TRIO Pfam Description: CRAL/TRIO domain
  misc_feature (525)..(606): Pfam Name: EMP24_GP25L Pfam Description: emp24/gp25L/p24 family/GOLD
  misc_feature (1)..(613): Functional Homolog Of Ceres SEEDLINE ID no. ME18924 at SEQ ID NO: 1554
MAEEPQPEAAPAAVAATTEVAVAEKAPVEAEKEKKVEEETPAVEAEAKEEKKDEAAAAAAAGGDEAGAIEGTGSFKEESNLVADLPDPEKKALDEFKQLIAAALAACEFNLPPPPPPPKAKVEAAVEETKAEETKAEEEPKAEEPAKEEEPKAEVAAAAAAPPEAGTEEPKAEASSEEAKTEEPKAEAAADEPAKEESKAEAAPAEEAKPAEPEPEEKTVVVTEEEAATKTVEAIEETVVPAAAAPAAAATEEAAAPEPEVQAAAAPEPVLIWGVPLVGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 1574 - protein, 595 aa, Oryza sativa subsp. japonica
  misc_feature (1)..(595): Public GI ID no.125572823
  misc_feature (1)..(595): Bit score of 1296.2 for HMM based on sequences of FIGURE 54.
  misc_feature (263)..(303): Pfam Name: CRAL_TRIO_N Pfam Description: CRAL/TRIO, N-terminus
  misc_feature (318)..(489): Pfam Name: CRAL_TRIO Pfam Description: CRAL/TRIO domain
  misc_feature (507)..(588): Pfam Name: EMP24_GP25L Pfam Description: emp24/gp25L/p24 family/GOLD
  misc_feature (1)..(595): Functional Homolog Of Ceres SEEDLINE ID no. ME18924 at SEQ ID NO: 1554
MAEEPQPEAAPAAVAATTEVAVAEKAPVEAEKEKKVEEETPAVEAEAKEEKKDEAAAAAAAGGDEAGAIEGTGSFKEESNLVADLPDPEKKALDEFKQLIAAALAACEFNLPPPPPPPKAKVEAAVEETKAEETKAEEEPKAEEPAKEEEPKAEVAAAAAAPPEAGTEEPKAEASSEEAKTEEPKAEAAADEPAKEESKAEAAPAEEAKPAEPEPGGEDRRGHRGRGGHQDGGSDRGNRRARCCCACCRRHGGSRGAGTGGDDERTDTVLLKFLRAREFKVKEAMAMLRSAVLWRKRFGIESLLDADLALPELDSVVFYRGADREGHPVCYNVYGEFQDKDLYEKAFGDEEKRERFLKWRIQLLERGILSQLDFSPSGICSMVQVTDLKNSPPMLGKHRAVTRQAVALLQDNYPEFIAKKVFINVPWWYLAANKMMSPFLTQRTKSKFIFASPAKSAETLFRYIAPEQVPVQFGGLFKEDDPEFTTSDAVTELTIKPSSKETVEIPVTENSTIGWELRVLGWEVSYGAEFTPDAEGGYTVIVQKTRKVPANEEPIMKGSFKVGEPGKIVLTINNPASKKKKLLYRSKVKSTSESV

SEQ ID NO: 1575 - protein, 607 aa, Trifolium pratense
  misc_feature (1)..(607): Public GI ID no.84453208
  misc_feature (1)..(607): Bit score of 1355.9 for HMM based on sequences of FIGURE 54.
  misc_feature (274)..(318): Pfam Name: CRAL_TRIO_N Pfam Description: CRAL/TRIO, N-terminus
  misc_feature (332)..(500): Pfam Name: CRAL_TRIO Pfam Description: CRAL/TRIO domain
  misc_feature (521)..(602): Pfam Name: EMP24_GP25L Pfam Description: emp24/gp25L/p24 family/GOLD
  misc_feature (1)..(607): Functional Homolog Of Ceres SEEDLINE ID no. ME18924 at SEQ ID NO: 1554
MAEEPQKPTEQVATTPATSETTIEKTPPPQAEEVVAAADADAVVVPPVVAEETEKPAEDVKPADETAAATDKKILQSVSFKEETNVVSELPESQKKALDELKQLIQEALNKHEFTAPPPPPPTKAVAEVAEEKKPEEEEKKTEEVVAEEKKVEEVVAEEKKVEEAVAEEKKVEEVEKKEEEKGSSSEEPKTEAKIEAEPEAKKEETVLEVVEKIATSTEEDGAKTVEAIQESIVSVTVTDGEQPVTETVGEAVAVAEVEVTPTTPEEVEIWGIPLLADERSDVILLKFLRARDFKVKEAYTMIKQTVIWRKEFGIEALLQEDLGTDWDKVVFTDGYDKEGHPVYYNVFGEFENKELYQNTFSDDEKRTKFIRWRIQSLEKSIRKLDFTPSGISTIVQVNDLKNSPGLGKKELRQATNKALQLLQDNYPEFVAKQVFINVPWWYLAFSRFLSAFLTQRTKSKFVFAGPSKSADTLFKYIAPEQVPVQYGGLSREGEQEFTTADPATEVTIKPATKHAVEFPISEKSTLVWEVRVVDWSVNYGAEFVPSAEDGYTVIIQKNRKVAPADETIISNTFKIGEPGKVILTIDNQSSKKKKLLYRSKTIPISE

SEQ ID NO: 1576 - DNA, 1545 bp, Arabidopsis thaliana
  misc_feature (1)..(1545): Ceres SEEDLINE ID no.ME19182
  misc_feature (1)..(1545): Ceres ANNOT ID no.876419
  misc_feature (1)..(1545): Genomic Sequence
  misc_feature (1)..(1545): Inplanta Sequence
  misc_feature (1)..(1545): Encodes the peptide sequence at SEQ ID NO. 1577
ttttttgaaggttcttgatctcaacttttgttgcgtattgatgtttgatcctctggattttgtatccaacggaagatctatcgagaaatgaacaaattcgatacaaattgttagtgtttagctgaattatgtagattttgttaacttcgatcttgaagatgattgatgtttatcgtactagtagaatctgatgttaaatctttgagtgatggatcgtgttatcagcatcaatagtgaaaagattctatattgatttagacgtgaagtcatgaaaattgactaacaagattctaacgtttggttctgttttgctctgttttattagatgaatggagaagaagtgaaaacgagtcaacctcagaagaagcttcagaaccctactccacgtttaaacgagaggattctctcatctttgtctaagagatcggttgctgcacatccatggcatgatcttgaaatcggtaataatcactgttttaaagatattctgtgtgtttgattagagtctttttaactaaattgttctatgtgtgcaggacctggagctccagtgattttcaatgtggtaaagtctttatgcttgatgatgtgacaatccgatcgaaaaagagttaatcatttgtcttttttggatgaaattaggttattgagatctcaaaggggagcaaagtcaaatatgaacttgacaaaaaaacaggtctcatcaaggtaaaaagatatcaaatcttgaaaaaacagaatgatctgaggatatatgatgatcgtaagtgtttgtatatgtctatcaggttgataggattctttattcttcggttgtgtatcctcacaactacgggtttgtcccacgcacactatgtgaagacaatgaccctatagatgttttagttatcatgcaggtttgagtctaattctaacaacattcaccaaaagaaaatgaaatggctgaaataatttcttatcaaagttgattatgtacaggagcctgtgcttccgggttgttttcttcgcgcccgagctattggtttaatgcctatgattgaccaggtaacatcctaagctttagtttttcatgtttccttgtgcttcaagtttgtgtaaccattgtagctaattctttggggttttggttgaaataaagggtgaaaaagatgacaagatcattgcagtttgtgttgatgatcctgagtataagcacatcactaacatcaatgaacttcctcctcatcgtctttctgaaatccgtcgattctttgaagactgtatccttaaaacctattttaatacttgattaggaaacaaaaccatttcttttttgctatctttaaccaaaatataacagacaagaagaatgagaacaaggaagttgcagtgaatgattttctacaacctggtcctgctattgaagccattcagtactcaatgtaaacttttttttctttttaccttttttacataatttgcttttcttttaagcaaatcttgatgtttgaaatcattcacagggatctttacgctgagtacattcttcacaccctgaggagatag

SEQ ID NO: 1577 - protein, 216 aa, Arabidopsis thaliana
  misc_feature (1)..(216): Ceres SEEDLINE ID no.ME19182
  misc_feature (1)..(216): Ceres ANNOT ID no.876419
  misc_feature (1)..(216): Bit score of 527.2 for HMM based on sequences of FIGURE 55.
  misc_feature (54)..(208): Pfam Name: Pyrophosphatase Pfam Description: Inorganic pyrophosphatase
MNGEEVKTSQPQKKLQNPTPRLNERILSSLSKRSVAAHPWHDLEIGPGAPVIFNVVIEISKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHITNINELPPHRLSEIRRFFEDYKKNENKEVAVNDFLQPGPAIEAIQYSMDLYAEYILHTLRR

SEQ ID NO: 1578 - protein, 192 aa, Chlamydomonas reinhardtii
  misc_feature (1)..(192): Public GI ID no.75164812
  misc_feature (1)..(192): Bit score of 417.9 for HMM based on sequences of FIGURE 55.
  misc_feature (28)..(180): Pfam Name: Pyrophosphatase Pfam Description: Inorganic pyrophosphatase
  misc_feature (1)..(192): Functional Homolog Of Ceres SEEDLINE ID no. ME19182 at SEQ ID NO: 1577
MSFYRGTASHPWHDLHPGNDAPNFVSCVIEIPRGSKVKYELDKDTGLCFVDRILYSSVVYPHNYGFVPKTLCEDGDPLDVLVLMQEPVVPMCFLRAKPIGVMQMLDQGERDDKLIAVHADDPEYKGFTDISQLPPHRLAEIKRFFEDYKKNEHKEVVVDDFLGAEEAKKVVKDSLNMYQEHYVPRKLRNVYE

SEQ ID NO: 1579 - DNA, 1036 bp, Gossypium hirsutum
  misc_feature (1)..(1036): Ceres CLONE ID no.1794223
  misc_feature (1)..(1036): Encodes the peptide sequence at SEQ ID NO 1580
aagggacaacttattttctcccattctttaacatcctttgaagactccattctataaatattttacctataacatcaagcgcagcttcaagctcattgcatcccttcctatttctcttccctcaataatcaaaagcttcttctttctttctttttctgtgcgtgcactcttaaaccacaacaaaccaagatgagtgaagaagataaaaatgaagctaaggtactggaaactccacgcaaaccaccccgtctgaacgagaggattctttcgtctatgtcacggagatcagttgctgcacatccttggcatgatcttgagattggacctggagctccagcaatttttaactgtgttgttgagataccaaaaggtagtaaggtcaagtatgaacttgacaagaagacaggattgattaaggttgatcgagttttatattcatcagtggtctaccctcataactatggtttcatccctcgcacactttgtgaagacaatgatcccttggattgtttggttatcatgcaggagcccgttcttcctggatgttttctgcgagccagagcccttggactaatgccaatgattgaccagggggagaaagatgacaagatcattgcagtttgtgttgatgatcctgagtacaagcattacaccgacatcaaagatcttccccctcaccgcctgactgagatccgtcgtttctttgaagactacaagaaaaatgagaacaaggaggttgcagtcgacaaatttttaccagcaaccgctgccgttgaagctgtccagtattcaatggatctttatgccgagtacattatgcaaaccctgaggcgataggctgaaaaagggcaatcttccatcatgggaggaaatgcaccacatactaaataaaacatttatcgacagcatttggatatgaattgaactcctttgatactccccttttagctgtgattctgtacgattattattacccgttggattaaaaactttgttgtcgggaagagattatatatggaatttatgacattaccag

SEQ ID NO: 1580 - protein, 215 aa, Gossypium hirsutum
  misc_feature (1)..(215): Ceres CLONE ID no.1794223
  misc_feature (1)..(215): Bit score of 539.0 for HMM based on sequences of FIGURE 55.
  misc_feature (53)..(207): Pfam Name: Pyrophosphatase Pfam Description: Inorganic pyrophosphatase
  misc_feature (1)..(215): Functional Homolog Of Ceres SEEDLINE ID no. ME19182 at SEQ ID NO: 1577
MSEEDKNEAKVLETPRKPPRLNERILSSMSRRSVAAHPWHDLEIGPGAPAIFNCVVEIPKGSKVKYELDKKTGLIKVDRVLYSSVVYPHNYGFIPRTLCEDNDPLDCLVIMQEPVLPGCFLRARALGLMPMIDQGEKDDKIIAVCVDDPEYKHYTDIKDLPPHRLTEIRRFFEDYKKNENKEVAVDKFLPATAAVEAVQYSMDLYAEYIMQTLRR

SEQ ID NO: 1581 - DNA, 1055 bp, Gossypium hirsutum
  misc_feature (1)..(1055): Ceres CLONE ID no.1842917
  misc_feature (1)..(1055): Encodes the peptide sequence at SEQ ID NO 1582
ttttttttctgctcttcgggtttggctttagatggtaaccaagaaagaaagcgggaaccggcacagcttcctttgctacttctctatttaaagcctcctataagcttcttgaaagcttcattttggttcagaactggaaaccgctgctgtgatggctccaccaattgagactacagtcaagtcctctgactctcactgcgctccacatcctcctttgaatgaaaggatcctttcgtcaatgaccaggaggtccgtcgctgctcacccatggcatgatcttgaaattggacctggagctcctacggttttcaactgcgtgattgaaattgggaaagggagcaaggtgaaatatgaacttgacaagaaaactggtttgatcaaggttgatcgtgtgctttattcatcagttgtgtatcctcacaactatggtttcattcctcgtactctttgtgaagacaatgatcccttggatgtcctgattattatgcaggaaccagttcttccagggtgctttcttcgggctaaagctataggtctgatgcctatgattgatcagggtgagaaagatgacaagattattgctgtatgtgctgatgatcctgagtatcgtcactacaatgacatcaaggaacttccacctcaccgtttggctgagattcgccgcttctttgaggactataagaagaatgagaacaaggaagttgctgtcaatgacttcctgcccgcctcaactgcttatgaggcaatccagcattccatgaatttatacgcggactacattgtggagagcttaaggcggtagttgttcatagcattccgtctttatagtatattacatagttatgaatatgtttctgctatatactgaagtactgtcatgcatactgcattcacctacgaagtattgtgtgcttatcccctaaaatacattttcattttctggatggaagaaagaaaaaggtttgaagttatgataattatgcaatgatgatgaccataattttggatatttctcattgtaatgataatgcctataaatctttttcctttttgtc

SEQ ID NO: 1582 - protein, 216 aa, Gossypium hirsutum
  misc_feature (1)..(216): Ceres CLONE ID no.1842917
  misc_feature (1)..(216): Bit score of 534.1 for HMM based on sequences of FIGURE 55.
  misc_feature (54)..(187): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MAPPIETTVKSSDSHCAPHPPLNERILSSMTRRSVAAHPWHDLEIGPGAPTVFNCVIEIGKGSKVKYELDKKTGLIKVDRVLYSSVVYPHNYGFIPRTLCEDNDPLDVLIIMQEPVLPGCFLRAKAIGLMPMIDQGEKDDKIIAVCADDPEYRHYNDIKELPPHRLAEIRRFFEDYKKNENKEVAVNDFLPASTAYEAIQHSMNLYADYIVESLRR

SEQ ID NO: 1583 - DNA, 969 bp, Gossypium hirsutum
  misc_feature (1)..(969): Ceres CLONE ID no.1936244
  misc_feature (1)..(969): Encodes the peptide sequence at SEQ ID NO 1584
ctccgcagagtatcggcggttcactttttttttttttctctctccgcgccgtatgaaacgaaaccgctgaagagatggcaccaccaattgagactccaaccaagtcctctggctctcaccacgcatcacatcctcctttgaatgaaaggattctttcatcgatgagcagaaggtctgttgctgctcacccatggcatgatcttgagattggacctggagctccaatggttttcaactgtgtgattgaaatcccaaaaggtagcaaggtgaaatatgaacttgacaagaaaactggtctgatcatggttgatcgagtgctttactcatcagttgtgtatcctcacaactacggattcatccctcgtactctttgtgaagacaatgatcccatggatgtcttgatcattatgcaggaaccagttattccaggatgctttcttcgcgctaaagctataggtctgatgcctatgattgatcagggtgagaaagatgacaagattattgctgtctgtgctgatgatcctgagtatcgtcactacaatgatatcaaggaactcccacctcaccgcctggctgaaatccgtcgcttctttgaagactataagaagaatgagaacaaagaagttgctgttaatgactttctgcctgcctctactgcatacgaggcaatccaacactccttgaatctctacgcggactacatcgtggagagcttgaggcggtagttgtcgattcaccgtgccccgtctatatacaaatatatatattaatatgaatatgaatatgttgctgctatacaagaaattcatcgtctccttgtgcgggcagaaacaccctgcactcactgattttgcgacaaagaaaatgtgtttttcattttataggtgacatggctgttggtgttttatgacaattatgcaatgatggcgataattttagataattctcagtgtaatgagtgattgctac

SEQ ID NO: 1584 - protein, 216 aa, Gossypium hirsutum
  misc_feature (1)..(216): Ceres CLONE ID no.1936244
  misc_feature (1)..(216): Bit score of 534.6 for HMM based on sequences of FIGURE 55.
  misc_feature (54)..(187): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MAPPIETPTKSSGSHHASHPPLNERILSSMSRRSVAAHPWHDLEIGPGAPMVFNCVIEIPKGSKVKYELDKKTGLIMVDRVLYSSVVYPHNYGFIPRTLCEDNDPMDVLIIMQEPVIPGCFLRAKAIGLMPMIDQGEKDDKIIAVCADDPEYRHYNDIKELPPHRLAEIRRFFEDYKKNENKEVAVNDFLPASTAYEAIQHSLNLYADYIVESLRR

SEQ ID NO: 1585 - DNA, 1217 bp, Gossypium hirsutum
  misc_feature (1)..(1217): Ceres CLONE ID no.1854569
  misc_feature (1)..(1217): Encodes the peptide sequence at SEQ ID NO 1586
ttttctctctccgcaccgtatgaaacataaggaatttccctctttttatatatttttatatattttttaatttacacttttcttttttttttttacttctcctcgctttggtatcgagcggggggttgcctttaaattctaacgaggaaagagagcgagaaggcatcaagcttttctttgctcctccttaagtgtttctatagggttttaattcgttcttctcattacctctcttttaacctttctcttttttgcttgctctctttttttttcgagatctgtgcgttttcttcttttcaattagcttcttgaaagctttattttcttaagaacaggaaaccgctgaagagatgcaccaccaattgagactccaaccaagtcctctggctctcaccacgcttcacatcctcctttgaatgaaaggattctttcatcgatgagcagaaggtctgttgctgctcacccatggcatgatcttgagattggacctggagctccaatggttttcaactgtgtgattgaaatcccaaaaggtagcaaggtgaaatatgaacttgacaagaaaactggtctgatcaaggttgatcgtgtgctttactcatcagttgtgtatcctcacaactacggattcatccctcgcactctttgtgaagacaatgatcccatggatgtcttgatcattatgcaggaaccagttattccaggatgctttcttcgcgctaaagctataggtctgatgcctatgattgatcagggtgagaaagatgacaagattattgctgtctgtgccgatgatcctgagtatcgtcactacaatgatatcaaggaactcccacctcaccgcctggctgaaatccgtcgcttctttgaagactataagaagaatgagaacaaagaagttgctgttaatgactttctgcctgcctctactgcatacgaggcaatccaacactccttgaatctctacgcggactacatagtggagagcttgaggcggtaattgtcggttcaccgtgccccgtctatatacaaatatatatattaatatgaatatgaatatgttgctactatacaagaaattcatcgtctccttgtgcgggcagaaacaccctgcactcactggttttgcgacaaagaaaatgtgtttttcattttataggtgacatggctgtttggtgttttatgacaattatgcaatgatggcgataattttagat

SEQ ID NO: 1586 - protein, 187 aa, Gossypium hirsutum
  misc_feature (1)..(187): Ceres CLONE ID no.1854569
  misc_feature (1)..(187): Bit score of 483.7 for HMM based on sequences of FIGURE 55.
  misc_feature (25)..(158): Pfam Name: Pyrophosphatase Pfam Description: Inorganic pyrophosphatase
  misc_feature (1)..(187): Functional Homolog Of Ceres SEEDLINE ID no. ME19182 at SEQ ID NO: 1577
MSRRSVAAHPWHDLEIGPGAPMVFNCVIEIPKGSKVKYELDKKTGLIKVDRVLYSSVVYPHNYGFIPRTLCEDNDPMDVLIIMQEPVIPGCFLRAKAIGLMPMIDQGEKDDKIIAVCADDPEYRHYNDIKELPPHRLAEIRRFFEDYKKNENKEVAVNDFLPASTAYEAIQHSLNLYADYIVESLRR

SEQ ID NO: 1587 - DNA, 943 bp, Gossypium hirsutum
  misc_feature (1)..(943): Ceres CLONE ID no.1849679
  misc_feature (1)..(943): Encodes the peptide sequence at SEQ ID NO 1588
ataccaaaaaaagccttcactcaaagaagccaaacactttggattctctcatttttctagaagtttttgagtattgaaagaagtatggcaaacaatgacggagaagcaacaagcgggaagagcactggattctctcgcgtcgcccttaatgaaagaatcctttcttcgatgactcgaagatcgattgctgctcatccttggcatgatttggagattggacctggtgctccagcagtttttaactgtgtggttgaaattggaaaaggtagcaaggtcaagtacgagctcgacaaaaccagtggtcttataaaagttgatcgtgttctgtactcatcagttgtttacccacacaactatggtttcatcccaaggactatttgtgaggacagtgatcctatggatgtcctgatactgatgcaggagcctgttttgcctggttcttttcttcgtgctcgtgctattgggttaatgcctatgattgatcagggtgagaaggatgacaagattattgctgtatgtgctgatgatcccaagttccgtcattacacagacatcaaacagcttcctcctcatcgtctggctgaaatccgccgcttcttcgaggattacaaaaagaatgagaacaagaaggttgatgtagaagactttttgccagctgagactgctattgcagccatcaagtattccatggatctatatgcatcttacattgttgaaagtttgaggaagtgatcatctttgcgactatttggtaaaaattacagtaaaatttgggtattatattagtgtgcccagacttaatgttgcatacctctcgtggttaaacattatcaaatgctcaagctgtgatattgatttatgttgcacttcttatatgacttccttaatagcatgtaatacattgtccatgagacttgactaatggaaaggaaatattcgactt

SEQ ID NO: 1588 - protein, 215 aa, Gossypium hirsutum
  misc_feature (1)..(215): Ceres CLONE ID no.1849679
  misc_feature (1)..(215): Bit score of 512.2 for HMM based on sequences of FIGURE 55.
  misc_feature (53)..(176): Pfam Name: Pyrophosphatase Pfam Description: Inorganic pyrophosphatase
  misc_feature (1)..(215): Functional Homolog Of Ceres SEEDLINE ID no. ME19182 at SEQ ID NO: 1577
MANNDGEATSGKSTGFSRVALNERILSSMTRRSIAAHPWHDLEIGPGAPAVFNCVVEIGKGSKVKYELDKTSGLIKVDRVLYSSVVYPHNYGFIPRTICEDSDPMDVLILMQEPVLPGSFLRARAIGLMPMIDQGEKDDKIIAVCADDPKFRHYTDIKQLPPHRLAEIRRFFEDYKKNENKKVDVEDFLPAETAIAAIKYSMDLYASYIVESLRK

SEQ ID NO: 1589 - DNA, 651 bp, Populus balsamifera subsp. trichocarpa
  misc_feature (1)..(651): Ceres ANNOT ID no.1471422
  misc_feature (1)..(651): Encodes the peptide sequence at SEQ ID NO 1590
atgagtgatgaaacgaaaacacaagaaaatgaagttgttgaagctaagcgccaagcaccccgtctgaacgagagaatcctttcatccttgtcaaggagaactgttgctgcacatccttggcatgatcttgaaattgggcctggagctccccacattttcaatgttgtggttgagataacaaaaggaagtaaggtcaaatacgaactggacaagaagacaggactaatcaaggtcgatcggattttatattcctcggtggtctatccccacaactatggtttcatccctcgcacattatgcgaagacaatgatcccttggatgttttggtactcatgcaggagcctgtccttcctggctgttttctgcgagccagggctattggacttatgcccatgattgaccagggagagaaagacgacaagattattgcggtttgtgctgatgatccagagtacaagcactacactgacatcagggagctggcccctcatcgtctttctgagatccgccgtttctttgaagattacaagaaaaatgagaacaaggaggttgcagttaatgactttttaccttcaaattctgctgttgaagctatccagtactcaatggacctttatgctgagtacattctgcacacgctgcggcggtag

SEQ ID NO: 1590 - protein, 216 aa, Populus balsamifera subsp. trichocarpa
  misc_feature (1)..(216): Ceres ANNOT ID no.1471422
  misc_feature (1)..(216): Bit score of 542.7 for HMM based on sequences of FIGURE 55.
  misc_feature (54)..(208): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MSDETKTQENEVVEAKRQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIRELAPHRLSEIRRFFEDYKKNENKEVAVNDFLPSNSAVEAIQYSMDLYAEYILHTLRR

SEQ ID NO: 1591 - DNA, 639 bp, Populus balsamifera subsp. trichocarpa
  misc_feature (1)..(639): Ceres ANNOT ID no.1497509
  misc_feature (1)..(639): Encodes the peptide sequence at SEQ ID NO 1592
atgagtgacgtaacaaaaacacaagaaaatgaagttgaaactaagcaccaagcgccccgtctgaatgagagaatcctttcatctttgtcaaggagaactgttgctgcacatccttggcatgatcttgaaattggtattttgcagaagatgatcgtggttgagataacaaaaggaagtaaggtcaaatatgaactggacaagaagacaggactaatcaaggttgatcggattttatactcctcagtggtctatccccacaactatggtttcatccctcgcacattatgcgaagacaatgatcccttggatgttttagtactcatgcaggagcctgtccttcccggttgttttctacgagccagggccattggacttatgcccatgattgaccagggagagaaagacgacaaaattattgcagtttgtgctgatgatcctgagtacaagcactacactgacatcaaggagctggccccccatcgtctttctgagatccgacgtttctttgaagactacaagaaaaatgagaacaaggaggttgcagttaatgacttcttaccttcaaatactgctgttgaagctatccagtactcaatggacctttatgctgagtacgttttgcacaccctgcgtcggtag

SEQ ID NO: 1592 - protein, 212 aa, Populus balsamifera subsp. trichocarpa
  misc_feature (1)..(212): Ceres ANNOT ID no.1497509
  misc_feature (1)..(212): Bit score of 504.9 for HMM based on sequences of FIGURE 55.
  misc_feature (51)..(204): Pfam Name: Pyrophosphatase Pfam Description: Inorganic pyrophosphatase
  misc_feature (1)..(212): Functional Homolog Of Ceres SEEDLINE ID no. ME19182 at SEQ ID NO: 1577
MSDVTKTQENEVETKHQAPRLNERILSSLSRRTVAAHPWHDLEIGILQKMIVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIKELAPHRLSEIRRFFEDYKKNENKEVAVNDFLPSNTAVEAIQYSMDLYAEYVLHTLRR

SEQ ID NO: 1593 - DNA, 645 bp, Populus balsamifera subsp. trichocarpa
  misc_feature (1)..(645): Ceres ANNOT ID no.1524833
  misc_feature (1)..(645): Encodes the peptide sequence at SEQ ID NO 1594
atgagtgatgaaacgaaaacacaagaaaatgaagttgttgaagctaagcgccaagcaccccgtctgaacgagagaatcctttcatccttgtcaaggagaactgttgctgcacatccttggcatgatcttgaaattgggcctggagctccccacattttcaatgttgtggttgagataacaaaaggaagtaaggtcaaatacgaactggacaagaagacaggactaatcaaggtcgatcggattttatattcctcggtggtctatccccacaactatggtttcatccctcgcacattatgcgaagacaatgatcccttggatgttttggtactcatgcaggagcctgtccttcctggctgttttctgcgagccagggctattggacttatgcccatgattgaccagggagagaaagacgacaagattattgcggtttgtgctgatgatccagagtacaagcactacactgacatcagggagctggcccctcatcgtctttctgagatccgccgtttctttgaagatttatctccttccaatgccagttatcgaattcgatgcagtaccattttttatgaacttttatacattgttcggtgcagggacctttatgctgagtacattctgcacacgctgcggcggtag

SEQ ID NO: 1594 - protein, 214 aa, Populus balsamifera subsp. trichocarpa
  misc_feature (1)..(214): Ceres ANNOT ID no.1524833
  misc_feature (1)..(214): Bit score of 447.8 for HMM based on sequences of FIGURE 55.
  misc_feature (54)..(174): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MSDETKTQENEVVEAKRQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIRELAPHRLSEIRRFFEDLSPSNASYRIRCSTIFYELLYIVRCRDLYAEYILHTLRR

SEQ ID NO: 1595 - DNA, 621 bp, Populus balsamifera subsp. trichocarpa
  misc_feature (1)..(621): Ceres ANNOT ID no.1510462
  misc_feature (1)..(621): Encodes the peptide sequence at SEQ ID NO 1596
atggctaacaacgatggggaagtgaccgggaaacgtgcaggatggcctcctgttctcaatgaaaggattctttcttcaatgtcccggagatctattgctgcgcatccctggcatgacttggagattggacctggtgctccaagtgttttcaattgtgtgattgagatcagcaagggcagcaaggttaagtatgagcttgacaaggcaagtggccttataaaggttgatcgtgttctctactcatcagttgtttacccacacaactatggtttcatcccacgaactctctgtgaggacagtgatcctatggatgttctggtactgatgcaggagcctgtgctacccggttctttccttcgtgctcgtgcaattggtttaatgccaatgattgatcagggtgaaaaggatgacaaaatcattgcagtgtgtgctgatgaccctgagttcgtccattacaaggacatcaaggaacttcctccgcatcgcctggctgaaattcgccgctttttcgaggactgtatccatattcatacaaataagaagaatgagaacaagaaagttgatgttgaagacttcttgccagctgcctctgcaattgatgccatcaagtattccatgtga

SEQ ID NO: 1596 - protein, 206 aa, Populus balsamifera subsp. trichocarpa
  misc_feature (1)..(206): Ceres ANNOT ID no.1510462
  misc_feature (1)..(206): Bit score of 443.6 for HMM based on sequences of FIGURE 55.
  misc_feature (51)..(171): Pfam Name: Pyrophosphatase Pfam Description: Inorganic pyrophosphatase
  misc_feature (1)..(206): Functional Homolog Of Ceres SEEDLINE ID no. ME19182 at SEQ ID NO: 1577
MANNDGEVTGKRAGWPPVLNERILSSMSRRSIAAHPWHDLEIGPGAPSVFNCVIEISKGSKVKYELDKASGLIKVDRVLYSSVVYPHNYGFIPRTLCEDSDPMDVLVLMQEPVLPGSFLRARAIGLMPMIDQGEKDDKIIAVCADDPEFVHYKDIKELPPHRLAEIRRFFEDCIHIHTNKKNENKKVDVEDFLPAASAIDAIKYSM

SEQ ID NO: 1597 - DNA, 956 bp, Arabidopsis thaliana
  misc_feature (1)..(956): Ceres CLONE ID no.124537
  misc_feature (1)..(956): Encodes the peptide sequence at SEQ ID NO 1598
atatatacattttacaatcacttgctagaccaacgggcttcacttgtttctctcccaaagtttcttcatcatccttgcgataaagaaaacaacaatcggctgtttcgtttcgatccaaagatgagtgaagaaactaaagataaccagaggctgcagcgaccagctcctcgtcttaacgagaggattctctcatccttgtcaagaagatccgtagctgctcatccatggcatgatcttgagattggacctggagctccacagattttcaatgtggttgttgagatcactaaaggaagcaaggtcaaatacgagcttgacaaaaagacaggactcatcaaggttgatcgtattctctactcatcagttgtgtaccctcacaactatggttttgttcctcgcacattgtgtgaagacaatgaccccattgatgtcttagtcatcatgcaggaacctgtgcttccgggttgttttctgcgtgccagagccattggattaatgcctatgattgaccagggtgaaaaagatgacaagatcattgcagtgtgtgttgatgatcctgaatataagcactacactgacatcaaagaacttcctcctcaccgtctctctgaaatccgtcgtttcttcgaagactacaagaaaaacgagaacaaggaagttgcagtgaatgattttctgccatctgagtctgcggttgaagctatccagtactcaatggacctctatgctgaatacattctccacaccctgaggcgttgaagcttctcctcagaagatttctgcatcatctatgtttctgttacttttcattgataataagaagcatatgatcctaattgatattacttttatctctgcattttttcttccttatcatttggtccttctgtaatttcgttttaaagaccctttcttggcattgaaatttttggtttaatttgtttgaagagttctac

SEQ ID NO: 1598 - protein, 212 aa, Arabidopsis thaliana
  misc_feature (1)..(212): Ceres CLONE ID no.124537
  misc_feature (1)..(212): Bit score of 544.8 for HMM based on sequences of FIGURE 55.
  misc_feature (50)..(204): Pfam Name: Pyrophosphatase Pfam Description: Inorganic pyrophosphatase
  misc_feature (1)..(212): Functional Homolog Of Ceres SEEDLINE ID no. ME19182 at SEQ ID NO: 1577
MSEETKDNQRLQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSESAVEAIQYSMDLYAEYILHTLRR

SEQ ID NO: 1599 - protein, 230 aa, Arabidopsis thaliana
  misc_feature (1)..(230): Public GI ID no.6715648
  misc_feature (1)..(230): Bit score of 512.4 for HMM based on sequences of FIGURE 55.
  misc_feature (50)..(170): Pfam Name: Pyrophosphatase Pfam Description: Inorganic pyrophosphatase
  misc_feature (1)..(230): Functional Homolog Of Ceres SEEDLINE ID no. ME19182 at SEQ ID NO: 1577
MSEETKDNQRLQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDCILFLQCSSLFISIDLSTNKKNENKEVAVNDFLPSESAVEAIQYSMDLYAEYILHTLRR

SEQ ID NO: 1600 - DNA, 907 bp, Arabidopsis thaliana
  misc_feature (1)..(907): Ceres CLONE ID no.1019906
  misc_feature (1)..(907): Encodes the peptide sequence at SEQ ID NO 1601
attttttgtttttgtccctttgaaacgaaagaagatccaaagatgagtgaagaagcatatgaagaaactcaggaatcaagtcaatctcctcgtccggttccaaaactgaacgagaggattctctcaacactatccaggagatctgtagctgcacatccatggcacgaccttgagattggtcctgaagctccattggtcttcaatgtggtggttgagatcacaaagggaagcaaagtgaaatatgaactcgacaaaaagaccggtcttatcaaggttgaccggatcttgtactcctccgttgtttatccacacaattacggattcatcccacggacattgtgtgaagacaacgatcctcttgatgtccttgtccttatgcaggaaccagtgcttcccggatgtttcctccgtgctagagccattggattaatgcccatgattgatcagggagagaaagacgacaaaatcatagccgtatgtgctgatgatccagagtacaaacatttcacagacatcaaacaactcgctcctcatcgtctccaagaaatccgccgtttcttcgaagactataagaagaacgagaacaagaaagtggctgtcaacgatttcttgccatcagagagtgcacatgaagctattcagtactccatggatctatacgctgagtatattctccacacgttgaggagatgaacaacaacaacaacatatgattctcttcgcagcatccgcatataaatatatttaaatggaatattattttacataattcataaccatatgattggctttttgcagttttttgttttgttttgttttctgtttgtttttttccttgtgatgatgcaattttgttcaattgtataatttgaaactggtaagatataatgacaaacgcagttttgcc

SEQ ID NO: 1601 - protein, 216 aa, Arabidopsis thaliana
  misc_feature (1)..(216): Ceres CLONE ID no.1019906
  misc_feature (1)..(216): Bit score of 538.2 for HMM based on sequences of FIGURE 55.
  misc_feature (54)..(208): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MSEEAYEETQESSQSPRPVPKLNERILSTLSRRSVAAHPWHDLEIGPEAPLVFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHFTDIKQLAPHRLQEIRRFFEDYKKNENKKVAVNDFLPSESAHEAIQYSMDLYAEYILHTLRR

SEQ ID NO: 1602 - protein, 216 aa, Arabidopsis thaliana
  misc_feature (1)..(216): Public GI ID no.26451240
  misc_feature (1)..(216): Bit score of 535.0 for HMM based on sequences of FIGURE 55.
  misc_feature (54)..(208): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MSEEAYEETQESSQSPRPVPKLNERILSTLSRRSVAAHPWHDLEIGPEAPLVFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHFTDIKQLAPHRLQEIRRFFENYKKNENKKVAVNDFLPSESAHEAIQYSMDLYAEYILHTLRR

SEQ ID NO: 1603 - protein, 216 aa, Arabidopsis thaliana
  misc_feature (1)..(216): Public GI ID no.21593570
  misc_feature (1)..(216): Bit score of 518.0 for HMM based on sequences of FIGURE 55.
  misc_feature (54)..(208): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MAPPIEVSTKSYVEKHVSLPTLNERILSSMSHRSVAAHPWHDLEIGPEAPIIFNCVVEIGKGSKVKYELDKTTGLIKVDRILYSSVVYPHNYGFIPRTLCEDSDPIDVLVIMQEPVIPACFLRAKAIGLMPMIDQGEKDDKIIAVCADDPEYRHYNDISELPPHRMAEIRRFFEDYKKNENKEVAVNDFLPATAAYDAVQHSMDLYADYVVENLRR

SEQ ID NO: 1604 - DNA, 1297 bp, Arabidopsis thaliana
  misc_feature (1)..(1297): Ceres CLONE ID no.40186
  misc_feature (1)..(1297): Encodes the peptide sequence at SEQ ID NO 1605
atattccaaaattaaagagaatttaatttattgttttccttccagaaaaatattaatattctttctaaactaaaaaatggagtcttcaaatagcacagaagcagagacatagagcgggaacgcgtttagtcacagctttcttctcctttagcttttctctctacacttgcttctctctctctctctcctttgggttatccttcttgagatctgtgcttgcgtttcttcttcattcgacgacactttatctcgggagatttcagatttgtcgatttgttcagcaatggcgccaccgattgaggtttctaccaaaagctacgttgagaaacatgtttcacttcctactcttaatgagaggatactttcgtccatgagtcacagatcagtagctgcacacccatggcatgatctcgagataggacctgaagccccaattatcttcaattgtgtggttgagataggaaaagggagcaaggtgaaatatgaactcgacaaaactacgggtctcattaaggtcgaccgtattctttactcatctgtcgtatacccacacaactatgggttcattccgcgtaccctttgtgaggacagtgaccctattgatgttcttgtcattatgcaggaaccggtgatcccagcatgctttcttcgggccaaagctattggtctgatgccaatgattgatcagggtgagaaagacgacaagatcattgctgtctgcgctgacgatccagagtatcgccattacaacgacatcagtgagcttccgcctcatcgtatggctgagatccgccgtttctttgaagactataagaaaaacgagaacaaggaagtagccgttaacgacttccttccggcaactgcagcctacgacgcagttcagcattccatggatctctatgcagactacgtcgtggagaacctaagacgttgaatcatcacctcaagcaatggaatgaaagctcacaactgcattattcacaaatataaatatacatataaatgtcaggcttctcaaaggatatatttgttgtgtatgtcctctgatgaatccggtagatgatgccgataattctttttttttttttgtcgtatgaaaccgataatcaaagactaaaacagggattttcctcatttgtggtcatcactttttaaattttggtgtcatttctcatcttaatcaatttgtttttgagttttattcttctattagatcttttatacatcaaagaatagatgaagattccaccctaaaaccttatagtatgtcatttattcacaatatgttatacgtgtt

SEQ ID NO: 1605 - protein, 216 aa, Arabidopsis thaliana; identical to SEQ ID NO: 1603
  misc_feature (1)..(216): Ceres CLONE ID no.40186
  misc_feature (1)..(216): Bit score of 518.0 for HMM based on sequences of FIGURE 55.
  misc_feature (54)..(208): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577

SEQ ID NO: 1606 - DNA, 993 bp, Brassica napus
  misc_feature (1)..(993): Ceres CLONE ID no.968096
  misc_feature (1)..(993): Encodes the peptide sequence at SEQ ID NO 1607
gtactactgtaacttctcttctgcataagagagagagagagagagaagaaagaaaaaagattacgtaacggaatctcttcttccgtttcccgattgaatcttgaaactgcatcttgagcatttcgaaatggctgataacaaggatggagtaacccccaagagctctgccgctttccctctgaggaaccctaacgttactcttaacgagaggaatttcgcagccttcacaaacagatcagctgctgctcatccatggcacgacttggagattggcccggaagctcctgcagttttcaactgtgttgttgaaattagcaaaggtggcaaggtgaagtacgagctagacaagaacagtggccttattaaggttgatcgtgttctgtactcatccattgtgtacccacacaactacggcttcattccccgaaccatttgtgaggacagtgaccctattgatgtcctggtactcatgcaggagcctgtgctgactggatcgttcctccgtgcccgtgctattggtttaatgcccatgattgatcagggtgaaaaagacgacaagatcattgcagtctgcgctgatgatccagagttccgtcactacagagacatcaaagagcttcctcctcaccgtctagctgagatccgccgcttcttcgaagactacaagaagaacgagaacaagaaagttgctgttgaaggtttcctccctgctcaagctgccatcgacgcaattaaggactccatggatctttacgcagcttacatcaaagctggcctgcagcgttaatgaataaacctcggtcgagcctgttcctccgggtttgattcggtttcactatcactgaggccttcttatactacattgcatgttaaacttggtacatttttgcaatgtacattgaaaaactttgtcgaatcggaagctttctgatgatgacgattgagaattccaattttagtcactaaatttggagattcatattagctctttcc

SEQ ID NO: 1607 - protein, 219 aa, Brassica napus
  misc_feature (1)..(219): Ceres CLONE ID no.968096
  misc_feature (1)..(219): Bit score of 502.4 for HMM based on sequences of FIGURE 55.
  misc_feature (57)..(211): Pfam Name: Pyrophosphatase Pfam Description: Inorganic pyrophosphatase
  misc_feature (1)..(219): Functional Homolog Of Ceres SEEDLINE ID no. ME19182 at SEQ ID NO: 1577
MADNKDGVTPKSSAAFPLRNPNVTLNERNFAAFTNRSAAAHPWHDLEIGPEAPAVFNCVVEISKGGKVKYELDKNSGLIKVDRVLYSSIVYPHNYGFIPRTICEDSDPIDVLVLMQEPVLTGSFLRARAIGLMPMIDQGEKDDKIIAVCADDPEFRHYRDIKELPPHRLAEIRRFFEDYKKNENKKVAVEGFLPAQAAIDAIKDSMDLYAAYIKAGLQR

SEQ ID NO: 1608 - protein, 228 aa, Malus x domestica
  misc_feature (1)..(228): Public GI ID no.6752884
  misc_feature (1)..(228): Bit score of 519.3 for HMM based on sequences of FIGURE 55.
  misc_feature (66)..(198): Pfam Name: Pyrophosphatase Pfam Description: Inorganic pyrophosphatase
  misc_feature (1)..(228): Functional Homolog Of Ceres SEEDLINE ID no. ME19182 at SEQ ID NO: 1577
MAPPIETVQKVQPPPNAIEPHVTYHHDHSSHPPLNERILSSMTRRSIAAHPWHDLEIGPGAPKIFNCVIEIPKGSKVKYELDKKTGLIKGDRILDSSVVYPHNYGFIPRTLCEDNDPLGCLDIMQEPVVPGCFLRAKAIGLMPMIDQGEKDDQIIAVCADDPEYRHYNDIKELPPHRLAEIRRFFEDYKKNENKEVAVDDFLPASTAFDAIQHSMNLYADYIVESLRR

SEQ ID NO: 1609 - protein, 216 aa, Arachis hypogaea
  misc_feature (1)..(216): Public GI ID no.47775656
  misc_feature (1)..(216): Bit score of 526.1 for HMM based on sequences of FIGURE 55.
  misc_feature (54)..(177): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MSPPIESPAKVAITQHSKPPPLNERIISSMTRRSVAAHPWHDLEIGPEAPKIFNCVVEIGKGSKVKYELDKKTGLIKVDRVLYSSVVYPHNYGFIPRTICEDSDPMDVLVIMQEPVLPGCFLRAKAIGLMPMIDQGEKDDKIIAVCADDPEYRHYNDIKELPPHRLAEIRRFFEDYKKNENKEVEVHDFLLATTAMRAIKHSMTLYADYIVESLRR

SEQ ID NO: 1610 - DNA, 953 bp, Glycine max
  misc_feature (1)..(953): Ceres CLONE ID no.1020799
  misc_feature (1)..(953): Encodes the peptide sequence at SEQ ID NO 1611
acacgcgctctaccgttttctttgccttgttatttggctttctccacactttccgcaagactgttctgttcttgaaacatccgttgttccaagatgagtgaagaagtgaaagagaatcaatctgacaagcttcagagaacagctccacgtttgaacgagaggatactctcatctttatcaaggaaatcggttgctgctcatccatggcatgatcttgaaatcggacctggagctccgtcgatcttcaatgtggttattgagatctcaaaaggtagcaaggtcaaatatgaacttgacaaaaagacaggactcatcaaggttgatcggattctatattcatcggtcgtgtatcctcataactacggttttatcccccgcacattatgtgaagacaatgaccctttagatgtgttagtcatcatgcaggagcctgtgcttccaggttgtttcctgcgcgcacgagctatcggattaatgcctatgattgatcagggagaaaaagatgacaagatcattgcggtttgtgttgatgatcctgagtataagcattacactgacatcaaagaacttccacctcatcgtctctcagaaatccggcgattctttgaagattacaagaagaatgagaacaaggaagtcgctgtaaatgattttcttccgaatggtcctgccgttgaagccattcagtactcaatggacctttacgctgagtacattcttcacaccctgaggagataaaacaagaacattcctgccaaattttttgctctgcaaatctcagattttgtagcagaggaaaaagaaaacaaaacaagaatttgtctgatatttggattttgaataaacacgtgttcctgacactgttctaatacttggcttcatagcttgttgttgttgttgtcttctggggatctgctgtctggacaattacccctactaagatttgttttctc

SEQ ID NO: 1611 - protein, 214 aa, Glycine max
  misc_feature (1)..(214): Ceres CLONE ID no.1020799
  misc_feature (1)..(214): Bit score of 539.9 for HMM based on sequences of FIGURE 55.
  misc_feature (52)..(185): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MSEEVKENQSDKLQRTAPRLNERILSSLSRKSVAAHPWHDLEIGPGAPSIFNVVIEISKGSKVKYELDKKTGLIKVDRILYSSVVYPHNYGFIPRTLCEDNDPLDVLVIMQEPVLPGCFLRARAIGLMPMIDQGEKDDKIIAVCVDDPEYKHYTDIKELPPHRLSEIRRFFEDYKKNENKEVAVNDFLPNGPAVEAIQYSMDLYAEYILHTLRR

SEQ ID NO: 1612 - DNA, 845 bp, Glycine max
  misc_feature (1)..(845): Ceres CLONE ID no.1057283
  misc_feature (1)..(845): Encodes the peptide sequence at SEQ ID NO 1613
gtttcgatttatagacctttgccttttgcattttacacaccaacaacgcgcttcactctagtttctcccttttcgattccaaaagatgagtgaagagcagcagcgacctgcgcctcgtctgaacgagaggatcctctcttccttgtccagacgttccgttgctgctcatccttggcatgatcttgagattggacctggagctccccagattttcaatgttgtcgttgagattacaaagggaagcaaagtcaaatatgaacttgacaaaaagactggactcatcaaggttgatcgtattctctactcatcagttgtttacccacacaactatggtttcgttcctcgcacattgtgtgaagacaatgaccctattgatgttttagtcatcatgcaggaacctgtgcttcctggttgttttctacgtgctcgtgctattggattaatgcctatgattgaccagggtgagaaagatgacaagatcatagcagtctgtgttgatgatcctgagtacaagcattacactgacatcaaagaacttcctcctcaccgtctctctgagatccgtcgtttctttgaagactacaagaagaacgagaacaaggaagttgcggttaatgattttctgccatctgagaatgctattgaagctatccagtactctatggacctctatgcggagtacattctccataccctgagacgttgaagcttcttctcctcagaacatctcttgcaacatcttggtttctgtttacctttttatctttaattgatacttcctctgcattttcttgtaagactttggatctttcatttgtccttgtcaactcattacgattgaatct

SEQ ID NO: 1613 - protein, 206 aa, Glycine max
  misc_feature (1)..(206): Ceres CLONE ID no.1057283
  misc_feature (1)..(206): Bit score of 548.5 for HMM based on sequences of FIGURE 55.
  misc_feature (44)..(198): Pfam Name: Pyrophosphatase Pfam Description: Inorganic pyrophosphatase
  misc_feature (1)..(206): Functional Homolog Of Ceres SEEDLINE ID no. ME19182 at SEQ ID NO: 1577
MSEEQQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSENAIEAIQYSMDLYAEYILHTLRR

SEQ ID NO: 1614 - DNA, 922 bp, Glycine max
  misc_feature (1)..(922): Ceres CLONE ID no.472312
  misc_feature (1)..(922): Encodes the peptide sequence at SEQ ID NO 1615
ggatctctttaccttcttccaaagtatttgcttttattttttgttgaaaaaagtgtttgcttttgccgttgtacaagatgagtgatgagaataatgaagaaccttgcgaaaaccgtccggttccccgtttaaatgaaaggattctttcatctttgtctaggagatcagttgctgctcacccttggcatgatcttgaaattggacctggagcgcctatgattttcaattgtgttgtggagatcactaagggaagcaaggtcaaatacgaacttgacaaaaagactggattaattaaggttgatcgggttttgtactcatcagttgtttatcctcataactatggtttcatcccaagaactctgtgtgaagacaatgatccaattgatgtcttggttctcatgcaggagccagttcttcctggttgtttcctgcgagccagggccattggattgatgcctatgattgaccagggggagaaggatgataaaattattgcagtatgtgctgatgatccagaatataagcactatactgacttcaaagaacttccacctcatcgcctcatggagattcgccgcttctttgaagattacaagaagaatgagaacaaggaggtagcagttaatgattttctacctgcatccactgccgttgaatccatccagtactcaatggatctttatgcggagtatattctgcataccttaaggcgatagacaagaatactatactccacaaatcagaataagctgcagcactctagatggtttttgaatacattttgatgaaactttaattatattgtattttgtattgagttggataatatataacagttgtttgttttactaagtgaagaaaaatccataaactgtaatgcttcatgattgatatttattcttatataattcagctttcaatc

SEQ ID NO: 1615 - protein, 212 aa, Glycine max
  misc_feature (1)..(212): Ceres CLONE ID no.472312
  misc_feature (1)..(212): Bit score of 542.1 for HMM based on sequences of FIGURE 55.
  misc_feature (50)..(204): Pfam Name: Pyrophosphatase Pfam Description: Inorganic pyrophosphatase
  misc_feature (1)..(212): Functional Homolog Of Ceres SEEDLINE ID no. ME19182 at SEQ ID NO: 1577
MSDENNEEPCENRPVPRLNERILSSLSRRSVAAHPWHDLEIGPGAPMIFNCVVEITKGSKVKYELDKKTGLIKVDRVLYSSVVYPHNYGFIPRTLCEDNDPIDVLVLMQEPVLPGCFLRARAIGLMPMIDQGEKDDKIIAVCADDPEYKHYTDFKELPPHRLMEIRRFFEDYKKNENKEVAVNDFLPASTAVESIQYSMDLYAEYILHTLRR

SEQ ID NO: 1616 - DNA, 1112 bp, Glycine max
  misc_feature (1)..(1112): Ceres CLONE ID no.724767
  misc_feature (1)..(1112): Encodes the peptide sequence at SEQ ID NO 1617
agttgagtatcctttttcttattcctttgcacttttatttgtgctcgttcttcttctttcctttacacagaacaatagtagcaagcagagccccaagatctgtgcttgaaccttcacttgtgtttccttccttctgcagacgagcttcaccttgcgccgaagggccacagatggttgaaaccgatatggatgccgaaactgttgcaaatgtggttccaccaaaggagactccaaacagtgttcccatctcttatcattcctcacactcacaccctcctcttaatgagaggattatttcatccatgaccagaagatctgttgctgcacacccgtggcacgaccttgagatagggcctggtgctccaacgatcttcaattgtgtgattgagattgggaaagggagcaaggtgaaatatgaactggacaaaaaatcgggtcttatcaagatcgaccgtgttctttactcatcagttgtgtatcctcacaattatgggtttatcccacgtactatttgtgaggacagtgatcccctggatgtcttgattattatgcaggagccggttcttccaggttgctttcttcgggccaaagcaattggtctcatgcccatgattgatcagggggagaaagatgataagataattgctgtctgtgctgatgatcccgagtatcgacattacaatgatatcaaggagcttcctccacatcgtttagctgaaattcgtcgtttttttgaagactacaagaagaatgaaaacaaggaagtcgcagtaaacgactttttgcctgcctcagctgctttcgaagcggttaatagatccatgagcttgtatgcggactacatagtggagagcttgagacggtagtcgttgatgaatgatgcacgtcaaggatttttaactgacggaccaatggaagatgtttgcttgaaaaaaggctgcattatcaatattatgtaggaataaaaaaaaacattttactttagctgcctcttagctcatgcatgttctacaaactgtgcttaatttcaaatatgtcatccctgcaatatcaaatttacctgcctcttatagcacatgcacaatccaatatcaaatgttttaatcttgtat

SEQ ID NO: 1617 - protein, 231 aa, Glycine max
  misc_feature (1)..(231): Ceres CLONE ID no.724767
  misc_feature (1)..(231): Bit score of 519.9 for HMM based on sequences of FIGURE 55.
  misc_feature (69)..(202): Pfam Name: Pyrophosphatase Pfam Description: Inorganic pyrophosphatase
  misc_feature (1)..(231): Functional Homolog Of Ceres SEEDLINE ID no. ME19182 at SEQ ID NO: 1577
MVETDMDAETVANVVPPKETPNSVPISYHSSHSHPPLNERIISSMTRRSVAAHPWHDLEIGPGAPTIFNCVIEIGKGSKVKYELDKKSGLIKIDRVLYSSVVYPHNYGFIPRTICEDSDPLDVLIIMQEPVLPGCFLRAKAIGLMPMIDQGEKDDKIIAVCADDPEYRHYNDIKELPPHRLAEIRRFFEDYKKNENKEVAVNDFLPASAAFEAVNRSMSLYADYIVESLRR

SEQ ID NO: 1618 - DNA, 1122 bp, Glycine max
  misc_feature (1)..(1122): Ceres CLONE ID no.1045495
  misc_feature (1)..(1122): Encodes the peptide sequence at SEQ ID NO 1619
gtcaaatggattggttatagagtttttaagtcgtaattgcagacattcatcttttgtgacggtgcttttggtgaaattattttgtttttgcaatttttgtattagtttacgcgacaaatggattgattatcgacttgttattgtattaattttcggacactgttcttttgggtgattcttgaaagagtgtagaaatggctccaccaattgagaccccaaccaaggtttccagctatcagcactccccaaaccctcgtcttaacgagaggattctttcatccatttccaggaaacatgttgctgctcacccgtggcatgatcttgagataggacctgaagctccaaagatcttcaactgtgtggttgaaattgggaaaggaagtaaggtgaaatatgaacttgacaaaagaactggtcttattatggttgatcgtatcctttactcatcggttgtgtatcctcacaactatgggtttatcccacgtactatttgtgaggacggtgatcccatggatgtcttggttatcatgcaggagccagttcttccaggttgctttctacgggccaaagctattggactcatgcctatgattgatcagggtgagaaagatgacaagataattgctgtctgtgctgatgatcctgagtataggcattacaatgatatcaaggaccttcctcctcaccgtttagctgaaattcgtcgtttctttgaagattacaagaagaatgagaacaaggaagttgcagtgaacgactttcttcctgcttcagctgcctatgaagctatcaagcattccatgaccttatatgcggaatacgttgtggagaacttgaggcggtagagcttgaaattttgtttggttgtgaagacatacatgctttcaaaggctgctattataattgcgattatgacgataagaaaacctttctatccttgtcgcgtgtgcatttggtctcagggctggcaacatgcatattctgcacatgtgcttaattttgagtgaatgatttttatttatttattaatatcaaagttttaatgttgtagctcaatctaccaaatatttggagcatatgggattcctatatatcttatatatatacataaaacatttttac

SEQ ID NO: 1619 - protein, 216 aa, Glycine max
  misc_feature (1)..(216): Ceres CLONE ID no.1045495
  misc_feature (1)..(216): Bit score of 523.0 for HMM based on sequences of FIGURE 55.
  misc_feature (54)..(187): Pfam Name: Pyrophosphatase Pfam Description: Inorganic pyrophosphatase
  misc_feature (1)..(216): Functional Homolog Of Ceres SEEDLINE ID no. ME19182 at SEQ ID NO: 1577
MAPPIETPTKVSSYQHSPNPRLNERILSSISRKHVAAHPWHDLEIGPEAPKIFNCVVEIGKGSKVKYELDKRTGLIMVDRILYSSVVYPHNYGFIPRTICEDGDPMDVLVIMQEPVLPGCFLRAKAIGLMPMIDQGEKDDKIIAVCADDPEYRHYNDIKDLPPHRLAEIRRFFEDYKKNENKEVAVNDFLPASAAYEAIKHSMTLYAEYVVENLRR

SEQ ID NO: 1620 - DNA, 884 bp, Glycine max
  misc_feature (1)..(884): Ceres CLONE ID no.1609390
  misc_feature (1)..(884): Encodes the peptide sequence at SEQ ID NO 1621
cagtcaccatctccgactctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattctttactcatcagttgtctacccacacaactatggttttatcccaagaaccatttgtgaagacagtgatcctatggacgtgctggttctaatgcaggaacccgtgcttcctggttccttccttcgtgctcgtgctattggactaatgcctatgattgaccagggtgagagggatgacaagatcatagcagtttgtgctgatgaccctgagttccgccattacactgacatcaatgagcttcctccacatcggcttgctgaaatcagaagattctttgaggactacaagaagaatgagaacaaaatagttgatgttgaagactttctaccggctgaagctgccattgatgccatcaattactccatggacttgtatgctgcttacatagttgagagcttaaggcactaacttctttagaaactgaatagccaatttcagtgatctccaactaaatatgtaaaatgtgaatgaaactccataaacattgtgatttccgtgctgttctgtgatgcactagtgctgcctcggttattgacacaacagtgtctaaaacttctgctttggatgcggttgtactgccccccaataatgagttcatttctagtattg

SEQ ID NO: 1621 - protein, 213 aa, Glycine max
  misc_feature (1)..(213): Ceres CLONE ID no.1609390
  misc_feature (1)..(213): Bit score of 512.1 for HMM based on sequences of FIGURE 55.
  misc_feature (51)..(174): Pfam Name: Pyrophosphatase Pfam Description: Inorganic pyrophosphatase
  misc_feature (1)..(213): Functional Homolog Of Ceres SEEDLINE ID no. ME19182 at SEQ ID NO: 1577
MAHLEDSSAWNSSIPHPKLNERILSSLSRRTVAAHPWHDLEIGPGAPAVFNCVVEIGKGSKVKYELDKTSGLIKVDRILYSSVVYPHNYGFIPRTICEDSDPMDVLVLMQEPVLPGSFLRARAIGLMPMIDQGERDDKIIAVCADDPEFRHYTDINELPPHRLAEIRRFFEDYKKNENKIVDVEDFLPAEAAIDAINYSMDLYAAYIVESLRH

SEQ ID NO: 1622 - protein, 219 aa, Medicago truncatula
  misc_feature (1)..(219): Public GI ID no.87240865
  misc_feature (1)..(219): Bit score of 537.5 for HMM based on sequences of FIGURE 55.
  misc_feature (57)..(190): Pfam Name: Pyrophosphatase Pfam Description: Inorganic pyrophosphatase
  misc_feature (1)..(219): Functional Homolog Of Ceres SEEDLINE ID no. ME19182 at SEQ ID NO: 1577
MSEHDQEVQEVQENVQEIHRPVPRLNERILSSLSRRSVAAHPWHDLEIGPGAPHIFNCVVEITKGSKVKYELDKKTGLIKVDRILYSSVVYPHNYGFIPRTLCEDNDPIDVLVLMQEPVLPGCFLRARAIGLMPMIDQGEKDDKIIAVCADDPEYKHFTDYKELAPHRIMEIRRFFEDYKKNENKEVAVNDFLPPSTAVEAIQYSMDLYAEYILHTLRR

SEQ ID NO: 1623 - protein, 211 aa, Solanum tuberosum
  misc_feature (1)..(211): Public GI ID no.2500047
  misc_feature (1)..(211): Bit score of 539.7 for HMM based on sequences of FIGURE 55.
  misc_feature (49)..(203): Pfam Name: Pyrophosphatase Pfam Description: Inorganic pyrophosphatase
  misc_feature (1)..(211): Functional Homolog Of Ceres SEEDLINE ID no. ME19182 at SEQ ID NO: 1577
MSNENDDLSPQRRAPRLNERILSSISRRSVAAHPWHDLEIGPEAPSVFNVVIEISKGSKVKYELDKKTGLIKVDRILYSSVVYPQNYGFIPRTLCEDNDPMDVLVLMQEPVLPGCFLRARAIGLMPMIDQGEKDDKIIAVCADDPEYRHYTDIKQLPPHRLAEIRRFFEDYKKNENKDVAVDDFLPPNSAVNAIQYSMDLYAEYILHSLRK

SEQ ID NO: 1624 - protein, 211 aa, Solanum tuberosum
  misc_feature (1)..(211): Public GI ID no.118185007
  misc_feature (1)..(211): Bit score of 537.4 for HMM based on sequences of FIGURE 55.
  misc_feature (49)..(172): Pfam Name: Pyrophosphatase Pfam Description: Inorganic pyrophosphatase
  misc_feature (1)..(211): Functional Homolog Of Ceres SEEDLINE ID no. ME19182 at SEQ ID NO: 1577
MSNENDDLSPQRRAPRLNERILSSISRRSVAAHPWHDLEIGPEAPSVFNVVIEISKGSKVKYELDKKTGLIKVDRILYSSVVYPQNYGFIPRTLCEDNDPMDVLVLMQEPVLPGCFLRARAIGLMPMIDQGEKDDKIIAVCADDPEYRHYTDIKQLPPHRLVEIRRFFEDYKKNENKDVAVDDFLPPSSAVNAIQYSMDLYAEYILHSLRK

SEQ ID NO: 1625 - protein, 217 aa, Solanum tuberosum
  misc_feature (1)..(217): Public GI ID no.2706450
  misc_feature (1)..(217): Bit score of 487.8 for HMM based on sequences of FIGURE 55.
  misc_feature (54)..(188): Pfam Name: Pyrophosphatase Pfam Description: Inorganic pyrophosphatase
  misc_feature (1)..(217): Functional Homolog Of Ceres SEEDLINE ID no. ME19182 at SEQ ID NO: 1577
MVPPIETQVKSPVSQKFSIPPLNERILSSMTRRSVAAHPWHDLEIEPDAPQIFNVVIEISKGSKVKYELDKKTGLIKVDRVLYSSVVYPHNYGFIPRTLCEDSDPLDVLVIMQEPITSGLDFLRAKAIGVMPMIDQGEKDEKIIAVCADDPEYKDYADINELPPHRLAEIRRFFEDYKKNENKEVAVNDFLPSDKAFEAVQHSQDLYADYIVESLRR

SEQ ID NO: 1626 - DNA, 1093 bp, Triticum aestivum
  misc_feature (1)..(1093): Ceres CLONE ID no.705340
  misc_feature (1)..(1093): Encodes the peptide sequence at SEQ ID NO 1627
tcaccacaaacagctgatctgagtccacagcagagcaccattcttctcttccattctactcaacgcaaagtctcccgctgatcagatcgagcgctaggctgtcagatccatccatggccccctcccaagaagtcgccgccgccaccaaggagccgtccaccaacggcaacgggacacaggccgccgccgccccgaagaccaagacgccggcgctgaacgagcggatcctctcctccatcacccgccggtcggtggcggcgcacccgtggcacgacctggagatcggcccggacgcgcccacaatcttcaactgcgtgatcgagatccccaaggggagcaaggtcaagtacgagctggacaagaagacggggctcatcaaggtggaccgcgtgctctactcctccgtcgtctacccgcacaactacggcttcatcccgcgcaccctctgcgacgactccgaccccatcgacgtcctcgtcatcatgcaggagcccgtcgtccccgggtgcttcctccgggccaaggccatcggcctcatgcccatgatcgaccagggcgaggccgacgacaagatcatcgccgtctgcgccgacgaccccgagtaccgccacttcaacgacatcaaggagctgcccccgcaccgcctcgccgagatcagaagattcttcgaggactacaagaagaacgagaacaaggaggtggccgtcaacgacttcctgccgtcagaggacgcctacgaggccatccagcactccatggatctctatgccacctacatctgcgagggcctgagaaggtagatgatagatccggtgacgccatgccgcttgctgcaggatcgatgttgacgaaaaattactcgtgtcgagagcgttacctagctcatacaagtcataaacatacatacatacattcttgttttgtgttacctacctgcatacacaaatacacatactagtatatgatctgatcgcccaaagccttgcattaaggcagtagcagccagataaacagggcattctttccccagctaccttatgtaatacgatttcctggctgaatgaatatgagatgttggtatactttttccctg

SEQ ID NO: 1627 - protein, 228 aa, Triticum aestivum
  misc_feature (1)..(228): Ceres CLONE ID no.705340
  misc_feature (1)..(228): Bit score of 533.1 for HMM based on sequences of FIGURE 55.
  misc_feature (66)..(220): Pfam Name: Pyrophosphatase Pfam Description: Inorganic pyrophosphatase
  misc_feature (1)..(228): Functional Homolog Of Ceres SEEDLINE ID no. ME19182 at SEQ ID NO: 1577
MAPSQEVAAATKEPSTNGNGTQAAAAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRR

SEQ ID NO: 1628 - DNA, 1070 bp, Triticum aestivum
  misc_feature (1)..(1070): Ceres CLONE ID no.1319476
  misc_feature (1)..(1070): Encodes the peptide sequence at SEQ ID NO 1629
accacaacacggcacagccgctgagtccacagcagagcagagcagcattcttctcttccattctactcaacgcaaagtctctctatctcagatcagatcagatcagatcgagcgctaggctgtaagatccaaccatggccccctcacaggaagtcgcggcccccgccgccaaggagccatccgccaacggcaacgggaccaacggcacgcccgcagccgcccccaagaccaaggccccggcgctgaacgagcggatcctctcctccatcacccgccgctccgtcgccgcccacccgtggcacgacctggagatcggcccggacgcgcccacaatcttcaactgcgtgatcgagatccccaaggggagcaaggtcaagtacgagctggacaagaagacggggctcatcaaggtggaccgggtgctctactcctccgtcgtctacccgcacaactacggcttcatcccgcgcaccctctgcgacgactccgaccccatcgacgtcctcgtcatcatgcaggagcccgtcgtccccggatgcttcctccgcgccaaggccatcggactcatgcccatgatcgaccagggcgaggccgacgacaagatcatcgccgtctgcgccgacgaccccgagtaccgccacttcaacgacatcaaggagctccctccccaccgcctcgccgagatcaggcgtttcttcgaggactacaagaagaacgagaacaaggaggtggccgtcaacgacttcctgccgtcggaggacgcctacgaggccatccagcactccatggatctctatgccacctacatttgcgagggcctgagaagatagatagatccggtgatgccgccccgcttgctggaggatgttgatgaaaaattactcgtgtcgagagcgaacatacatacattcttgttttcagttacctacctgcatacatacacatactagtatatgatatgatcgcccaaagccttgcgttaaggcagtagcagccagataaacagggcattcttttcccaactaccttatgtaatacgatttcctggctgaatgaatatgagatgttgg

SEQ ID NO: 1629 - protein, 231 aa, Triticum aestivum
  misc_feature (1)..(231): Ceres CLONE ID no.1319476
  misc_feature (1)..(231): Bit score of 533.8 for HMM based on sequences of FIGURE 55.
  misc_feature (69)..(223): Pfam Name: Pyrophosphatase Pfam Description: Inorganic pyrophosphatase
  misc_feature (1)..(231): Functional Homolog Of Ceres SEEDLINE ID no. ME19182 at SEQ ID NO: 1577
MAPSQEVAAPAAKEPSANGNGTNGTPAAAPKTKAPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRR

SEQ ID NO: 1630 - DNA, 892 bp, Triticum aestivum
  misc_feature (1)..(892): Ceres CLONE ID no.639389
  misc_feature (1)..(892): Encodes the peptide sequence at SEQ ID NO 1631
gttcttctgctggtcatttatatccgtcatccgactcgatccttatcgaaatttgtgggattgtaggacaatggcggaaggcaagaaggatgctccgaagctgaaccagcggatggtatcatctctctcgaagcgaactgctgcggcacattcttggcatgatctggagataggacctgaagcccctctaatcttcaatgccgttgttgagatcacaaaggggagcaaagtcaagtatgaacttgacaagaagactgggatgataaaggttgacaggattctgtactcgtccgtagtctacccacataactacggtttcgtaccacggacgctgtgtgaagatggagatccaattgacgtcttggtcctgatgcaggaaccagtcatacctggttgctttcttcgagctaaggctattgggcttatgcccatgattgatcagggtgagaaagatgataagctcattgctgtttgcgttgatgatcccgagtaccgtcatctcaacgaccttaaggagctctctccccaccgccttgctgaaatccgtcgcttcttcgaagattacaagaagaatgagaacaaggaggttgctgtgaacgacttcttgccaccggagactgcacaggccgccattaagcactccatggacctatatgcagaatatatactgcagagtctgaagaactaatcgtggtagcaaacttgcaaggctgcagaaaccacccacatggtctcgtaagaggacaataatcgactacatggcttttatttaagggcccatttttctatatatttaaataatgggaaatgctattcccatacgtatttttctgcagaacattgtaatcaaggactaatgttatacttgtgcatagtgtttcataatatttgg

SEQ ID NO: 1631 - protein, 205 aa, Triticum aestivum
  misc_feature (1)..(205): Ceres CLONE ID no.639389
  misc_feature (1)..(205): Bit score of 502.0 for HMM based on sequences of FIGURE 55.
  misc_feature (43)..(176): Pfam Name: Pyrophosphatase Pfam Description: Inorganic pyrophosphatase
  misc_feature (1)..(205): Functional Homolog Of Ceres SEEDLINE ID no. ME19182 at SEQ ID NO: 1577
MAEGKKDAPKLNQRMVSSLSKRTAAAHSWHDLEIGPEAPLIFNAVVEITKGSKVKYELDKKTGMIKVDRILYSSVVYPHNYGFVPRTLCEDGDPIDVLVLMQEPVIPGCFLRAKAIGLMPMIDQGEKDDKLIAVCVDDPEYRHLNDLKELSPHRLAEIRRFFEDYKKNENKEVAVNDFLPPETAQAAIKHSMDLYAEYILQSLKN

SEQ ID NO: 1632 - DNA, 1042 bp, Triticum aestivum
  misc_feature (1)..(1042): Ceres CLONE ID no.1033015
  misc_feature (1)..(1042): Encodes the peptide sequence at SEQ ID NO 1633
acgcctcaaagttaatatcgcggcatcgggtcctgcgctgcgcgcctgctgctgctccctcgccctcgcctccgctgccgtcgcgcgagatcaaccccgccgccatggctggagaagctgatgggaagacctaccaggtatcaaggatgccccctgctgctctcaacgagcgcatcctttcttccatgtctcaaaagcacgttgctgctcacccatggcatgacctggagataggtccaggggcccctgcagttttcaactgtgtggttgagattcctagaggcagcaaggttaagtatgagttggacaaagcaactggtcttatcaaggttgatcgtgttctgtactcctcagttgtgtacccacacaactatggcttcattccacgcacactctgtgaggataatgacccgatggatgtccttgtcctgatgcaggaacaagttgttcctggttgcttcctgcgtgcccgtgctattgggcttatgcctatgattgatcagggtgagaaagatgacaagatcatagctgtctgtgctgatgatcctgagtaccgtcacttcagagacatcagtgaacttcccccgcatcgcctacaggaaatccgtcgcttctttgaagactacaagaagaatgaaaacaaggaggttgcagtgaatgatttcctcccagcagaagatgccatcaacgcaatcaagtactcgatggacctctacggttcgtacatcatggagggcttaaggaagtgatctccagttggcggactgcggatgctacgcgatccgccctacggcttatcaatagtacgacaaacatctatgttaacatgatgatcgaaaaccatcagtctgttggggatctatatataccttctgtccatgctgagtcaagcatgggtacattttccttccgtatatgccatgtcaggtccaagtatttgacctcttgctggaaccttttttgtcaaaccgtctcttgacagagcggctgcttaataggaaatcagcgttacgcgaaggcgcgtatgcgtgcctccagtcct

SEQ ID NO: 1633 - protein, 214 aa, Triticum aestivum
  misc_feature (1)..(214): Ceres CLONE ID no.1033015
  misc_feature (1)..(214): Bit score of 513.7 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MAGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHFRDISELPPHRLQEIRRFFEDYKKNENKEVAVNDFLPAEDAINAIKYSMDLYGSYIMEGLRK

SEQ ID NO: 1634 - DNA, 1107 bp, Triticum aestivum
  misc_feature (1)..(1107): Ceres CLONE ID no.1327670
  misc_feature (1)..(1107): Encodes the peptide sequence at SEQ ID NO 1635
aaatgagcagcaaaaggagcgcagcgagcagcagtgcacagcagagaagcggcgggaagtacgatacgatccgaacgcgtctcgcctactctgcttcctctgctccccggctagctagggtttgctccctcgccgccggcgcgcgtggccgtctgaagcagatccatcccatcccaggtttttgtgatggctcccgctattgaagcagcagagaaggtcaaggtggcaagcgcacctgttaaggctcctgttcttaatgaaagaacactatcatccatgacccggagacctggttcagcgcattcttggcatgatcttgaaataggccctgatgcaccaactatcttcaactgtgtcattgagatacctaggggcagcaaggttaaatatgaacttgacaagaaaactggactgataatggtggaccgcgtgctttattcatcagtggtgtaccctcacaactatggattcattccccgcacactgtgcgatgacagtgatccgatggatgtgctagttattatgcaggagccagttgtgccgggctgtttcctccgtgcaaaggcgatcggcctcatgcctatgattgaccagggagaagcagatgataagatcattgcagtgtgcgctgacgaccctgaatacaagcatttcaatgatatcaaggagctcccacctcaccggttggctgaaatcagacgcttctttgaggactacaagaagaatgagaacaaggaggtcgctgtgaacgactttctgccggcgactgctgcttacgaggccattcagcattccatggatctgtatgctacttacgtcgtggagggcctgcggaggtaggctgctgcccggaggttcggctcgacgcgctgctccttgtcgtcggggccgggacgatgttggcgaaaaccggagaatgagacactgtcaccttacgaactaagtactgttattttgttggtgttggcatatgtaccactggttcttatgaccttgaatgtactagtagttagcacaagaaagagtggcgcaatattcttttgtggcctcggtgcccctatgttgttaccttcatgttgattctcttgacgattcaagtcaggcatg

SEQ ID NO: 1635 - protein, 217 aa, Triticum aestivum
  misc_feature (1)..(217): Ceres CLONE ID no.1327670
  misc_feature (1)..(217): Bit score of 507.5 for HMM based on sequences of FIGURE 55.
  misc_feature (55)..(209): Pfam Name: Pyrophosphatase Pfam Description: Inorganic pyrophosphatase
  misc_feature (1)..(217): Functional Homolog Of Ceres SEEDLINE ID no. ME19182 at SEQ ID NO: 1577
MAPAIEAAEKVKVASAPVKAPVLNERTLSSMTRRPGSAHSWHDLEIGPDAPTIFNCVIEIPRGSKVKYELDKKTGLIMVDRVLYSSVVYPHNYGFIPRTLCDDSDPMDVLVIMQEPVVPGCFLRAKAIGLMPMIDQGEADDKIIAVCADDPEYKHFNDIKELPPHRLAEIRRFFEDYKKNENKEVAVNDFLPATAAYEAIQHSMDLYATYVVEGLRR

SEQ ID NO: 1636 - DNA, 935 bp, Zea mays
  misc_feature (1)..(935): Ceres CLONE ID no.1430456
  misc_feature (1)..(935): Encodes the peptide sequence at SEQ ID NO 1637
acgcgctttactgttctttcttcttacttttcgcaagattgttctgttctttacacgattccaagatgagtgaagaggtcaaagagaatcagtctgggaagcttcagaagccaactccacgtttaaacgagaggatcctctcatctttatctaagagatcggttgctgctcatccatggcatgatcttgaaatcggacctggagctccagtgattttcaatgtggttgttgagatctcaaagggtagcaaggtcaaatatgaacttgacaaaaagacaggactaatcaaggttgatcggatcctttattcatcggttgtgtatccgcataactacggttttattccccgcacattatgcgaagacaatgatccgttggatgtgctagtcatcatgcaggagcctgtacttccaggttgttttctgcgcgcccgagctattggattaatgcccatgattgatcagggagaaaaagatgacaagatcattgcggtatgtgttgatgatcctgagtataagcattacactgacatcaaagaacttcctcctcatcgtcttactgaaattcggcgattctttgaagattacaagaagaatgagaacaaggaagttgctgtaaatgattttctaccgaatggtcctgctgttgaagctattcagtactcaatggacctttacgctgagtacattcttcacaccctgagaagataagaaaaggactattcctgccaaaaaaaagcaagaatttgtcttatatttgaattttgaataaagcactgttcatgaaactgttctgatattttgtctttaaagcttctttgttgttgttttcttctggggatcttttgtctgaagattaatcccaattgagttttttttttctcttatttgtattggattttttttatccctttaaagttttgatttcgttccaag

SEQ ID NO: 1637 - protein, 214 aa, Zea mays
  misc_feature (1)..(214): Ceres CLONE ID no.1430456
  misc_feature (1)..(214): Bit score of 539.8 for HMM based on sequences of FIGURE 55.
  misc_feature (52)..(185): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MSEEVKENQSGKLQKPTPRLNERILSSLSKRSVAAHPWHDLEIGPGAPVIFNVVVEISKGSKVKYELDKKTGLIKVDRILYSSVVYPHNYGFIPRTLCEDNDPLDVLVIMQEPVLPGCFLRARAIGLMPMIDQGEKDDKIIAVCVDDPEYKHYTDIKELPPHRLTEIRRFFEDYKKNENKEVAVNDFLPNGPAVEAIQYSMDLYAEYILHTLRR

SEQ ID NO: 1638 - DNA, 920 bp, Zea mays
  misc_feature (1)..(920): Ceres CLONE ID no.1357137
  misc_feature (1)..(920): Encodes the peptide sequence at SEQ ID NO 1639
atttccgttttccacaccaccaccaacgcctttaacttttttattactcctctcccaaagttcctcccttttcgactccaaagatgactgaggaaacgaaggagaaccagcgacctgctcctcgtcttaacgagaggatcctctcttccttgtctagacgctccgtagctgctcatccctggcacgatcttgagattggccctggagctccacagattttcaacgtggtggttgagatcacaaagggaagcaaggtcaaatatgaacttgacaaaaagactggactcatcaaggtggatcgtattctctactcatcagttgtttaccctcacaactatggtttcgtccctcgcacactttgtgaagacaatgaccctattgatgttttagtcatcatgcaggaaccggtgcttccaggttgtttcctgcgtgcccgagctattggattaatgcctatgattgatcagggtgagaaagatgacaagatcattgcagtttgtgttgatgaccctgagtacaagcattacactgacatcaaagaacttcctcctcaccgtctctctgagatccgtcgtttctttgaagactacaagaagaatgagaacaaggaagttgcagttaatgatttcctgccgtctgagaaagctattgaagctatccagtactcaatggacctttatgctgagtacattctccataccctgcgacgttgacgcttcttctcctcggaacatttctgcatcgtctttgtttctgtttctttcaatgatataataagaagcaaaattgatactttctctgcattttcttgttgactttggatttttatcattttctccttgtgtaactcaataattttgttttaaatcttctttggggcattttaacgtttggttcatataaattctacatagaaatac

SEQ ID NO: 1639 - protein, 209 aa, Zea mays
  misc_feature (1)..(209): Ceres CLONE ID no.1357137
  misc_feature (1)..(209): Bit score of 543.3 for HMM based on sequences of FIGURE 55.
  misc_feature (47)..(201): Pfam Name: Pyrophosphatase Pfam Description: Inorganic pyrophosphatase
  misc_feature (1)..(209): Functional Homolog Of Ceres SEEDLINE ID no. ME19182 at SEQ ID NO: 1577
MTEETKENQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYTDIKELPPHRLSEIRRFFEDYKKNENKEVAVNDFLPSEKAIEAIQYSMDLYAEYILHTLRR

SEQ ID NO: 1640 - DNA, 1117 bp, Zea mays
  misc_feature (1)..(1117): Ceres CLONE ID no.241250
  misc_feature (1)..(1117): Encodes the peptide sequence at SEQ ID NO 1641
aaaaaaggccagccaacagaggccggtggaaaggagagaatcgagcagagccaccaggttgctcctcatttccactttccactgcgcctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgcttgctatattgcgaaccttggaattgagaacagcgtcactagctgtgattcgctcctttctcgttaaattatcatatgaataggccaagtccatacgtttaccgtgtggcgctctgtcagtcttcgtctacccaagtagctagctgcatggagggatgtctagcgttgctatgagatggcactcgtgggtctgcgggctgactacatgggtccgttcctgtgttttccgtaaaataaaattataattctatataattgaatcatttaatttatgc

SEQ ID NO: 1641 - protein, 257 aa, Zea mays
  misc_feature (1)..(257): Ceres CLONE ID no.241250
  misc_feature (1)..(257): Bit score of 537.6 for HMM based on sequences of FIGURE 55.
  misc_feature (95)..(249): Pfam Name: Pyrophosphatase Pfam Description: Inorganic pyrophosphatase
  misc_feature (1)..(257): Functional Homolog Of Ceres SEEDLINE ID no. ME19182 at SEQ ID NO: 1577
KRPANRGRWKGENRAEPPGCSSFPLSTAPPLPIAVPDRSAGLRMSEEDKAAASAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAQEAIQYSMDLYAQYILQSLRQ

SEQ ID NO: 1642 - DNA, 985 bp, Zea mays
  misc_feature (1)..(985): Ceres CLONE ID no.330215
  misc_feature (1)..(985): Encodes the peptide sequence at SEQ ID NO 1643
aaaaaggaccccggcccacctggaagccggagagaatcgagcagagccaccgatcgctcctgagcactttccacattccagttccactccgcctccgctgccggtcgccgtctccgagactccgacagtccgaccgcaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgcccatgattgaccagggtgaaaaggatgacaagataatagcagtctgtgctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattctaataagtcaaaacacttgatattgtgtgcaaatcttggggttgagaacaatgtcactagctgtgatttacttctgtgacttgcattttttttcttgttaaattatgaataagcgaagtccatacgtctg

SEQ ID NO: 1643 - protein, 214 aa, Zea mays
  misc_feature (1)..(214): Ceres CLONE ID no.330215
  misc_feature (1)..(214): Bit score of 537.2 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 1644 - DNA, 1119 bp, Zea mays
  misc_feature (1)..(1119): Ceres CLONE ID no.328799
  misc_feature (1)..(1119): Encodes the peptide sequence at SEQ ID NO 1645
atccgaccagcgtttactcctaactagtttgccgatcgagcccgggcgacgtgagatacgagcggcgtcgaccggcgccggcgagcctccgcagccgcagccgcccgatctgggttttctttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgccttcctccgcgccagggccatcggcctcatgcctatgatagatcagggagagaaggacgacaagatcatcgccgtctgcgccgacgaccccgagtaccgccactacaacgacatcagcgagctctcccctcaccgcctccaggagatccgccgcttctttgaagactacaagaagaacgagaacaaggaggtggccgtcaacgacttcctgcccgccgccgctgcccgcgaagccatccagtactccatggacctgtaacggccagtacatcatgcagaccctgcggcggtagagcgttcctaccagatcccatgccagctgagctgacgcaagagcacagatcgacagaatccttgtggtctcgtctcatgcatggatagccaggtcacatggcttgtcgacgacgaccatgcatctcttcttcccagcgatatatattttagcctgtatcttcccttatttattatagtcttttgggtttggtggaatctgtccacagtgtggtttgatctatgtattcctcttctacatttctcccagaacgaatcgatgagattaataataatgttactacaaccctgttgttttgtcgaccg

SEQ ID NO: 1645 - protein, 213 aa, Zea mays
  misc_feature (1)..(213): Ceres CLONE ID no.328799
  misc_feature (1)..(213): Bit score of 495.6 for HMM based on sequences of FIGURE 55.
  misc_feature (62)..(212): Pfam Name: Pyrophosphatase Pfam Description: Inorganic pyrophosphatase
  misc_feature (1)..(213): Functional Homolog Of Ceres SEEDLINE ID no. ME19182 at SEQ ID NO: 1577
MSQDQENGGTNGQHAADVMEVEPKRRAPRLNERILSSLSRRSVAAHPWHDLEIGPEAPAVFNVVVEITKGSKVKYELDKKTGLIKVDRILYSSVVYPHNYGFVPRTLCEDNDPMDVLVLMQEPVLPGAFLRARAIGLMPMIDQGEKDDKIIAVCADDPEYRHYNDISELSPHRLQEIRRFFEDYKKNENKEVAVNDFLPAAAAREAIQYSMDL

SEQ ID NO: 1646 - DNA, 1046 bp, Zea mays
  misc_feature (1)..(1046): Ceres CLONE ID no.302862
  misc_feature (1)..(1046): Encodes the peptide sequence at SEQ ID NO 1647
aatcacatttgattcgagccagtcagccagccccggagccctggacagcagcagcgaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttactcctctgttgtttacccacataactatggtttcattccacgcacactctgtgaggatagcgaccccatggacgtcctcgtactgatgcaggaacaagttgtccctgggtgtttcctgcgagctcgtgctattgggctcatgcctatgatcgatcagggtgagaaagatgataagatcatagctgtctgtgctgatgaccctgaattccgtcactacaaggacatctcggacctccccccgcatcgccttcaagagatccgccgcttttttgaagattataaaaagaatgaaaacaaagaagttgcagtgaatgatttcctcccagccgaagatgccatcaaagcaatcgagcactcgatggacctgtatggctcgtacgtcatggaaagcctgaggaggtgatctgctgctgcttgattgtggatgctacgtaattttctcaacagctcatcgagagtaccgtagtccgtagtacggcaaatgttaacacgcacgaactggaatcatgaccaagggatattaccttctgttcatgctgaaacgatcagcagtttctttctttgcatcatatgccacgtcaaatcaaggcacttgcctctgaaatctttgtggtcaagtcaaaccagcacttcgacagaacgattgatggatgcatgtattactgttacataaatgtccatttgctcaacttcatttctg

SEQ ID NO: 1647 - protein, 248 aa, Zea mays
  misc_feature (1)..(248): Ceres CLONE ID no.302862
  misc_feature (1)..(248): Bit score of 494.1 for HMM based on sequences of FIGURE 55.
  misc_feature (86)..(219): Pfam Name: Pyrophosphatase Pfam Description: Inorganic pyrophosphatase
  misc_feature (1)..(248): Functional Homolog Of Ceres SEEDLINE ID no. ME19182 at SEQ ID NO: 1577
SHLIRASQPAPEPWTAAANSRPLRHLATRLFSLSPPGQGRDHPIGSVMAGAAALNEGILSSVSEKNVAAHPWHDLEIGPEAPEVFNCVVEIPRGSKVKYELDKISGLIKVDRVLYSSVVYPHNYGFIPRTLCEDSDPMDVLVLMQEQVVPGCFLRARAIGLMPMIDQGEKDDKIIAVCADDPEFRHYKDISDLPPHRLQEIRRFFEDYKKNENKEVAVNDFLPAEDAIKAIEHSMDLYGSYVMESLRR

SEQ ID NO: 1648 - protein, 215 aa, Papaver rhoeas
  misc_feature (1)..(215): Public GI ID no.84619270
  misc_feature (1)..(215): Bit score of 540.2 for HMM based on sequences of FIGURE 55.
  misc_feature (53)..(207): Pfam Name: Pyrophosphatase Pfam Description: Inorganic pyrophosphatase
  misc_feature (1)..(215): Functional Homolog Of Ceres SEEDLINE ID no. ME19182 at SEQ ID NO: 1577
MSEEAATETGSSSVKRTTPKLNERILSSLSRRSVAAHPWHDLEIGPGAPSVVNAVVEITKGSKVKYELDKKTGMIKVDRVLYSSVVYPHNYGFIPRTLCEDNDPLDVLILMQEPVLPGCFLRIRAIGLMPMIDQGEKDDKIIAVCADDPEYRHYTDIKQLAPHRLAEIRRFFEDYKKNENKEVAVNDFLPSATAHEAIQYSMDLYAEYIMMSLRR

SEQ ID NO: 1649 - protein, 236 aa, Papaver rhoeas
  misc_feature (1)..(236): Public GI ID no.84619272
  misc_feature (1)..(236): Bit score of 524.9 for HMM based on sequences of FIGURE 55.
  misc_feature (74)..(207): Pfam Name: Pyrophosphatase Pfam Description: Inorganic pyrophosphatase
  misc_feature (1)..(236): Functional Homolog Of Ceres SEEDLINE ID no. ME19182 at SEQ ID NO: 1577
MDPPTEIANDVAPAKNDVAPAKNKTLNAIKAASYSSHARPSLNERILSSMSRRAVAAHPWHDLEIGPGAPTIFNCVVEIPRGSKVKYELDKKSGLIKVDRILYSSVVYPHNYGFIPRTLCEDADPLDVLIIMQEPVLPGCFLRAKAIGLMPMIDQGEKDDKIIAVCADDPEYRHYTDIKELPPHRLAEIRRFFEDYKKNENKEVAVNDFLPAEDASKAIQHSMDLYADYIVEALRR

SEQ ID NO: 1650 - DNA, 1058 bp, Panicum virgatum
  misc_feature (1)..(1058): Ceres CLONE ID no.1821143
  misc_feature (1)..(1058): Encodes the peptide sequence at SEQ ID NO 1651
attccccatcacctctccaacgtttgcccgagcgcgacgtgagacgacgagcggcgtcgagagcgacccgagccagcagctgccgccgccttccagttcgtgccgggatccggagatgagccaggagaacggagccaccaacgggcacctcgccgaggagcagcaggacgtcgtgatggaggtggagccgaagcgccgggcgccgcggctcaacgagcggatcctctcctcgctgtcgcggaggtccgtcgccgcgcacccctggcacgacctcgagatcggtcccgaagctccggcggtcttcaacgtggtcgtggagatcaccaaggggagcaaggtcaagtacgagctggacaagaagacggggctcatcaaggtggaccgggtcctctactcctccgtcgtgtacccgcacaactacggcttcatcccccgctcgctctgcgaggacaacgaccccatggacgtcctcgtcctcatgcaggaaccagtccttcccggcgccttcctccgggccagggcgatcggcctcatgcctatgatagatcagggcgagaaggacgacaagatcatagccgtctgcgccgacgatcccgagtaccgccactacaacgacatcagcgagctatcccctcaccgcctccaggagattcggcgcttcttcgaagactacaaaaagaacgagaacaaggaggtcgccgtcaacgagttcctccccgctgaagctgcccgcgaagccatccagtactccatggatctgtacgggcagtacattatgcagaccttgaggcggtagagcgtgaccgctttttccctctccctaccgaatcttatgcgagctgaagcaaaagcaccataacatcggaacatttggaatctgatgagcagccaagtcacatgagttgtcgtgcttgttggtcatcttttttccagagatattttagtctgtatcttgctctttattaattttctggaacttgtccacagtgtggtttgatctatgtactcctcttctacatttctcacagaacgagtaaataaaattaatagtgtatcag

SEQ ID NO: 1651 - protein, 226 aa, Panicum virgatum
  misc_feature (1)..(226): Ceres CLONE ID no.1821143
  misc_feature (1)..(226): Bit score of 536.2 for HMM based on sequences of FIGURE 55.
  misc_feature (64)..(218): Pfam Name: Pyrophosphatase Pfam Description: Inorganic pyrophosphatase
  misc_feature (1)..(226): Functional Homolog Of Ceres SEEDLINE ID no. ME19182 at SEQ ID NO: 1577
MSQENGATNGHLAEEQQDVVMEVEPKRRAPRLNERILSSLSRRSVAAHPWHDLEIGPEAPAVFNVVVEITKGSKVKYELDKKTGLIKVDRVLYSSVVYPHNYGFIPRSLCEDNDPMDVLVLMQEPVLPGAFLRARAIGLMPMIDQGEKDDKIIAVCADDPEYRHYNDISELSPHRLQEIRRFFEDYKKNENKEVAVNEFLPAEAAREAIQYSMDLYGQYIMQTLRR

SEQ ID NO: 1652 - DNA, 964 bp, Panicum virgatum
  misc_feature (1)..(964): Ceres CLONE ID no.1762859
  misc_feature (1)..(964): Encodes the peptide sequence at SEQ ID NO 1653
accccgttcccgtggcgtgccttctagggtttccttccttccctcgcctccccgcgccgctccctcccgcccgccagatttggatctgcgctccagccccaggttgttctgatggctcccgctgtagaagctgtgaaggaggcaggctcattccaaaaggttcctgctttgaatgaaagaatactgtcatccatgtccaggagatctgttgctgcgcacccttggcatgatctggagattggccctggtgcaccaaccatattcaactgtgtcattgagatacccaggggcagcaaggtgaagtacgaacttgacaagaaaactggactgataaaggtggaccgtgtgctgtattcatcagttgtgtaccctcacaactatggattcattcctcgcacactttgtgaagacagtgaccctctggatgtgctggttataatgcaggagccagttattccaggctgtttccttcgggcaaaggccatcggccttatgcctatgattgatcagggagagactgatgataagatcattgctgtgtgcgccgatgatcctgaatacaagcactacaatgatatcaaggagcttccacctcaccgcttggctgaaatcaggcgcttctttgaggactacaagaagaatgagaacaaggaggttgctgtgaatgactttctgcctgctagcgctgcttatgaagccatacaacactctatggatctgtatgctacctacattgttgagggcctgaggaggtaggctgctgctgcgtggtgcaacggtgccttgcttgaagggatgtttttcaccggttgggtctggaggatgttgacgaaaactgagatacactacctaatgaaacacaagtattgttattttgttggtaacttgtataccgctagtaatgaaacctgaaccaaatcccctggggaatcagtagtagttgaagctagtaacacgagaatgg

SEQ ID NO: 1653 - protein, 214 aa, Panicum virgatum
  misc_feature (1)..(214): Ceres CLONE ID no.1762859
  misc_feature (1)..(214): Bit score of 529.4 for HMM based on sequences of FIGURE 55.
  misc_feature (52)..(206): Pfam Name: Pyrophosphatase Pfam Description: Inorganic pyrophosphatase
  misc_feature (1)..(214): Functional Homolog Of Ceres SEEDLINE ID no. ME19182 at SEQ ID NO: 1577
MAPAVEAVKEAGSFQKVPALNERILSSMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGLMPMIDQGETDDKIIAVCADDPEYKHYNDIKELPPHRLAEIRRFFEDYKKNENKEVAVNDFLPASAAYEAIQHSMDLYATYIVEGLRR

SEQ ID NO: 1654 - DNA, 976 bp, Panicum virgatum
  misc_feature (1)..(976): Ceres CLONE ID no.1805493
  misc_feature (1)..(976): Encodes the peptide sequence at SEQ ID NO 1480
agcggcagcagccgcagcgaactcgaggccactccctccctccgccacctcgcgctcgcctgcctgacgcctctcctcgcttgcgccaccggggagggagggcgaccctccgatcagctccgccatggctggaactgctgttctcaatgagcgcatcctttcttccatgtcccagaaacatgttgctgctcatccatggcatgatttggagataggaccaggggctcctgaagttttcaactgtgtggttgagattcctagaggcagcaaggtgaagtatgagttggacaaggcatctggtctgatcaaggttgatcgtgtcctttactcctctgttgtttacccacacaactacggtttcattccacgcacactctgtgaggatagcgaccccatggacgtcctcatcctgatgcaggaacaagttgtccctgggtgttacctgcgagctcgtgctattgggctcatgcctatgattgatcagggagagaaagatgataagatcatagcggtctgcgctgatgaccctgaataccgtcactacacggacatcaaggaccttcctccacatcgccttcaagagattcgccgcttctttgaagattacaagaagaatgaaaacaaagaggtcgcggtgaatgagttcctcccagcaaaagatgccatcgatgcaatcagatactctatggacctgtatggctcgtacatcatcgaaggactgaggaagtaacaagattgcagatgcttcatgatttactcagcagctcgagagtactgtagcacgacatatgttaacatgcacgaactgaaatcatgacaaaggaatattaccttgtgttcatgttgagactagcagcagtgccttttgtttccattatatatgccgtgtcaagtccaagcacttggctttgctgaaatctgtcgtcaaaccaacatttgacagaacgattacctaatagaatatcactgattacat

SEQ ID NO: 1655 - DNA, 1453 bp, Zea mays subsp. mays
  misc_feature (1)..(1453): useful for making plants with increased size as described in USSN 10/572,827
  misc_feature (1)..(1453): ceres Seq. ID no. 12355477
aatccctcgcctgcaactggctctctgtccccttctgctccccccacggttccccagagcccgagccaaatctaggggcttccttcatccgagcgtggtttcaattctaggggtagtcacctcacctgaattccgcccaaataaattcgtcgctgccttgtgatccttggggtttccttggttcttgagttgcgatcttctgctggttcgtgtcccccaatccgtaatcaatccggcgtctaggaaaccaattgctgctcagttctcttatttgctcctcgccttccttcctccagcctggttaaaatatcgaaaggggatttttttttaaaaatctgctcatcgaggaagcagggaagacaagaattgttgcatcggataaaggtcgggtgaaaatacaagcaaatcctgggaactcgcgtccctttgctaggtggttctttcctgatacaaagaacacaatgggcgatgtgtccttgaacggacccattaaggctgctgagccaggtgccggtggcattgccaagggcaatcaagttctggacacgatgtccgccgggtggacagacgagagacacaggctgtatataagctctatggaggcctctttcgtcgatcaactgtacaaccacgggagccgtccgcgcaacgcaaacggcaccgccttcaaggctctccgcagggagtacgtcgagtatgagaagaccgatgctcctgtgcgaaggggggctaagtgctgcggcgttcctgcaaatccttggatgcagcatttcaggccacgtagtgatggcggtaataacgcgcgaggcgatgggctcggggattctgtgggcgatcttgaatctggcactgaggcaaaccggaagagcctctcagcgtctcatggaagggaacgggacgcttgtgagggagaaccccagcttctccatgaaagtagagaggtctctgatcaaaattttgctgacgacgaggctgaagctgaaacagaatcaatgaaagcatacaagaaaaggagattaagcaggacaatgatcaactaaatttgcagggtcaattagcttagcctgttgcaggaattgagatgactgtcctaaaaggaggcagtaagatgatgggacatgtcttacgaaattttcagctgttgcctcttggtagccaaggcactttgaatccgaaggaaggtgttgaagggtagttgttagtgatcttgtgatgatataacgagctctggagcagttagcatcggcattttagtggattatgttcttgttatgtgtatctgtctatttttcagtcctcatcggtagtgctgcatagtacctcgctctctcgtcagaaggatattaggctaggtcactgttattaaatttttcaataacagtgaagtgtacatgtgtttgccaaatggtgagaatcattattgatttccaattcacaaactattctttatgcc

SEQ ID NO: 1656 - DNA, 576 bp, Zea mays subsp. mays
  misc_feature (1)..(576): useful for making plants with increased size as described in USSN 10/572,827
atgggcgatgtgtccttgaacggacccattaaggctgctgagccaggtgccggtggcattgccaagggcaatcaagttctggacacgatgtccgccgggtggacagacgagagacacaggctgtatataagctctatggaggcctctttcgtcgatcaactgtacaaccacgggagccgtccgcgcaacgcaaacggcaccgccttcaaggctctccgcagggagtacgtcgagtatgagaagaccgatgctcctgtgcgaaggggggctaagtgctgcggcgttcctgcaaatccttggatgcagcatttcaggccacgtagtgatggcggtaataacgcgcgaggcgatgggctcggggattctgtgggcgatcttgaatctggcactgaggcaaaccggaagagcctctcagcgtctcatggaagggaacgggacgcttgtgagggagaaccccagcttctccatgaaagtagagaggtctctgatcaaaattttgctgacgacgaggctgaagctgaaacagaatcaatgaaagcatacaagaaaaggagattaagcaggacaatgatcaac

SEQ ID NO: 1657 - protein, 192 aa, Zea mays subsp. mays
  misc_feature (1)..(192): useful for making plants with increased size as described in USSN 10/572,827
  PEPTIDE (1)..(192): ceres Seq. ID no. 12355478
MGDVSLNGPIKAAEPGAGGIAKGNQVLDTMSAGWTDERHRLYISSMEASFVDQLYNHGSRPRNANGTAFKALRREYVEYEKTDAPVRRGAKCCGVPANPWMQHFRPRSDGGNNARGDGLGDSVGDLESGTEANRKSLSASHGRERDACEGEPQLLHESREVSDQNFADDEAEAETESMKAYKKRRLSRTMIN

SEQ ID NO: 1658 - DNA, 489 bp, Zea mays subsp. mays
  misc_feature (1)..(489): useful for making plants with increased size as described in USSN 10/572,827
atgtccgccgggtggacagacgagagacacaggctgtatataagctctatggaggcctctttcgtcgatcaactgtacaaccacgggagccgtccgcgcaacgcaaacggcaccgccttcaaggctctccgcagggagtacgtcgagtatgagaagaccgatgctcctgtgcgaaggggggctaagtgctgcggcgttcctgcaaatccttggatgcagcatttcaggccacgtagtgatggcggtaataacgcgcgaggcgatgggctcggggattctgtgggcgatcttgaatctggcactgaggcaaaccggaagagcctctcagcgtctcatggaagggaacgggacgcttgtgagggagaaccccagcttctccatgaaagtagagaggtctctgatcaaaattttgctgacgacgaggctgaagctgaaacagaatcaatgaaagcatacaagaaaaggagattaagcaggacaatgatcaac

SEQ ID NO: 1659 - protein, 163 aa, Zea mays subsp. mays
  misc_feature (1)..(163): useful for making plants with increased size as described in USSN 10/572,827
  PEPTIDE (1)..(163): ceres Seq. ID no. 12355479
MSAGWTDERHRLYISSMEASFVDQLYNHGSRPRNANGTAFKALRREYVEYEKTDAPVRRGAKCCGVPANPWMQHFRPRSDGGNNARGDGLGDSVGDLESGTEANRKSLSASHGRERDACEGEPQLLHESREVSDQNFADDEAEAETESMKAYKKRRLSRTMIN

SEQ ID NO: 1660 - DNA, 441 bp, Zea mays subsp. mays
  misc_feature (1)..(441): useful for making plants with increased size as described in USSN 10/572,827
atggaggcctctttcgtcgatcaactgtacaaccacgggagccgtccgcgcaacgcaaacggcaccgccttcaaggctctccgcagggagtacgtcgagtatgagaagaccgatgctcctgtgcgaaggggggctaagtgctgcggcgttcctgcaaatccttggatgcagcatttcaggccacgtagtgatggcggtaataacgcgcgaggcgatgggctcggggattctgtgggcgatcttgaatctggcactgaggcaaaccggaagagcctctcagcgtctcatggaagggaacgggacgcttgtgagggagaaccccagcttctccatgaaagtagagaggtctctgatcaaaattttgctgacgacgaggctgaagctgaaacagaatcaatgaaagcatacaagaaaaggagattaagcaggacaatgatcaac

SEQ ID NO: 1661 - protein, 147 aa, Zea mays subsp. mays
  misc_feature (1)..(147): useful for making plants with increased size as described in USSN 10/572,827
  PEPTIDE (1)..(147): ceres Seq. ID no. 12355480
MEASFVDQLYNHGSRPRNANGTAFKALRREYVEYEKTDAPVRRGAKCCGVPANPWMQHFRPRSDGGNNARGDGLGDSVGDLESGTEANRKSLSASHGRERDACEGEPQLLHESREVSDQNFADDEAEAETESMKAYKKRRLSRTMIN

SEQ ID NO: 1662 - DNA, 1494 bp, Zea mays subsp. mays
  misc_feature (1)..(1494): useful for making plants with increased size as described in USSN 10/572,827
  misc_feature (1)..(1494): ceres Seq. ID no. 12410516
gtgtttcatttttaatgaccattctctcatctgctgctggctgcggctatatacccccctctctctgtctctctatctccttctgttcttagacgtttctccatagcctgagccaaatctagggggcttgcttcatctgctgtccgatcgtggtttggtttctcggggctggcgcggtcaagagcgcacctgaattccaccgaaatccgccacggtagttcttgcctaggtgtgtcgttggtcgttgccttgtgacccttgcggattttcttgtttctttttgagttgcgatctttgcaggttagtctcccccccaatccgtaatcatccggcgtctaggaaactgcagtccagttttcttatttgttcgtctcgtgccttctccccatcctggttagaaagaatatcggaagggggatttttttttttgcctgttcgtagaggaagcagtgaagacataattgttgcatctgataaagctcgggcgaaatacacgcaaatccttggaattttgcatccctttgctggctcttttctgattcagagaacccaatgggggatgtgtccttgaatcgacccgttaaggccgagccaactgccggtggcattgccaagggaaaccgagttctggacacgatgtccgccgggtggacggacgagagacacatgctgtatataagctccatggaggcttcttttgtcgatcagctatacaaccatggaaaccatccgcacgacgcaaatggcgctggcttcaaggttctccgcaggggggtgtgggagtacatcgagtatgagaagaccagtgcccctgtgcgaagtggggctaaatgctgcgtccctgcaaatccttggatccggcatttcaggccacgtgactgcggtagtaacgcacagagtgacgcggtcgaggcctcagtgggcgaccatgagtcgggtactcaggcaagccgcaagagcccttcagtgtctcatggaagggaacggggagcttgtaagggagaaccccagattctacatgaaagtacagaggtctctgatcaaaattttgctgacgatgaggctgaagctgaaacagaatcaatgaaagcatgcaagaaaaggagactaagcagggctttgcactccggtgctgaatgatcaagtaaattcgcaggaacaattagcttagcctgttgcaagaatcgatatgatttatcctaaaagaaggtgttaagatgatgggacatggctttcaaaactttcagctgttgcctgctggtagccaagacacactgaatccgaaggaaggcgttgaagggtagctgttagtgattttgtgatataaagagtactggggcagttagcatcggcatttttagcggatttaagttcttgttatgtatatctgtcttctgtcttcatcagtagtgctgcttagtacctcactctctcgtcagcaggatatttctatatattgtctgtacttggtagatatatgtattggttgatccg

SEQ ID NO: 1663 - DNA, 585 bp, Zea mays subsp. mays
  misc_feature (1)..(585): useful for making plants with increased size as described in USSN 10/572,827
atgggggatgtgtccttgaatcgacccgttaaggccgagccaactgccggtggcattgccaagggaaaccgagttctggacacgatgtccgccgggtggacggacgagagacacatgctgtatataagctccatggaggcttcttttgtcgatcagctatacaaccatggaaaccatccgcacgacgcaaatggcgctggcttcaaggttctccgcaggggggtgtgggagtacatcgagtatgagaagaccagtgcccctgtgcgaagtggggctaaatgctgcgtccctgcaaatccttggatccggcatttcaggccacgtgactgcggtagtaacgcacagagtgacgcggtcgaggcctcagtgggcgaccatgagtcgggtactcaggcaagccgcaagagcccttcagtgtctcatggaagggaacggggagcttgtaagggagaaccccagattctacatgaaagtacagaggtctctgatcaaaattttgctgacgatgaggctgaagctgaaacagaatcaatgaaagcatgcaagaaaaggagactaagcagggctttgcactccggtgctgaa

SEQ ID NO: 1664 - protein, 195 aa, Zea mays subsp. mays
  misc_feature (1)..(195): useful for making plants with increased size as described in USSN 10/572,827
  PEPTIDE (1)..(195): ceres Seq. ID no. 12410517
MGDVSLNRPVKAEPTAGGIAKGNRVLDTMSAGWTDERHMLYISSMEASFVDQLYNHGNHPHDANGAGFKVLRRGVWEYIEYEKTSAPVRSGAKCCVPANPWIRHFRPRDCGSNAQSDAVEASVGDHESGTQASRKSPSVSHGRERGACKGEPQILHESTEVSDQNFADDEAEAETESMKACKKRRLSRALHSGAE

SEQ ID NO: 1665 - DNA, 501 bp, Zea mays subsp. mays
  misc_feature (1)..(501): useful for making plants with increased size as described in USSN 10/572,827
atgtccgccgggtggacggacgagagacacatgctgtatataagctccatggaggcttcttttgtcgatcagctatacaaccatggaaaccatccgcacgacgcaaatggcgctggcttcaaggttctccgcaggggggtgtgggagtacatcgagtatgagaagaccagtgcccctgtgcgaagtggggctaaatgctgcgtccctgcaaatccttggatccggcatttcaggccacgtgactgcggtagtaacgcacagagtgacgcggtcgaggcctcagtgggcgaccatgagtcgggtactcaggcaagccgcaagagcccttcagtgtctcatggaagggaacggggagcttgtaagggagaaccccagattctacatgaaagtacagaggtctctgatcaaaattttgctgacgatgaggctgaagctgaaacagaatcaatgaaagcatgcaagaaaaggagactaagcagggctttgcactccggtgctgaa

SEQ ID NO: 1666 - protein, 167 aa, Zea mays subsp. mays
  misc_feature (1)..(167): useful for making plants with increased size as described in USSN 10/572,827
  PEPTIDE (1)..(167): ceres Seq. ID no. 12410518
MSAGWTDERHMLYISSMEASFVDQLYNHGNHPHDANGAGFKVLRRGVWEYIEYEKTSAPVRSGAKCCVPANPWIRHFRPRDCGSNAQSDAVEASVGDHESGTQASRKSPSVSHGRERGACKGEPQILHESTEVSDQNFADDEAEAETESMKACKKRRLSRALHSGAE

SEQ ID NO: 1667 - DNA, 471 bp, Zea mays subsp. mays
  misc_feature (1)..(471): useful for making plants with increased size as described in USSN 10/572,827
atgctgtatataagctccatggaggcttcttttgtcgatcagctatacaaccatggaaaccatccgcacgacgcaaatggcgctggcttcaaggttctccgcaggggggtgtgggagtacatcgagtatgagaagaccagtgcccctgtgcgaagtggggctaaatgctgcgtccctgcaaatccttggatccggcatttcaggccacgtgactgcggtagtaacgcacagagtgacgcggtcgaggcctcagtgggcgaccatgagtcgggtactcaggcaagccgcaagagcccttcagtgtctcatggaagggaacggggagcttgtaagggagaaccccagattctacatgaaagtacagaggtctctgatcaaaattttgctgacgatgaggctgaagctgaaacagaatcaatgaaagcatgcaagaaaaggagactaagcagggctttgcactccggtgctgaa

SEQ ID NO: 1668 - protein, 157 aa, Zea mays subsp. mays
  misc_feature (1)..(157): useful for making plants with increased size as described in USSN 10/572,827
  PEPTIDE (1)..(157): ceres Seq. ID no. 12410519
MLYISSMEASFVDQLYNHGNHPHDANGAGFKVLRRGVWEYIEYEKTSAPVRSGAKCCVPANPWIRHFRPRDCGSNAQSDAVEASVGDHESGTQASRKSPSVSHGRERGACKGEPQILHESTEVSDQNFADDEAEAETESMKACKKRRLSRALHSGAE

SEQ ID NO: 1669 - DNA, 409 bp, Brassica napus
  misc_feature (1)..(409): useful for making plants with increased size as described in USSN 10/572,827
  misc_feature (1)..(409): ceres Seq. ID no. 4788142
ttttttctttttcaccttctcctcctccttctctcctttcttctgatattttcctctctctagtcttaacaagatagataggtagcaaatggttggtgactacagagagaactatagcccaagctccgacgattcttcttctgtaggggaagagacgacttcttcaatgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacaggtatgaataggacactttcccctgtctttttccatgtgcgatgttgtg

SEQ ID NO: 1670 - DNA, 276 bp, Brassica napus
  misc_feature (1)..(276): useful for making plants with increased size as described in USSN 10/572,827
atggttggtgactacagagagaactatagcccaagctccgacgattcttcttctgtaggggaagagacgacttcttcaatgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacaggta

SEQ ID NO: 1671 - protein, 92 aa, Brassica napus
  misc_feature (1)..(92): useful for making plants with increased size as described in USSN 10/572,827
  PEPTIDE (1)..(92): ceres Seq. ID no. 4788143
MVGDYRENYSPSSDDSSSVGEETTSSMYSARNEDTPTEWTDEKHSLYLKSMEASFVDQLYNSLGALGSKNNKDTVGPSRRFGDGGKPSEEQV

SEQ ID NO: 1672 - DNA, 198 bp, Brassica napus
  misc_feature (1)..(198): useful for making plants with increased size as described in USSN 10/572,827
atgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacaggta

SEQ ID NO: 1673 - protein, 66 aa, Brassica napus
  misc_feature (1)..(66): useful for making plants with increased size as described in USSN 10/572,827
  PEPTIDE (1)..(66): ceres Seq. ID no. 4788144
MYSARNEDTPTEWTDEKHSLYLKSMEASFVDQLYNSLGALGSKNNKDTVGPSRRFGDGGKPSEEQV

SEQ ID NO: 1674 - DNA, 186 bp, Brassica napus
  misc_feature (1)..(186): useful for making plants with increased size as described in USSN 10/572,827
atgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacaggtatgaa

SEQ ID NO: 1675 - protein, 62 aa, Brassica napus
  misc_feature (1)..(62): useful for making plants with increased size as described in USSN 10/572,827
  PEPTIDE (1)..(62): ceres Seq. ID no. 4788145
MKIRLQNGPMRSIVCILNQWKLPSLISCTTPSVRSAPKTTRILSDHREGSVMVENLLKNRYE

SEQ ID NO: 1676 - DNA, 486 bp, Brassica napus
  misc_feature (1)..(486): useful for making plants with increased size as described in USSN 10/572,827
  misc_feature (1)..(486): ceres Seq. ID no. 4796909
tttccgtctttctttttcaccttctcctcctccttctctcctttcttctgatattttcctctctctagtcttaacaagatagataggtagcaaatggttggtgactacagagagaactatagcccaagctccgacgattcttcttctgtaggggaagagacgacttcttcaatgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacagaagatgaatgtgaggcagcctgagtatcgtctcaatggaagacacggtcgtcgctctcacgagtttcttaggagtccatggatcaagcactataagccttcaccaaagtccctaacagat

SEQ ID NO: 1677 - DNA, 393 bp, Brassica napus
  misc_feature (1)..(393): useful for making plants with increased size as described in USSN 10/572,827
atggttggtgactacagagagaactatagcccaagctccgacgattcttcttctgtaggggaagagacgacttcttcaatgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacagaagatgaatgtgaggcagcctgagtatcgtctcaatggaagacacggtcgtcgctctcacgagtttcttaggagtccatggatcaagcactataagccttcaccaaagtccctaacagat

SEQ ID NO: 1678 - protein, 131 aa, Brassica napus
  misc_feature (1)..(131): useful for making plants with increased size as described in USSN 10/572,827
  PEPTIDE (1)..(131): ceres Seq. ID no. 4796910
MVGDYRENYSPSSDDSSSVGEETTSSMYSARNEDTPTEWTDEKHSLYLKSMEASFVDQLYNSLGALGSKNNKDTVGPSRRFGDGGKPSEEQKMNVRQPEYRLNGRHGRRSHEFLRSPWIKHYKPSPKSLTD

SEQ ID NO: 1679 - DNA, 315 bp, Brassica napus
  misc_feature (1)..(315): useful for making plants with increased size as described in USSN 10/572,827
atgtattctgcgaggaatgaagatacgcctacagaatggaccgatgagaagcatagtttgtatcttaaatcaatggaagcttccttcgttgatcagctgtacaactccctcggtgcgctcggctccaaaaacaacaaggatactgtcggaccatcgagaaggttcggtgatggtggaaaaccttctgaagaacagaagatgaatgtgaggcagcctgagtatcgtctcaatggaagacacggtcgtcgctctcacgagtttcttaggagtccatggatcaagcactataagccttcaccaaagtccctaacagat

SEQ ID NO: 1680 - protein, 105 aa, Brassica napus
  misc_feature (1)..(105): useful for making plants with increased size as described in USSN 10/572,827
  PEPTIDE (1)..(105): ceres Seq. ID no. 4796911
MYSARNEDTPTEWTDEKHSLYLKSMEASFVDQLYNSLGALGSKNNKDTVGPSRRFGDGGKPSEEQKMNVRQPEYRLNGRHGRRSHEFLRSPWIKHYKPSPKSLTD

SEQ ID NO: 1681 - DNA, 243 bp, Brassica napus
  misc_feature (1)..(243): useful for making plants with increased size as described in USSN 10/572,827
atggaagcttccttcgttgatcagctgtacaactccctcggtgcgctcggctccaaaaacaacaaggatactgtcggaccatcgagaaggttcggtgatggtggaaaaccttctgaagaacagaagatgaatgtgaggcagcctgagtatcgtctcaatggaagacacggtcgtcgctctcacgagtttcttaggagtccatggatcaagcactataagccttcaccaaagtccctaacagat

SEQ ID NO: 1682 - protein, 81 aa, Brassica napus
  misc_feature (1)..(81): useful for making plants with increased size as described in USSN 10/572,827
  PEPTIDE (1)..(81): ceres Seq. ID no. 4796912
MEASFVDQLYNSLGALGSKNNKDTVGPSRRFGDGGKPSEEQKMNVRQPEYRLNGRHGRRSHEFLRSPWIKHYKPSPKSLTD

SEQ ID NO: 1683 - DNA, 1014 bp, Arabidopsis thaliana
  misc_feature (1)..(1014): useful for making plants with increased size as described in USSN 10/572,827
  misc_feature (1)..(1014): ceres Seq. ID no. 12321174
ctctctctcttaaagctctcttctttggctctttcgaagaagaaccatttttatttcctaagagagacgacggagttcttttctaaagcaccggagaggaggagaagcaacgatggagaatgattgcacggtgaatattgtctctctggagaaggatcgcgatgtttcggaggcgtcggctgaatctcagagcgagtcgactctttcgaactcgctcgattccggtgttacggctgagacctctcgttctgatgctgattccaaactggatgaatgtactgcttggacgaatgagaaacacaactcatatcttgattatttagagagctcgtttgttaggcaattatactccttgcttggaggtgggactcagagactttctagaactcgtgatgtgcagtctaactctcataaatcagctgatcagtttaccgtcctacaaaatggttgctggcagaaggttaactttggaaagaaacaatcttgtttggagacttcatctgagtttcgttttcacagaaattcattgagaaataagcctgaaaattccaacggaaattacaccatgggaactactgtccaaggagatgtgttatgtcatgacgaaaccaaacactcagaggcgtcagggcagaatttcagagaagaagaagaagaagaagagaagggagaggtgagcaaaaaacgagaaagagaagcaaataacgatgatagttcattgaaggaggatcaggttgtgccggtaaggatggtgaagcccagaacgtgaaagcattaggaagtgtagatgaaatactatgaatagagataaagaaatagaagaaggtgtggttacgaatgtggagagggttttgtttgttgtatagcgtgaggctaaagagagccttccttataaagggatccaatgggatatggaaataggattggtgtttgttttcgttaaattttgtctaatgttaactaggggaaaagttatctgatagtattagcatcttatggcaattttattctttt

SEQ ID NO: 1684 - DNA, 654 bp, Arabidopsis thaliana
  misc_feature (1)..(654): useful for making plants with increased size as described in USSN 10/572,827
atggagaatgattgcacggtgaatattgtctctctggagaaggatcgcgatgtttcggaggcgtcggctgaatctcagagcgagtcgactctttcgaactcgctcgattccggtgttacggctgagacctctcgttctgatgctgattccaaactggatgaatgtactgcttggacgaatgagaaacacaactcatatcttgattatttagagagctcgtttgttaggcaattatactccttgcttggaggtgggactcagagactttctagaactcgtgatgtgcagtctaactctcataaatcagctgatcagtttaccgtcctacaaaatggttgctggcagaaggttaactttggaaagaaacaatcttgtttggagacttcatctgagtttcgttttcacagaaattcattgagaaataagcctgaaaattccaacggaaattacaccatgggaactactgtccaaggagatgtgttatgtcatgacgaaaccaaacactcagaggcgtcagggcagaatttcagagaagaagaagaagaagaagagaagggagaggtgagcaaaaaacgagaaagagaagcaaataacgatgatagttcattgaaggaggatcaggttgtgccggtaaggatggtgaagcccagaacg

SEQ ID NO: 1685 - protein, 218 aa, Arabidopsis thaliana
  misc_feature (1)..(218): useful for making plants with increased size as described in USSN 10/572,827
  PEPTIDE (1)..(218): ceres Seq. ID no. 12321175
MENDCTVNIVSLEKDRDVSEASAESQSESTLSNSLDSGVTAETSRSDADSKLDECTAWTNEKHNSYLDYLESSFVRQLYSLLGGGTQRLSRTRDVQSNSHKSADQFTVLQNGCWQKVNFGKKQSCLETSSEFRFHRNSLRNKPENSNGNYTMGTTVQGDVLCHDETKHSEASGQNFREEEEEEEKGEVSKKREREANNDDSSLKEDQVVPVRMVKPRT

SEQ ID NO: 1686 - DNA, 1027 bp, Arabidopsis thaliana
  misc_feature (1)..(1027): useful for making plants with increased size as described in USSN 10/572,827
  misc_feature (1)..(1027): ceres Seq. ID no. 12323601
agatattttgtttctctctttctctctgatatttttcattttcttcttcttctctctctctctccacaaagataagccaacaatggttggtgattacagaggacgctttagtagccgtcgtttctccgacgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataagctcttgcaacatgacgtaaatttgaagtctgtttcttgagaggtcagatggtgaagctttatatgaggagagaattttgtaatgtatatatatttgcataacttataagtcaaatttactatccttagttacaagtttcttcatcatatatccctaactataaatatatttatatgctcatgtgagtggattcatttgtactgtaaaacccttagaaagacgtcaaattagtatttgatggtc

SEQ ID NO: 1687 - DNA, 819 bp, Arabidopsis thaliana
  misc_feature (1)..(819): useful for making plants with increased size as described in USSN 10/572,827
gatattttgtttctctctttctctctgatatttttcattttcttcttcttctctctctctctccacaaagataagccaacaatggttggtgattacagaggacgctttagtagccgtcgtttctccgacgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataagctcttgcaacatgacgtaaatttgaagtctgtttct

SEQ ID NO: 1688 - protein, 273 aa, Arabidopsis thaliana
  misc_feature (1)..(273): useful for making plants with increased size as described in USSN 10/572,827
  PEPTIDE (1)..(273): ceres Seq. ID no. 12323602
DILFLSFSLIFFIFFFFSLSLHKDKPTMVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 1689 - DNA, 738 bp, Arabidopsis thaliana
  misc_feature (1)..(738): useful for making plants with increased size as described in USSN 10/572,827
atggttggtgattacagaggacgctttagtagccgtcgtttctccgacgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataagctcttgcaacatgacgtaaatttgaagtctgtttct

SEQ ID NO: 1690 - protein, 246 aa, Arabidopsis thaliana
  misc_feature (1)..(246): useful for making plants with increased size as described in USSN 10/572,827
  PEPTIDE (1)..(246): ceres Seq. ID no. 12323603
MVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 1691 - DNA, 633 bp, Arabidopsis thaliana
  misc_feature (1)..(633): useful for making plants with increased size as described in USSN 10/572,827
atgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataagctcttgcaacatgacgtaaatttgaagtctgtttct

SEQ ID NO: 1692 - protein, 211 aa, Arabidopsis thaliana
  misc_feature (1)..(211): useful for making plants with increased size as described in USSN 10/572,827
  PEPTIDE (1)..(211): ceres Seq. ID no. 12323604
MYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 1693 - DNA, 960 bp, Arabidopsis thaliana
  misc_feature (1)..(960): useful for making plants with increased size as described in USSN 10/572,827
  misc_feature (1)..(960): ceres Seq. ID no. 13491409
atttttgtttctctctttctctctgatatttttcattttcttcttcttctctctctctctccacaaagataagccaacaatggttggtgattacagaggacgctttagtagccgtcgtttctccgatgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttcttgagaggtcagatggtgaagctttatatgaggagagaattttgtaatgtatatatatttgcataacttataagtcaaatttactatccttagttacaagtttcttcatcatatatccctaactataaatatatttatatgccc

SEQ ID NO: 1694 - DNA, 816 bp, Arabidopsis thaliana
  misc_feature (1)..(816): useful for making plants with increased size as described in USSN 10/572,827
tttttgtttctctctttctctctgatatttttcattttcttcttcttctctctctctctccacaaagataagccaacaatggttggtgattacagaggacgctttagtagccgtcgtttctccgatgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttct

SEQ ID NO: 1695 - protein, 272 aa, Arabidopsis thaliana
  misc_feature (1)..(272): useful for making plants with increased size as described in USSN 10/572,827
  PEPTIDE (1)..(272): ceres Seq. ID no. 13491410
FLFLSFSLIFFIFFFFSLSLHKDKPTMVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 1696 - DNA, 738 bp, Arabidopsis thaliana
  misc_feature (1)..(738): useful for making plants with increased size as described in USSN 10/572,827
atggttggtgattacagaggacgctttagtagccgtcgtttctccgatgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttct

SEQ ID NO: 1697 - protein, 246 aa, Arabidopsis thaliana; identical to SEQ ID NO: 1690
  misc_feature (1)..(246): useful for making plants with increased size as described in USSN 10/572,827
  PEPTIDE (1)..(246): ceres Seq. ID no. 13491411

SEQ ID NO: 1698 - DNA, 633 bp, Arabidopsis thaliana
  misc_feature (1)..(633): useful for making plants with increased size as described in USSN 10/572,827
atgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttct

SEQ ID NO: 1699 - protein, 211 aa, Arabidopsis thaliana; identical to SEQ ID NO: 1692
  misc_feature (1)..(211): useful for making plants with increased size as described in USSN 10/572,827
  PEPTIDE (1)..(211): ceres Seq. ID no. 13491412

SEQ ID NO: 1700 - DNA, 1031 bp, Artificial Sequence
  misc_feature (1)..(1031): useful for making plants with increased size as described in USSN 10/572,827
  misc_feature (1)..(1031): clone nucleotide 486033
  misc_feature (609)..(609): n is a, c, t, g, unknown, or other
agttcgctttggcctccgcttgccccctccctctcgcgtctctatacatcgccgctgttgtgttgcagttcagtttgcatcctgagctctctcctggaccagccgagatttctctctctgcgcatctctaattcatcttcgtcgagaggagctgttcctcttctttgccgcctcgaatctgggactggtcggttttctggatccctgctgcctgtcgggttctcgagaggtgtaaaatccaatggagggtgtgtcatcgttgaaccagccgttgatcaacgacgaccggcagcccgtgcccagcagtatcgccaagggtgatcaaatccaaggcctgttgtcgggtgaatggacaaatgagcggcacagctcgtacataagctccatggaggcatctttcgtggagcaactccgtagtggttccaaggccatccaggagggcttgtgccagagcatgaggattccgagggatgatgctcgcagccatgacgtccctgagagtccgtgggtggtggtgaggcgtttcaggccacgcggtgtccaccatggcgatggaatggaagtggaacctttggtcgatggttatggatcaggtactgacacggcccngagagaaggtccggacccacgcaagatagcgaaggcttctgctattattgaagtcacggaccagaattttcctgaggaggggattcaatccagtaacggtgcatgcaagagacagaaatctactcctggcaatgcatcaaatggccagggtacttaacaagatagtggaagccaagccatgccctctctgaagccttcaggaggccatgggggaaacgagacttgtctgcagtactacgtgatgacaggtcgtgctgcagctgcaagtagtttggcttaccaaaatatgatatcgtcgtcctttctgcggtgtggagagtagaatatgcatatccacatctgcagagagcaccggttctcttcttcttgttgctgttactattttgtgccatggagcaaatttatttggtaaatttgagctg

SEQ ID NO: 1701 - protein, 174 aa, Artificial Sequence
  misc_feature (1)..(174): useful for making plants with increased size as described in USSN 10/572,827
  misc_feature (1)..(174): clone peptide 486033
  misc_feature (123)..(123): Xaa is any aa, unknown or other
MEGVSSLNQPLINDDRQPVPSSIAKGDQIQGLLSGEWTNERHSSYISSMEASFVEQLRSGSKAIQEGLCQSMRIPRDDARSHDVPESPWVVVRRFRPRGVHHGDGMEVEPLVDGYGSGTDTAXREGPDPRKIAKASAIIEVTDQNFPEEGIQSSNGACKRQKSTPGNASNGQGT

SEQ ID NO: 1702 - DNA, 828 bp, Arabidopsis thaliana
  misc_feature (1)..(828): useful for making plants with increased cold tolerance as described in USSN 11/779,266
  misc_feature (1)..(828): Ceres CLONE ID no. 30087
  misc_feature (1)..(828): Ceres SEED LINE ID no. ME01451
aacttttctctcccactctttcttttactactctcacacatatctctgtctatatatcactttacataaaccactattccacacacaaacacacatagccatggcctcttctttctcttcacaagccttcttcttgctcacattgtctatggttttaattcctttctctttagctcaagctcccatgatggctccttctggctcaatgtccatgccgcctatgtctagcggcggtggaagctcggttcctcctccagtgatgtctccgatgccaatgatgactccaccacctatgcctatgactccatcacccatgcccatgactccaccacctatgcctatggctccaccaccaatgcccatggcttcaccaccaatgatgccaatgactccatctacaagcccaagcccattaacagttccggatatgccttcgccgccgatgccatccggaatggaatcttcaccttctccaggacccatgccaccggcaatggcggcttcgccggattcgggagctttcaatgttagaaacaacgtcgtaacactttcatgcgttgttggagttgttgcagctcattttctcctcgtttgaaatgattattgaattggtcagcctcgatcgttttcttgtaatttactttcatattttttttccctcaaattattagtggtcatcattttataatatttgagtttgtgtttgatgtacgattcagacatttgtttgcattatgtgcttaataagtttatcgttgactctacttgaagagagactttgtgtgtgatgtaaatttcttctatctatggaacattgcattcgtagcc

SEQ ID NO: 1703 - protein, 164 aa, Arabidopsis thaliana
  misc_feature (1)..(164): useful for making plants with increased cold tolerance as described in USSN 11/779,266
  misc_feature (1)..(164): Ceres CLONE ID no. 30087
  misc_feature (1)..(164): Ceres SEED LINE ID no. ME01451
MASSFSSQAFFLLTLSMVLIPFSLAQAPMMAPSGSMSMPPMSSGGGSSVPPPVMSPMPMMTPPPMPMTPSPMPMTPPPMPMAPPPMPMASPPMMPMTPSTSPSPLTVPDMPSPPMPSGMESSPSPGPMPPAMAASPDSGAFNVRNNVVTLSCVVGVVAAHFLLV

SEQ ID NO: 1704 - protein, 155 aa, Brassica napus
  misc_feature (1)..(155): useful for making plants with increased cold tolerance as described in USSN 11/779,266
  misc_feature (1)..(155): Ceres CLONE ID no. 947579
  misc_feature (1)..(155): Functional homolog of Ceres Clone ID no. 30087
MAASQAFLLLTLSMALVHFSLAQSPMMAPSGSMSMPPMPSGGSPMPMMTPPPMPMMTPPPMAMAPPPMPMTPPPMPMAPMPMTPSSSPMSPPTTMAPSPETVPDMASPPMMPGMESSPSPGPMPPAMASPDSGAFNVRNDVVAISFLVAAHLLLV

SEQ ID NO: 1705 - protein, 152 aa, Brassica napus
  misc_feature (1)..(152): useful for making plants with increased cold tolerance as described in USSN 11/779,266
  misc_feature (1)..(152): Public GI no. 62526422
  misc_feature (1)..(152): Functional homolog of Ceres Clone ID no. 30087
MALSHPMTIFSLFLTFLALTAAQSPMMAPTMPPSTMSMPPTTSTTTPPPMSSMSPPPSAMSPTPSTMSPPPMSPMTPSMSPMGPMTPTMSPMDSPPAPAGPGMAPGMSTPGPAPGPMGGESMASPPPSSGFVHGISISMAMVAIIGSVALFF

SEQ ID NO: 1706 - protein, 150 aa, Parthenium argentatum
  misc_feature (1)..(150): useful for making plants with increased cold tolerance as described in USSN 11/779,266
  misc_feature (1)..(150): Ceres CLONE ID no. 1606506
  misc_feature (1)..(150): Functional homolog of Ceres Clone ID no. 30087
MAVSRYIILLLSFTYLAAFSTAQAPSMSPMMMPMAPPPSTMPMTPPPSTMPMTPPPTPMTMTPPPMMMPMTPPPMPMGTPPMTMPMGPPPMMMPMSPGPSMMPASPPSPMGPSMAPEPATMSPGPSMTPAETPASGAIMQYSSITMLGIV

SEQ ID NO: 1707 - DNA, 586 bp, Artificial Sequence
  misc_feature (1)..(586): useful for making plants with increased cold tolerance as described in USSN 11/779,266
  misc_feature (1)..(586): Ceres CLONE ID no. 30469
  misc_feature (1)..(586): Ceres SEED LINE ID no. ME02779
aaaagatctacaaaacagagagttgtatactttaaatcatttagaggttgtgaaatattatggagagtgaaggaaagattgtgttcacagaagagcaagaggctcttgtagtgaagtcttggagtgtcatgaagaaaaactcagctgaattaggtctcaaactcttcatcaagatctttgagattgcaccaacaacgaagaagatgttctctttcttgagagactcaccaattcctgctgagcaaaatccaaagctcaagcctcacgcaatgtctgtttttgtcatgtacaactgaggaaaacagggaaagttacggtgagggagactactttgaagagacttggagccagccattctaaatacggtgtcgttgacgaacactttgaggtggccaagtatgcattgttggagacgataaaggaggcagtgccggagatgtggtcaccggagatgaaggtggcttggggtcaggcttatgatcaccttgttgctgccattaaagctgaaatgaatctttccaactaaaaaatcatatactattatatagttgtaaacttgtaataaatatttcattttgaattgttc

SEQ ID NO: 1708 - protein, 78 aa, Artificial Sequence
  misc_feature (1)..(78): useful for making plants with increased cold tolerance as described in USSN 11/779,266
  misc_feature (1)..(78): Ceres CLONE ID no. 30469
  misc_feature (1)..(78): Ceres SEED LINE ID no. ME02779
  misc_feature (13)..(74): Pfam Name: Globin Pfam Description: Globin
MESEGKIVFTEEQEALVVKSWSVMKKNSAELGLKLFIKIFEIAPTTKKMFSFLRDSPIPAEQNPKLKPHAMSVFVMYN

SEQ ID NO: 1709 - DNA, 483 bp, Arabidopsis thaliana
  misc_feature (1)..(483): useful for making plants with increased cold tolerance as described in USSN 11/779,266
  misc_feature (1)..(483): Ceres CLONE ID no. 30469_FL
atggagagtgaaggaaagattgtgttcacagaagagcaagaggctcttgtagtgaagtcttggagtgtcatgaagaaaaactcagctgaattaggtctcaaactcttcatcaagatctttgagattgcaccaacaacgaagaagatgttctctttcttgagagactcaccaattcctgctgagcaaaatccaaagctcaagcctcacgcaatgtctgtttttgtcatgtgttgtgaatcagcagtacaactgaggaaaacagggaaagttacggtgagggagactactttgaagagacttggagccagccattctaaatacggtgtcgttgacgaacactttgaggtggccaagtatgcattgttggagacgataaaggaggcagtgccggagatgtggtcaccggagatgaaggtggcttggggtcaggcttatgatcaccttgttgctgccattaaagctgaaatgaatctttccaactaa

SEQ ID NO: 1710 - protein, 160 aa, Arabidopsis thaliana
  misc_feature (1)..(160): useful for making plants with increased cold tolerance as described in USSN 11/779,266
  misc_feature (1)..(160): Ceres CLONE ID no. 30469_FL
  misc_feature (13)..(152): Pfam Name: Globin Pfam Description: Globin
  misc_feature (1)..(160): Functional homolog of Ceres Clone ID no. 30469
MESEGKIVFTEEQEALVVKSWSVMKKNSAELGLKLFIKIFEIAPTTKKMFSFLRDSPIPAEQNPKLKPHAMSVFVMCCESAVQLRKTGKVTVRETTLKRLGASHSKYGVVDEHFEVAKYALLETIKEAVPEMWSPEMKVAWGQAYDHLVAAIKAEMNLSN

SEQ ID NO: 1711 - protein, 160 aa, Raphanus sativus
  misc_feature (1)..(160): useful for making plants with increased cold tolerance as described in USSN 11/779,266
  misc_feature (1)..(160): Public GI no. 30909306
  misc_feature (13)..(152): Pfam Name: Globin Pfam Description: Globin
  misc_feature (1)..(160): Functional homolog of Ceres Clone ID no. 30469
MESEGKIVFTEEQEALVVKSWSVMKKNSADLGLKLFIKIFEIAPTAKKLFSFLRDSPIPAEQNPKLKPHAMSVFVMCCESAAQLRKTGKVTVKETTLKRLGANHSKYGVVDEHFEVTKYALLETIKEAVPEMWSPEMKSAWGQAYDHLVAAIKAEMKPSH

SEQ ID NO: 1712 - protein, 158 aa, Arabidopsis thaliana
  misc_feature (1)..(158): useful for making plants with increased cold tolerance as described in USSN 11/779,266
  misc_feature (1)..(158): Public GI no. 37903656
  misc_feature (10)..(149): Pfam Name: Globin Pfam Description: Globin
  misc_feature (1)..(158): Functional homolog of Ceres Clone ID no. 30469
MEGKVFTEEQETLVVKSWGVMKKNAAELGLKFFLKIFEIAPSAQKLFSFLRDSDIPLEKNPKLKPHAMSVFVMTCESAVQLRKAGKVTVRESTLKRLGGVHFKSGVVDEHYEVTKFALLETIKEALPEMWSPEMKNAWGEAYDQLVAAIKSEMKPPLN

SEQ ID NO: 1713 - protein, 163 aa, Arabidopsis thaliana
  misc_feature (1)..(163): useful for making plants with increased cold tolerance as described in USSN 11/779,266
  misc_feature (1)..(163): Public GI no. 15824736
  misc_feature (13)..(152): Pfam Name: Globin Pfam Description: Globin
  misc_feature (1)..(163): Functional homolog of Ceres Clone ID no. 30469
MATYEGKVFTEEQEALVVKSWTVMKKKTAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSQAA

SEQ ID NO: 1714 - protein, 161 aa, Glycine max
  misc_feature (1)..(161): useful for making plants with increased cold tolerance as described in USSN 11/779,266
  misc_feature (1)..(161): Ceres CLONE ID no. 546001
  misc_feature (13)..(152): Pfam Name: Globin Pfam Description: Globin
  misc_feature (1)..(161): Functional homolog of Ceres Clone ID no. 30469
MTTTLERGFSEEQEALVVKSWNVMKKNSGELGLKFFLKIFEIAPSAQKLFSFLRDSTVPLEQNPKLKPHAVSVFVMTCDSAVQLRKAGKVTVRESNLKKLGATHFRTGVANEHFEVTKFALLETIKEAVPEMWSPAMKNAWGEAYDQLVDAIKSEMKPPSS

SEQ ID NO: 1715 - protein, 160 aa, Glycine max
  misc_feature (1)..(160): useful for making plants with increased cold tolerance as described in USSN 11/779,266
  misc_feature (1)..(160): Public GI no. 11095158
  misc_feature (13)..(152): Pfam Name: Globin Pfam Description: Globin
  misc_feature (1)..(160): Functional homolog of Ceres Clone ID no. 30469
MGTLDTKGFTEEQEALVVKSWNAMKKNSAELGLKLFLKIFEIAPSAQKLFSFLKDSKVPLEQNTKLKPHAMSVFLMTCESAVQLRKSGKVTVRESSLKKLGANHFKYGVVDEHFEVTKFALLETIKEAVPEMWSPAMKNAWGEAYDQLVNAIKSEMKPSS

SEQ ID NO: 1716 - protein, 152 aa, Glycine max
  misc_feature (1)..(152): useful for making plants with increased cold tolerance as described in USSN 11/779,266
  misc_feature (1)..(152): Public GI no. 12963875
  misc_feature (8)..(147): Pfam Name: Globin Pfam Description: Globin
  misc_feature (1)..(152): Functional homolog of Ceres Clone ID no. 30469
MSSFSEEQEALVVKSWGSMKKDAGEWGLKFFLKIFEIAPSAKKMFSFLKDSNVPLDQNPKLKIHAKSVLVMTCEAAVQLRKAGKVVVRDSTLKKIGATHFKYGVVDEHFEVTKYALLETIKEASQEMWSVEMKNAWGEAYDQLVSAIKTEMK

SEQ ID NO: 1717 - protein, 165 aa, Zea mays
  misc_feature (1)..(165): useful for making plants with increased cold tolerance as described in USSN 11/779,266
  misc_feature (1)..(165): Ceres CLONE ID no. 1554560
  misc_feature (17)..(157): Pfam Name: Globin Pfam Description: Globin
  misc_feature (1)..(165): Functional homolog of Ceres Clone ID no. 30469
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 1718 - protein, 162 aa, Triticum aestivum
  misc_feature (1)..(162): useful for making plants with increased cold tolerance as described in USSN 11/779,266
  misc_feature (1)..(162): Ceres CLONE ID no. 839727
  misc_feature (14)..(154): Pfam Name: Globin Pfam Description: Globin
  misc_feature (1)..(162): Functional homolog of Ceres Clone ID no. 30469
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 1719 - protein, 169 aa, Triticum aestivum
  misc_feature (1)..(169): useful for making plants with increased cold tolerance as described in USSN 11/779,266
  misc_feature (1)..(169): Public GI no. 14701800
  misc_feature (21)..(161): Pfam Name: Globin Pfam Description: Globin
  misc_feature (1)..(169): Functional homolog of Ceres Clone ID no. 30469
MALVEGNNGVSGGAVSFSEEQEALVLKSWAIMKKDSANIGLRFFLKIFEVAPSASQMFSFLRNSDVPLEKNPKLKTHAMSVFVMTCEAAAQLRKAGKVTVRDTTLKRLGATHFKYGVGDAHFEVTRFALLETIKEAVPVDMWSPAMKSAWSEAYNQLVAAIKQEMKPAE

SEQ ID NO: 1720 - DNA, 416 bp, Arabidopsis thaliana
  misc_feature (1)..(416): useful for making plants with increased cold tolerance as described in USSN 11/779,266
  misc_feature (1)..(416): Ceres CLONE ID no. 271922
  misc_feature (1)..(416): Ceres SEED LINE ID no. ME03944
gctcattagggtttctcatctacgacggcgtggtgttcctccttcctgctctgaaaaatggcgaagagaacgaagaaggttggaatcgtcggcaaatacggaacacgttatggtgcgagtatcaggaagcagattaagaagatggaggtcagccagcacagcaagtacttctgtgagttctgtggcaagtacggagtgaagcgaaaggctgttggtatctggggttgcaaggattgtggcaaggtcaaggcaggtggtgcttacacaatgaacaccgccagtgcggtcactgttagaagcacgatcagaaggttgagggagcagatcgagggttaaaagtctgctggctttttatatttggtttccttgttttgacaatttaagttttgcatcaacagtgagaacatgttttgatt

SEQ ID NO: 1721 - protein, 92 aa, Arabidopsis thaliana [sequence omitted]

SEQ ID NO: 1722 - protein, 92 aa, Arabidopsis thaliana
  misc_feature (1)..(92): useful for making plants with increased cold tolerance as described in USSN 11/779,266
  misc_feature (1)..(92): Public GI no. 4090257
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSKFFCEFCGKFAVKRKAVGIWGCKDCGKVKAGGAYTLNTPSAVTVRSTIRRLREQTEG

SEQ ID NO: 1723 - protein, 92 aa, Arabidopsis thaliana
  misc_feature (1)..(92): useful for making plants with increased cold tolerance as described in USSN 11/779,266
  misc_feature (1)..(92): Public GI no. 4741896
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSKYFCEFCGKYAVKRKAVGIWGCKACGKVKAGGAYTLNTASAVTVRSTIRRLREQTES

SEQ ID NO: 1724 - protein, 92 aa, Arabidopsis thaliana
  misc_feature (1)..(92): useful for making plants with increased cold tolerance as described in USSN 11/779,266
  misc_feature (1)..(92): Ceres CLONE ID no. 36046
  misc_feature (2)..(91): Pfam Name: Ribosomal_L37ae Pfam Description: Ribosomal L37ae protein family
  misc_feature (1)..(92): Functional homolog of Ceres Clone ID no. 271922
  misc_feature (45)..(45): Xaa is any aa, unknown or other
  misc_feature (49)..(49): Xaa is any aa, unknown or other
MAKRTKKVGIVGKYGTRYGASIRKQIKKMEVSQHSKYFCEFCGKXGVKXKAVGIWGCKDCGKVKAGGAYTMNTASAVTVRSTIRRLREQIEG

SEQ ID NO: 1725 - protein, 92 aa, Arabidopsis thaliana
  misc_feature (1)..(92): useful for making plants with increased cold tolerance as described in USSN 11/779,266
  misc_feature (1)..(92): Public GI no. 6016699
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKARIVGKYGTRYGASLRKQIKKMEVSQHNKYFCEFCGKYSVKRKVVGIWGCKDCGKVKAGGAYTMNTASAVTVRSTIRRLREQTES

SEQ ID NO: 1726 - protein, 92 aa, Glycine max
  misc_feature (1)..(92): useful for making plants with increased cold tolerance as described in USSN 11/779,266
  misc_feature (1)..(92): Ceres CLONE ID no. 664936
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSKFFCEFCGKYAVKRKAVGIWGCKDCGKVKAGGAYTLNTASAVTVRSTIRRLREQTEG

SEQ ID NO: 1727 - protein, 92 aa, Glycine max
  misc_feature (1)..(92): useful for making plants with increased cold tolerance as described in USSN 11/779,266
  misc_feature (1)..(92): Ceres CLONE ID no. 658438
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 1728 - protein, 92 aa, Glycine max
  misc_feature (1)..(92): useful for making plants with increased cold tolerance as described in USSN 11/779,266
  misc_feature (1)..(92): Ceres CLONE ID no. 1049262
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSKFFCEFCGKYAVKRKAVGIWGCKDCGKVKAGGAYTLNTASAVTVRSTIRRLREQTES

SEQ ID NO: 1729 - protein, 92 aa, Triticum aestivum; identical to SEQ ID NO: 1727
  misc_feature (1)..(92): useful for making plants with increased cold tolerance as described in USSN 11/779,266
  misc_feature (1)..(92): Ceres CLONE ID no. 632613
  misc_feature (2)..(91): Pfam Name: Ribosomal_L37ae Pfam Description: Ribosomal L37ae protein family
  misc_feature (1)..(92): Functional homolog of Ceres Clone ID no. 271922

SEQ ID NO: 1730 - protein, 92 aa, Zea mays; identical to SEQ ID NO: 1727
  misc_feature (1)..(92): useful for making plants with increased cold tolerance as described in USSN 11/779,266
  misc_feature (1)..(92): Ceres CLONE ID no. 1390976
  misc_feature (2)..(91): Pfam Name: Ribosomal_L37ae Pfam Description: Ribosomal L37ae protein family
  misc_feature (1)..(92): Functional homolog of Ceres Clone ID no. 271922

SEQ ID NO: 1731 - protein, 92 aa, Zea mays; identical to SEQ ID NO: 1727
  misc_feature (1)..(92): useful for making plants with increased cold tolerance as described in USSN 11/779,266
  misc_feature (1)..(92): Ceres CLONE ID no. 1457185
  misc_feature (2)..(91): Pfam Name: Ribosomal_L37ae Pfam Description: Ribosomal L37ae protein family
  misc_feature (1)..(92): Functional homolog of Ceres Clone ID no. 271922

SEQ ID NO: 1732 - protein, 92 aa, Zea mays; identical to SEQ ID NO: 1727
  misc_feature (1)..(92): useful for making plants with increased cold tolerance as described in USSN 11/779,266
  misc_feature (1)..(92): Public GI no. 56202147
  misc_feature (2)..(91): Pfam Name: Ribosomal_L37ae Pfam Description: Ribosomal L37ae protein family
  misc_feature (1)..(92): Functional homolog of Ceres Clone ID no. 271922

SEQ ID NO: 1733 - protein, 92 aa, Zea mays
  misc_feature (1)..(92): useful for making plants with increased cold tolerance as described in USSN 11/779,266
  misc_feature (1)..(92): Public GI no. 58578274
  misc_feature (2)..(91): Pfam Name: Ribosomal_L37ae Pfam Description: Ribosomal L37ae protein family
  misc_feature (1)..(92): Functional homolog of Ceres Clone ID no. 271922
MTKRTKKAGIVGKYGTRYGASLRKQIKKMEVSQHSEYFCEFCGKYAVKRKAVGIWGCKDCGKVKAGGAYTLNTASAVTVRSTIRRLREQTES

SEQ ID NO: 1734 - DNA, 632 bp, Arabidopsis thaliana
  misc_feature (1)..(632): useful for making plants with increased cold tolerance as described in USSN 11/779,266
  misc_feature (1)..(632): Ceres CLONE ID no. 2403_FL
attccccatcgcacagacccgcctaagaatccgagagagaagaagagataatgcagatcttcgtcaaaaccctcaccggcaaaactataaccctagaggttgagagcagcgacaccatcgacaatgttaaagccaaaatccaggacaaatagggcataccacctgatcaacagaggctgatttttgctggtaagcaattggaagatggccggaccttagctgactacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggctcatctatgccggaaaacagcttgctgatgacaaaacggccaaagattatgcgatagagggaggctctgttcttcatttggttcttgctcttaggggtggtcttctctgatctgaataaataagcttttcaacaaacatctttcccctcactattgtcctccttttgtggaattcatgacacacaaaaattgctatgggaaattggaatattatgatgttttttctc

SEQ ID NO: 1735 - protein, 154 aa, Arabidopsis thaliana
  misc_feature (1)..(154): useful for making plants with increased cold tolerance as described in USSN 11/779,266
  misc_feature (1)..(154): Ceres CLONE ID no. 2403_FL
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(154): Functional homolog of Ceres Clone ID no. 2403
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYAIEGGSVLHLVLALRGGLL

SEQ ID NO: 1736 - protein, 154 aa, Zea mays
  misc_feature (1)..(154): useful for making plants with increased cold tolerance as described in USSN 11/779,266
  misc_feature (1)..(154): Ceres CLONE ID no. 1482731
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(154): Functional homolog of Ceres Clone ID no. 2403
MQIFVKTLTGKTITLEVESSDTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGSD

SEQ ID NO: 1737 - protein, 154 aa, Glycine max
  misc_feature (1)..(154): useful for making plants with increased cold tolerance as described in USSN 11/779,266
  misc_feature (1)..(154): Ceres CLONE ID no. 522921
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(154): Functional homolog of Ceres Clone ID no. 2403
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKEYNIEGGSVLHLVLALRGGTY

SEQ ID NO: 1738 - protein, 147 aa, Brassica napus
  misc_feature (1)..(147): useful for making plants with increased cold tolerance as described in USSN 11/779,266
  misc_feature (1)..(147): Ceres CLONE ID no. 1036726
  misc_feature (1)..(74): Pfam Name: ubiquitin Pfam Description: Ubiquitin family
  misc_feature (77)..(142): Pfam Name: ubiquitin Pfam Description: Ubiquitin family
  misc_feature (1)..(147): Functional homolog of Ceres Clone ID no. 2403
  misc_feature (132)..(132): Xaa is any aa, unknown or other
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTXKDYNIEGGSVSASGS

SEQ ID NO: 1739 - protein, 153 aa, Glycine max
  misc_feature (1)..(153): useful for making plants with increased cold tolerance as described in USSN 11/779,266
  misc_feature (1)..(153): Ceres CLONE ID no. 513071
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(153): Functional homolog of Ceres Clone ID no. 2403
  misc_feature (146)..(146): Xaa is any aa, unknown or other
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLXLALRGGY

SEQ ID NO: 1740 - DNA, 620 bp, Artificial Sequence
  misc_feature (1)..(620): useful for making plants with increased cold tolerance as described in USSN 11/779,266
  misc_feature (1)..(620): Ceres CLONE ID no. 2403
  misc_feature (1)..(620): Ceres SEED LINE ID no. ME05304
attccccatcgcacagacccccctaagaatccgagagagaagaagagataatgcagatcttcgtcaaaaccctcaccggcaaaactataaccctagaagttgagagcagcgacaccatcgacaatgttaaagccaaaatccaggacaaagagggcataccacctgatcaacagaggctgatttttgctggtaagcaattggaagatggccggaccttagctgattacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggctcatatatgccggaaaacagcttgctgatgacaaaacggccaaagattatgcgatagagggaggctctgttcttcatttggttcttgctcttaggggtggtcttctctgatcttaataaataagcttttcaacaaacatcttttccctcactattgtcctccttatgtggaattcatgacacaccaaaattgctatgggaaattggaatattatg

SEQ ID NO: 1741 - protein, 33 aa, Artificial Sequence
  misc_feature (1)..(33): useful for making plants with increased cold tolerance as described in USSN 11/779,266
  misc_feature (1)..(33): Ceres CLONE ID no. 2403
  misc_feature (1)..(33): Ceres SEED LINE ID no. ME05304
  misc_feature (1)..(33): Pfam Name: ubiquitin Pfam Description: Ubiquitin family
MQIFVKTLTGKTITLEVESSDTIDNVKAKIQDK

SEQ ID NO: 1742 - DNA, 1106 bp, Glycine max
  misc_feature (1)..(1106): useful for making plants with increased cold tolerance as described in USSN 11/779,266
  misc_feature (1)..(1106): Ceres CLONE ID no. 674166
  misc_feature (1)..(1106): Ceres SEED LINE ID no. ME03186
atatttttgtgtagatgaagatcaacaagagaaggtgttgttgtgagttgtgttgttatggtaccttccttcaaccacaaaacctctctccctctaccacccattctcttctctctctctctctcccgtcctccatctctcaccttctcaatctcttcaccaccaccatcatcatcattatcttctccaatctctataacctcgaaatccctcaaaacctctccctcaaaccaaatgaaatgacccttttgtgagaacattttttcccccttaagaaaaggtcaaaggctgcaactttttcttaaccaatctcacatttttttatttttcaacgtattttggccaggtttggttttctgggttgtcttggaattcaaaaaagattccaactttgaagatgggtaggggtggaaccgccgcggcggcggcggaggtcgccgaacccggtttaaggccggtttatttcaaagaacagcgatataggggcgtcagaaaaagaccgtggggccggttcgctgccgaaatcagagaccctttgaagaaagccagggtttggctcggaacctttgacaccgccgaggaggcggcgcgtgcctacgacacggcggcgagaaccctccggggaccaaaggcgaagaccaatttccctctttctccgccgttctaccatcccgatccattttccgatcaccggcacttcgccaacaccggcgaagatttccacgatcaccggcgaccaacatccagtggcatgagcagcaccgtagagtccttcagcggcccccgtgctgccgtgccggcgacagcgccggtggccaccggccggagatatccccggacgccacccgttatccccgaggactgccgcagcgactgcgattcgtcgtcctccgtcgttgacgacggcgaaggcgacaacgtggcgtcgtcgttcccgcgagaaccgttgccgtttgatctaaacgcgttgccgttagacgatgctgacgtggcaaccgatgatctgttctgcaccgttctttgcctctgatgagaaaaaatgaaaaaacggaacgaaatgatgtatttggttcgttgacggaattattattatttttttctttctt

SEQ ID NO: 1743 - protein, 210 aa, Glycine max
  misc_feature (1)..(210): useful for making plants with increased cold tolerance as described in USSN 11/779,266
  misc_feature (1)..(210): Ceres CLONE ID no. 674166
  misc_feature (1)..(210): Ceres SEED LINE ID no. ME03186
  misc_feature (26)..(89): Pfam Name: AP2 Pfam Description: AP2 domain
  misc_feature (26)..(89): Pfam Name: AP2; Pfam Description: AP2 domain
MGRGGTAAAAAEVAEPGLRPVYFKEQRYRGVRKRPWGRFAAEIRDPLKKARVWLGTFDTAEEAARAYDTAARTLRGPKAKTNFPLSPPFYHPDPFSDHRHFANTGEDFHDHRRPTSSGMSSTVESFSGPRAAVPATAPVATGRRYPRTPPVIPEDCRSDCDSSSSVVDDGEGDNVASSFPREPLPFDLNALPLDDADVATDDLFCTVLCL

SEQ ID NO: 1744 - protein, 225 aa, Glycine max
  misc_feature (1)..(225): useful for making plants with increased cold tolerance as described in USSN 11/779,266
  misc_feature (1)..(225): Public GI no. 12322345
  misc_feature (26)..(89): Pfam Name: AP2 Pfam Description: AP2 domain
  misc_feature (1)..(225): Functional homolog of Ceres Clone ID no. 674166
MRRGRGSSAVAGPTVVAAINGSVKEIRFRGVRKRPWGRFAAEIRDPWKKARVWLGTFDSAEEAARAYDSAARNLRGPKAKTNFPIDSSSPPPPNLRFNQIRNQNQNQVDPFMDHRLFTDHQQQFPIVNRPTSSSMSSTVESFSGPRPTTMKPATTKRYPRTPPVVPEDCHSDCDSSSSVIDDDDDIASSSRRRNPPFQFDLNFPPLDCVDLFNGADDLHCTDLRL

SEQ ID NO: 1745 - protein, 215 aa, Brassica napus
  misc_feature (1)..(215): useful for making plants with increased cold tolerance as described in USSN 11/779,266
  misc_feature (1)..(215): Ceres CLONE ID no. 975672
  misc_feature (21)..(84): Pfam Name: AP2 Pfam Description: AP2 domain
  misc_feature (1)..(215): Functional homolog of Ceres Clone ID no. 674166
  misc_feature (174)..(174): Xaa is any aa, unknown or other
  misc_feature (194)..(194): Xaa is any aa, unknown or other
  misc_feature (208)..(208): Xaa is any aa, unknown or other
  misc_feature (209)..(209): Xaa is any aa, unknown or other
  misc_feature (214)..(214): Xaa is any aa, unknown or other
MRKGRGSSAVPPALPGSVKEPRYRGVRKRPWGRFAAEIRDPLKKSRVWLGTFDSAEEAARAYDAAARNLRGPKAKTNFQIDCSPSSPLQPLHHRNQIDPFMDHRLYGGEQEVVIISRPASSSMSSTVKSCSGVRPASSSVAKAATKRYPRTPPVAPEDCRSDCDSSSSVVEDGXDIASSSSRRKPPFEFDLNFXPLDGVDLFVGADDXXCTDLXL

SEQ ID NO: 1746 - protein, 211 aa, Zea mays
  misc_feature (1)..(211): useful for making plants with increased cold tolerance as described in USSN 11/779,266
  misc_feature (1)..(211): Ceres CLONE ID no. 273307
  misc_feature (17)..(80): Pfam Name: AP2 Pfam Description: AP2 domain
  misc_feature (1)..(211): Functional homolog of Ceres Clone ID no. 674166
MRRRGVAAADADGDVELRFRGVRKRPWGRYAAEIRDPAKKARVWLGTFDSAEDAARAYDAAARMLRGPKARTNFPLPAAAALHHPHMPAAAAAAAPPYTTYPTATGVVSTPPVARPACSSLSSTVESFSGARPRPVLPPRFPPPSIPDGDCRSDCGSSASVVDDDCTDAAASASCPFPLPFDLNLPPGGGGAGVGFYADEEDELRLTALRL

SEQ ID NO: 1747 - protein, 194 aa, Triticum aestivum
  misc_feature (1)..(194): useful for making plants with increased cold tolerance as described in USSN 11/779,266
  misc_feature (1)..(194): Ceres CLONE ID no. 1055099
  misc_feature (20)..(83): Pfam Name: AP2 Pfam Description: AP2 domain
  misc_feature (1)..(194): Functional homolog of Ceres Clone ID no. 674166
MRKARPPQPQPQPSQQSPEIRYRGVRKRPSGRYAAEIRDPAKKTPIWLGTFDCAEDAARAYDSAARSLRGPTARTNFPPSSATQPPPRPPPPAAAAAAATSSQSSTVESWSGGGPRAPARARSAARAGTAKEGEEDCRSYCGSSSSVLLEEGADDAAASRSPLPFDLNMPPPQEGALDAEADQMTCRYDTLLRL

SEQ ID NO: 1748 - DNA, 660 bp, Populus balsamifera subsp. trichocarpa
  misc_feature (1)..(660): useful for making plants with increased cold tolerance as described in USSN 11/779,266
  misc_feature (1)..(660): Ceres ANNOT ID no.1441430
atggggagaacaagaacaacaacaaaacaggctgttgacccaaatggatctgcaacccaaaatatgttagtaattgcaaaagagcccagatacagaggagtacgaaagagaccatggggaagattcgctgcggagattagagatccctggaaaaagaccagagtttggctgggcaccttcgactctgcagaggatgcagcgcgtgcctacgatgcggctgctcgcaccctccgcggagcaaaggccaagacaaactttcctatctccacaacgaaccagttattcaatcatcaaaatcaaaaccaaagcccaaccgatcccttcttggatcaccacagtataaatccccaaagacccacatctagcagtttgagcagtacagtggagtctttcagcggtcctaggcctccgcagccaacaacaacaacaaaatcgggaaatgggccgaggagatctcatccacggatcccaccggttgttccagaagattgtcatagcgattgcgattcatcttcttcggtggttgatgacagagatgtcgcatccgctgcttcttctttgtgccgcaagcctttgcctttcgatctaaatttcccaccgttggaccaggttgacttgggctctggtgatgatctccactgcactgctttatgcctttga

SEQ ID NO: 1749 - protein, 219 aa, Populus balsamifera subsp. trichocarpa
  misc_feature (1)..(219): useful for making plants with increased cold tolerance as described in USSN 11/779,266
  misc_feature (1)..(219): Ceres ANNOT ID no. 1441430
  misc_feature (29)..(92): Pfam Name: AP2 Pfam Description: AP2 domain
  misc_feature (1)..(219): Functional Homolog of Ceres CLONE ID no. 674166 Given in SEQ ID NO: 42
MGRTRTTTKQAVDPNGSATQNMLVIAKEPRYRGVRKRPWGRFAAEIRDPWKKTRVWLGTFDSAEDAARAYDAAARTLRGAKAKTNFPISTTNQLFNHQNQNQSPTDPFLDHHSINPQRPTSSSLSSTVESFSGPRPPQPTTTTKSGNGPRRSHPRIPPVVPEDCHSDCDSSSSVVDDRDVASAASSLCRKPLPFDLNFPPLDQVDLGSGDDLHCTALCL

SEQ ID NO: 1750 - DNA, 985 bp, Glycine max
  misc_feature (1)..(985): useful for making plants with increased cold tolerance as described in USSN 11/779,266
  misc_feature (1)..(985): Ceres CLONE ID no.1240330
attattcctcttccatctctattctccataacacccaccacaccacttgtgaaaaacctcattaatatcacacactgacatgtatctctgagctccaatccaatacaagaccacaccttgtcgtgtcggacgaaccttggtgtctgtttttttttttttttcattattttctccgaagagatgaggaagggcagaggtggaggcgcctcggcggcggcggtggatgtgaacggatccattttaaaggagcctcggtaccggggcgtgaggaagagaccgtgggggagattcgccgcggagatcagagacccgttgaagaaagccagggtttggttgggaaccttcgattctgccgaggatgctgctcgtgcctacgacgccgccgctcggactctccgaggtcccaaggccaaaacaaatttcccccctctctcacctttttgctatccacaccccaccaccgatcctttcttctacactggtttccacgatcaacaccaccaccacaacaacaacaaccttaacaaccctcaaagacccacttcaagtggcatgagtagcaccgttgagtccttcagtgggccccgccctcccaccaccaccactaccaccacaaccacaactgcgacgccgtttttgactgctacgcggagatacccgcgcactccccctcttgtccctgaagactgccacagtgactgcgactcttcctcctccgtcgttgacgacggcgacgacaacatcgtttcgtcgtcgtttcgacctcccttgccgtttgatctcaacgcgctgccgtttgatgatgctgccgcggatgatgatctacgccgcaccgcgctttgtctctgatgatgattatcgtgcgatgatgatttttaatttctcatttttttacttgatttttttgttattgctatgcagaagaaatatatatttaaaatgatgatcagatgtaagattatggtaatatgatcttaattctgtg

SEQ ID NO: 1751 - protein, 222 aa, Glycine max
  misc_feature (1)..(222): useful for making plants with increased cold tolerance as described in USSN 11/779,266
  misc_feature (1)..(222): Ceres CLONE ID no. 1240330
  misc_feature (24)..(87): Pfam Name: AP2 Pfam Description: AP2 domain
  misc_feature (1)..(222): Functional Homolog of Ceres CLONE ID no. 674166 Given in SEQ ID NO: 42
MRKGRGGGASAAAVDVNGSILKEPRYRGVRKRPWGRFAAEIRDPLKKARVWLGTFDSAEDAARAYDAAARTLRGPKAKTNFPPLSPFCYPHPTTDPFFYTGFHDQHHHHNNNNLNNPQRPTSSGMSSTVESFSGPRPPTTTTTTTTTTATPFLTATRRYPRTPPLVPEDCHSDCDSSSSVVDDGDDNIVSSSFRPPLPFDLNALPFDDAAADDDLRRTALCL

SEQ ID NO: 1752 - DNA, 726 bp, Zea mays
  misc_feature (1)..(726): useful for making plants with increased cold tolerance as described in USSN 11/779,266
  misc_feature (1)..(726): Ceres CLONE ID no.1382611
acttttctctcccattcttttacaactcacgttgcacagcctttttctctatatattacttgacataaactactattcacaacacaaacacacacataaccatggcctcttcttcacaagctttccttttgctcacattgtctatggttttagttcatttctctttagctcaatctcccatgatggctccttctggctccatgtccatgccgccaatgcctagcggcggctctccaatgccaatgatgactccaccacctatgccaatgatgactccaccacctatggctatggctccaccacctatgcctatgactccaccaccaatgcccatggctccgatgccaatgactccatcttcaagtccaatgagcccaccaactactatggccccaagtccagaaacagtccctgatatggcttcgccaccgatgatgccaggaatggattcttctccttctccgggacccatgccaccggcaatggcctctccagattccggagcattcaatgtaagaaacgacgtcgtagcaatttcgttccttgttgcagctcatttgctcctagtttgagattattattaaattggccagcgtcgtgtttgtgtaatttactttcatttttttctcgagccattaattttcatgttttatcatatatttgggtttgtgtttgatatggtacgattcagacatttgtttgcttaataagtttatcgttgactct

SEQ ID NO: 1753 - protein, 156 aa, Zea mays
  misc_feature (1)..(156): useful for making plants with increased cold tolerance as described in USSN 11/779,266
  misc_feature (1)..(156): Ceres CLONE ID no. 1382611
  misc_feature (1)..(156): Functional Homolog of Ceres CLONE ID no. 30087 Given in SEQ ID NO: 2
MASSSQAFLLLTLSMVLVHFSLAQSPMMAPSGSMSMPPMPSGGSPMPMMTPPPMPMMTPPPMAMAPPPMPMTPPPMPMAPMPMTPSSSPMSPPTTMAPSPETVPDMASPPMMPGMDSSPSPGPMPPAMASPDSGAFNVRNDVVAISFLVAAHLLLV

SEQ ID NO: 1754 - DNA, 580 bp, Papaver somniferum
  misc_feature (1)..(580): useful for making plants with increased cold tolerance as described in USSN 11/779,266
  misc_feature (1)..(580): Ceres CLONE ID no.1627907
gcagaagcacaaggtaagattgaaggaggagaccggaactcttcttcgccaaaaccctagttcgagctcaccaacaacaatctttcgcaatgactaagcgtaccaagaaggccggaattgtgggtaaatatggtaccagatatggagcttcattaaggaaacagattaagaagatggaagtgagtcagcatgcaaagtacttctgtgagttctgcggaaagtacgctgtgaagagacaggctgttggaatctggggatgcaaggattgtggcaaagttaaagctggtggtgcttacactttgaacaccgccagtgccgtgacagttagaagcaccattagaaggttgagggagcaaactgaatcttagattgatctcgttatctatattttgtattttggtactgggtgagaggtaccatcagagctaatttagtgtttatcaccttttctggtcttcaagaactagttagtcattttgttattcagagatttttgataatgtctagtatcttacatttgtgagcagactatttctttgtttcaaattatggagttctgatgaatcttatatttattctc

SEQ ID NO: 1755 - protein, 92 aa, Papaver somniferum
  misc_feature (1)..(92): useful for making plants with increased cold tolerance as described in USSN 11/779,266
  misc_feature (1)..(92): Ceres CLONE ID no. 1627907
  misc_feature (2)..(91): Pfam Name: Ribosomal_L37ae Pfam Description: Ribosomal L37ae protein family
  misc_feature (1)..(92): Functional Homolog of Ceres CLONE ID no. 271922 Given in SEQ ID NO: 20
MTKRTKKAGIVGKYGTRYGASLRKQIKKMEVSQHAKYFCEFCGKYAVKRQAVGIWGCKDCGKVKAGGAYTLNTASAVTVRSTIRRLREQTES

SEQ ID NO: 1756 - DNA, 983 bp, Panicum virgatum
  misc_feature (1)..(983): useful for making plants with increased cold tolerance as described in USSN 11/779,266
  misc_feature (1)..(983): Ceres CLONE ID no.1761125
accagaccacaccacaccacaccgcgtccacatcctcccgcgcttctccgctcagcccgcgcgtttccgctgaggagggatagccgcgcggcgcgtcgaggggtttgtctttgatcgggtagctgaggctgagcgggcggggcaggatgatgcgcgacacggcggccgtggccgtggcggcgccgcggtacaggggcgtgcggaagcggccgtggggccggttcgcggcggagatccgcgacccggcgaagcgcgcgcgcgtctggctcggcaccttcgactccgccgaggccgcggcgcgcgcctacgacgtcgccgcgcggaccctgcgcggcccgctcgccaggaccaacttcccctgcgcctcctcccgcctcccgctgccctcccgccaccaaggcggctgtggcggcggcctcgtcgcgccgccgcccgccgcgccgacgtgcagctccagctccaccgtcgagtcctccagcggaccccgaggggcgcccagggctgctgcggcggcggcgcctcgaattcggaggcggtcggtgaaaaagccgcggccggcagcgcccgacatcgactgccacagcgactgcgcctcgtcggcctccgtcgtggacgacggcgacgacgcctccacggtccggtcgcgcgcgccgttcgacctcaacgtcccggctccggtggacggtgaccacgccctcgacctctgcacggagctgcggctctgagcaatatgatcctcgaacaacaacaacagcaaaacattgaaggcgatttttccccggtcttcttttcctgactaaattctgatatgatcaatatgctcgagagttctcgttttctttaacgcctcttgtatttggatctgctaccatcttctctgcccattctatttgtacaccagataacatgtaagatgttcacgaattaacacatatcttttcttaaaaaaatgaattaacacggaaaaaaaaaaaaaaaaaaaa

SEQ ID NO: 1757 - protein, 192 aa, Panicum virgatum
  misc_feature (1)..(192): useful for making plants with increased cold tolerance as described in USSN 11/779,266
  misc_feature (1)..(192): Ceres CLONE ID no. 1761125
  misc_feature (13)..(76): Pfam Name: AP2 Pfam Description: AP2 domain
  misc_feature (1)..(192): Functional Homolog of Ceres CLONE ID no. 674166 Given in SEQ ID NO: 42
MMRDTAAVAVAAPRYRGVRKRPWGRFAAEIRDPAKRARVWLGTFDSAEAAARAYDVAARTLRGPLARTNFPCASSRLPLPSRHQGGCGGGLVAPPPAAPTCSSSSTVESSSGPRGAPRAAAAAAPRIRRRSVKKPRPAAPDIDCHSDCASSASVVDDGDDASTVRSRAPFDLNVPAPVDGDHALDLCTELRL

SEQ ID NO: 1758 - DNA, 594 bp, Panicum virgatum
  misc_feature (1)..(594): useful for making plants with increased cold tolerance as described in USSN 11/779,266
  misc_feature (1)..(594): Ceres CLONE ID no.1783890
gagccctacccgcacccgcgccgccgccgccccgcgccccgtcgccgcagacgactccgccccgtcgccgcgatgacgaagcgcaccaagaaggccggaatcgtcggcaaatatggaactaggtatggtgctagcttgcgtaagcaaatcaagaagatggaggtgtctcagcactccaagtacttctgcgagttctgtggaaagtttgctgtgaaaaggaaagcagttggaatctggggatgcaaggactgcgggaaggttaaggctggtggtgcttacaccatgaacactgctagtgcagtcaccgtcaggagcacaatccgtcgcttgagggagcagactgaagcataatcggagctcttctctgcagtagtcctgtgctttttgtaccgtctaagacatatggctgtttggcctaagaacattcatgaatattctggttatgcttaaggatatcaaaaattatggtgctaaaatttgtacttcgttgctgttgcaaagttgacctgtcttgatccattcataatgtagaatttcctcatggttcttatctccagtttgctactctttggccaaaaaaaaaaaaaaaaaaaa

SEQ ID NO: 1759 - protein, 92 aa, Panicum virgatum; identical to SEQ ID NO: 1727
  misc_feature (1)..(92): useful for making plants with increased cold tolerance as described in USSN 11/779,266
  misc_feature (1)..(92): Ceres CLONE ID no. 1783890
  misc_feature (2)..(91): Pfam Name: Ribosomal_L37ae Pfam Description: Ribosomal L37ae protein family
  misc_feature (1)..(92): Functional Homolog of Ceres CLONE ID no. 271922 Given in SEQ ID NO: 20

SEQ ID NO: 1760 - DNA, 880 bp, Panicum virgatum
  misc_feature (1)..(880): useful for making plants with increased cold tolerance as described in USSN 11/779,266
  misc_feature (1)..(880): Ceres CLONE ID no.1802327
acacagatacattcgtcgatccaccactgtccagtgcttggcggttacgcacgcacgcacacagataggattatcttttactacaccaactcaccaagatactagcaagccgaatcgacaaacaagcagcaggaagaggaggcatggcgctcgcggaggggaacgtcatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctcgagaagaaccccaagctcaagaaccacgccatgtccgtcttcgtcatgacctgcgaggcggcggcgcagctacggaaggccgggaaggtcaccgtcagggagacgacgctcaagcggctgggcgccacgcacttcaagtacggcgtcgccgacggccacttcgaggtgacgaggttcgcgctgctggagacgataaaggaggcgcttcccgccgacatgtggagcctggagatgaagaacgcctggagcgaggcttacaaccagctggtggcggccatcaagcaggagatgaagcctgccgcatgatgctgctgctgctactgagatgaagcctgcccgcatgatgctgctgctgctactcggcctccgcgctgagttccccctacgatgcaccaccatctccaaattcttcatcgctgtttttttttttttgctgttttgacttgtattgtgcattttccaaatctctcgatggagacaagtgtgatgactaatttttgagagcatgtatatatgttgtgatgagcattgaataaaaaaaaaaaaaaaaaaaa

SEQ ID NO: 1761 - protein, 162 aa, Panicum virgatum
  misc_feature (1)..(162): useful for making plants with increased cold tolerance as described in USSN 11/779,266
  misc_feature (1)..(162): Ceres CLONE ID no. 1802327
  misc_feature (14)..(154): Pfam Name: Globin Pfam Description: Globin
  misc_feature (1)..(162): Functional homolog of Ceres Clone ID no. 30469
MALAEGNVIFGEEQEALVLKSWALMKKDSADLGLRFFLKIFEIAPSAKQMFSFLRDSDVPLEKNPKLKNHAMSVFVMTCEAAAQLRKAGKVTVRETTLKRLGATHFKYGVADGHFEVTRFALLETIKEALPADMWSLEMKNAWSEAYNQLVAAIKQEMKPAA

SEQ ID NO: 1762 - DNA, 1017 bp, Gossypium hirsutum
  misc_feature (1)..(1017): useful for making plants with increased cold tolerance as described in USSN 11/779,266
  misc_feature (1)..(1017): Ceres CLONE ID no.1838364
cctgcccatttccatcttccttctttccttcctctttcctttgtcttcttgctttatcttccctttatcttcaatcttttctgttctgtttttttcttagattcataggtaagttcgttttggttggcttgattatttcctcacttcccttcttttttggttcatcgtgatcttttcatcaaccccttttgattgttatatagattgttactattcttttaatcttttaaatattttttttccatgaggagagggagaggtgccgcagctgcaaacgccgtagctaggagaccggcactgcaacccagcggatctattaaagagccgagatacagaggtgttagaaaaaggccatggggcagattcgcggccgagattcgagacccttggaagaagaccagggtctggttagggacgttcgactcggccgaagaagccgctcgagcctacgatacggcggcgaggacgctccgtggacccaaagctaaaacaaatttccccataaattcttcaaatatcccggcttttcctttcgaaaccaatcatcaccacaacgaagggttcatcgaccaacgccggttatatccgatgggcgaatttcatgaccccgaagtgaatccacagagacccacgaggagtagcatgagtagcacggtggagtcgtttagtggacccagaccggcccaaccaccgcaaaagtcggcggacttcgcggtggtttcgactaggaagtactatccgaggccgccgccagtagagccagaggattgtcatagtgactgtgattcatcatcgtcggtggttgatgatggggatatcgcgttgtcttcttgtcggaaaactttgcctttcgatctcaattttccacccttggatgaagatggaagatctccagtgtactgctttatgtctttgatcgcgatgccggtgatgaatgatgatgatcgattattggatctctttttcttttttaaaaaatgttagcttttttaagcggaaaaaaaaaaaaaaaaaaaa

SEQ ID NO: 1763 - protein, 246 aa, Gossypium hirsutum
  misc_feature (1)..(246): useful for making plants with increased cold tolerance as described in USSN 11/779,266
  misc_feature (1)..(246): Ceres CLONE ID no. 1838364
  misc_feature (28)..(91): Pfam Name: AP2 Pfam Description: AP2 domain
  misc_feature (1)..(246): Functional Homolog of Ceres CLONE ID no. 674166 Given in SEQ ID NO: 42
MRRGRGAAAANAVARRPALQPSGSIKEPRYRGVRKRPWGRFAAEIRDPWKKTRVWLGTFDSAEEAARAYDTAARTLRGPKAKTNFPINSSNIPAFPFETNHHHNEGFIDQRRLYPMGEFHDPEVNPQRPTRSSMSSTVESFSGPRPAQPPQKSADFAVVSTRKYYPRPPPVEPEDCHSDCDSSSSVVDDGDIALSSCRKTLPFDLNFPPLDEDGRSPVYCFMSLIAMPVMNDDDRLLDLFFFFKKC

SEQ ID NO: 1764 - DNA, 708 bp, Panicum virgatum
  misc_feature (1)..(708): useful for making plants with increased cold tolerance as described in USSN 11/779,266
  misc_feature (1)..(708): Ceres CLONE ID no.1876458
acacagatacattcgtcgatccaccactgtccagtgcttggcggttacgcacgcacgcacacagataggattatcttttactacaccaactcaccaagatactagcaagccgaatcgacaaacaagcagcaggaagaggaggcatggcgctcgcggaggggaacgtcatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctcgagaagaaccccaagctcaagacccacgccatgtccgtcttcgtcatgacctgcgaggcggcggcgcagctacggaaggccgggaaggtcaccgtcagggagacgacgctcaagcggctgggcgccacgcacttcaagtacggcgtcgccgacggccacttcgaggtgacgaggttcgcgctgctggagacgataaaggaggcgcttcccgccgacatgtggagcctggagatgaagtacgcctggagcgaggcttacaaccagcttgtggcggccatcaagcaggagatgaagcctgccgcatgatgctgctgctgctactcggcctccgcgctgagttccccctacgatgcaccaccatctccaaattcttcatcgctgt

SEQ ID NO: 1765 - protein, 162 aa, Panicum virgatum
  misc_feature (1)..(162): useful for making plants with increased cold tolerance as described in USSN 11/779,266
  misc_feature (1)..(162): Ceres CLONE ID no. 1876458
  misc_feature (14)..(154): Pfam Name: Globin Pfam Description: Globin
  misc_feature (1)..(162): Functional homolog of Ceres Clone ID no. 30469
MALAEGNVIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALLETIKEALPADMWSLEMKYAWSEAYNQLVAAIKQEMKPAA

SEQ ID NO: 1766 - DNA, 712 bp, Panicum virgatum
  misc_feature (1)..(712): useful for making plants with increased cold tolerance as described in USSN 11/779,266
  misc_feature (1)..(712): Ceres CLONE ID no.1879148
acacagatacattcgtcgatccaccactgtccagtgctcggctcggttacgcacgcacgcacacaaattgtagtacctgtgttttacaccaccaaagatactagcaagccgagtcgacaaacaaagcagcaggaagaggcatggcgctcgctgacgggaacggcgcggccatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagcgcagctacggaaggccgggaaggtcaccgtcagggagacgacgctcaagcggctgggcgcaacgcacttcaagtacggcgtcgccgacggccacttcgaggtgacaaggttcgcgctgctggagacgataaaggaggcgcttcccgccgacatgtggagcctggagatgaagaacgcctggagcgaggcttacaaccagctcgtggcggccatcaagcaggagatgaagcctgctgcatgatgctgcatgctgctacatactcggcctccgagttccccctacgatgcaccaccatctccaagttcttcatcgctatt

SEQ ID NO: 1767 - protein, 164 aa, Panicum virgatum
  misc_feature (1)..(164): useful for making plants with increased cold tolerance as described in USSN 11/779,266
  misc_feature (1)..(164): Ceres CLONE ID no. 1879148
  misc_feature (16)..(156): Pfam Name: Globin Pfam Description: Globin
  misc_feature (1)..(164): Functional homolog of Ceres Clone ID no. 30469
MALADGNGAAIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALLETIKEALPADMWSLEMKNAWSEAYNQLVAAIKQEMKPAA

SEQ ID NO: 1768 - DNA, 1129 bp, Gossypium hirsutum
  misc_feature (1)..(1129): useful for making plants with increased cold tolerance as described in USSN 11/779,266
  misc_feature (1)..(1129): Ceres CLONE ID no.1884696
atccgcccccatttgttcgctctgtatattgaacttttctttctcgattttctctttgaacaaaaatgatgaagatcttcaaccagactctcaccggcaagactatcacgctcgaggtcgagagctccgacaccatcgaaggcgccaacaccattctccaagatggagggagcctccctccttaccgaacccgactgatcttcgccggacaacagcttgaggacggactgaccttgtgcgattacaacatcttaaaggaggtcaactctccacctcttcctccggttgcgcggtgggatgcttaccttccggaggaccttgaccggcaataccatcactctccaggtctaaagcgccgactcgatcaagttcgttcacgctaacatccaagactaggaaggcgtccccccataccaactacgactctgcttcgaccgaaaacaacttgaagacggccgtaccttggccgactacaacatccagaaggagtcaacgctccatcttgtccttcgtttgcgtggcgggatgcaaatcttcgttaagacgcttacgggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggtcctgcgtcttggaggtgggatgcagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggattccactcttcaccttgttcttcgtcttcgtggtgggttctaagccttaaggtctcccttaatgtgggttttctggttttacgtgaaggactgtgccctgtaatggccttttaaataatttctagtctttgtttaccggttgcatctatgtatggtttctcttagaatggaattagcatatttac

SEQ ID NO: 1769 - protein, 153 aa, Gossypium hirsutum
  misc_feature (1)..(153): useful for making plants with increased cold tolerance as described in USSN 11/779,266
  misc_feature (1)..(153): Ceres CLONE ID no. 1884696
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(153): Functional Homolog of Ceres CLONE ID no. 2403 Given in SEQ ID NO: 40
MQIFVKTLTGKTITLEVESSDTIDNVKAKIQDKEGIPPDQQRLIFAGKQLEDGRTLADYNIQKESTLHLVLRLGGGMQIFVKTLTGKTITLEVESSDTIDNVKAKIQDKEGIPPDQQRLIFAGKQLEDGRTLADYNIQKDSTLHLVLRLRGGF

SEQ ID NO: 1770 - DNA, 679 bp, Gossypium hirsutum
  misc_feature (1)..(679): useful for making plants with increased cold tolerance as described in USSN 11/779,266
  misc_feature (1)..(679): Ceres CLONE ID no.1916866
aaatcaaatacctactgcaattaaaatcccggaattacttaaacaacaatggctacctatgaaggtaaagttttcactgaagaacaagaagctttggtggtcaagtcatggactgtaatgaagaagaacgcagctgaattgggtcttaaattcttcttgaagatatttgagattgcaccatcagccaagaaactattctcattcttgagagactccaatgttccattggagcaaaacacaaagctgaagccccatgccatgtctgtctttgtcatgacatgtgaatctgcagtgcaactgcgtaaagcaggcaaagttacagtgagggaatcaaatttgaagaaattaggagctacccattttaagtatggggtagttgatgaacattttgaggtaacaaaatttgctcttttggagaccataaaagaagcagtaccagatatgtggtcagatgagatgaagaatgcatggggtgaagcctatgatcgtttggtcgcagccattaaaatagaaatgaaggcatgctcacaagctgcatgatttcacaagttccctacattattgcttgttaattttgggtccaataagattgaaagttttcaatcatttaaacatgtaatgtaacatagctattgctcatcactactgtttttttcccctagtttgtttgctcctgttc

SEQ ID NO: 1771 - protein, 163 aa, Gossypium hirsutum
  misc_feature (1)..(163): useful for making plants with increased cold tolerance as described in USSN 11/779,266
  misc_feature (1)..(163): Ceres CLONE ID no. 1916866
  misc_feature (13)..(152): Pfam Name: Globin Pfam Description: Globin
  misc_feature (1)..(163): Functional homolog of Ceres Clone ID no. 30469
MATYEGKVFTEEQEALVVKSWTVMKKNAAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSQAA

SEQ ID NO: 1772 - DNA, 1003 bp, Panicum virgatum
  misc_feature (1)..(1003): useful for making plants with increased cold tolerance as described in USSN 11/779,266
  misc_feature (1)..(1003): Ceres CLONE ID no.1950105
  misc_feature (489)..(489): y is t/u or c
  misc_feature (507)..(507): m is a or c
  misc_feature (519)..(519): s is g or c
  misc_feature (522)..(522): s is g or c
  misc_feature (662)..(662): r is g or a
atcgccacaagttcgcgatctctcgatttcacaaatcgccgagaagacccgagcagagaagttccctccgatcgccttgccaagatgcagatctttgtgaagacactcactggcaagactatcacccttgaggtggagtcttctgacacaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcaaagatccaggacaaggagggcatcccccctgaccagcagcgcctcatctttgcaggcaagcagttggaggatgggcgaactctggctgactayaatatccagaaagaatcmaccctgcacctsgtsctccgcctgcgtggtggaatgcagatctttgtgaagacgcttaccggcaagaccatcaccttggaggtggagtcttcggacaccatcgacaatgtgaaggcgaagattcaggacaaggagggcattcctccggaccagcrgcgcctcatctttgctggcaagcagctagaggacgggcgtaccctggcggattacaacatccagaaggagtccaccctccaccttgtcctgcgcctccgtggtggtttctgagcctagtgctcctgagttgccttttgtcgttatggtcaacctctggtttaagtcgtgtgaactctctgcattgcgttgctagtgtctggttgtggttgtaataagaacatgaagaacatgttgctgtggatcacatgactttttttttttgaaccggaagatcacatgactttcatggctttaagttcctgaactctgaaatctggacccccttttaagctctgaactc

SEQ ID NO: 1773 - protein, 229 aa, Panicum virgatum
  misc_feature (1)..(229): useful for making plants with increased cold tolerance as described in USSN 11/779,266
  misc_feature (1)..(229): Ceres CLONE ID no. 1950105
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (153)..(226): Pfam Name: ubiquitin Pfam Description: Ubiquitin family
  misc_feature (1)..(229): Functional Homolog of Ceres CLONE ID no. 2403 Given in SEQ ID NO: 40
  misc_feature (135)..(135): Xaa is any aa, unknown or other
  misc_feature (141)..(141): Xaa is any aa, unknown or other
  misc_feature (145)..(145): Xaa is any aa, unknown or other
  misc_feature (146)..(146): Xaa is any aa, unknown or other
  misc_feature (193)..(193): Xaa is any aa, unknown or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADXNIQKEXTLHXXLRLRGGMQIFVKTLTGKTITLEVESSDTIDNVKAKIQDKEGIPPDQXRLIFAGKQLEDGRTLADYNIQKESTLHLVLRLRGGF

SEQ ID NO: 1774 - DNA, 724 bp, Panicum virgatum
  misc_feature (1)..(724): useful for making plants with increased cold tolerance as described in USSN 11/779,266
  misc_feature (1)..(724): Ceres CLONE ID no.1990746
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
acacagatacactcgtcgatccaccagaccaccactgtccagtgctcggctcggttacgcacgcacgcacacaaataggagtacctgttttacaccaccaagatactagcaagcccaagccgagtcgacaaacaagcagcaggaagaggcatggcgctcgcggaggggaacggcgcggccatcttcggcgaggaacaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagtgcagctacggaaggccgggaaggtcaccgtcagggagacgacgctcaagcggctgggcgcaacgcacttcaagtacggcgtcgccgacggccacttcgaggtgacaaggttcgcgctgctggagacgataaaggaggcgcttcccgccgacatgtggagcctggagatgaagaacgcctggagcgaggcttacaaccagctcgtggcggccatcaagcnnnagatgaagcctgccgcatgatgctgcatgctgctacatactcggcctccgagtcccccctacgatgcaccaccatctcccagttcttcatcgctatttt

SEQ ID NO: 1775 - protein, 164 aa, Panicum virgatum
  misc_feature (1)..(164): useful for making plants with increased cold tolerance as described in USSN 11/779,266
  misc_feature (1)..(164): Ceres CLONE ID no. 1990746
  misc_feature (16)..(156): Pfam Name: Globin Pfam Description: Globin
  misc_feature (1)..(164): Functional homolog of Ceres Clone ID no. 30469
  misc_feature (158)..(158): Xaa is any aa, unknown or other
  misc_feature (159)..(159): Xaa is any aa, unknown or other
MALAEGNGAAIFGEEQEALVLKSWALMKKDSADLGLRFFLKIFEIAPSAKQMFSFLRDSDVPLEKNPKLKTHAMSVFVMTCEAAVQLRKAGKVTVRETTLKRLGATHFKYGVADGHFEVTRFALLETIKEALPADMWSLEMKNAWSEAYNQLVAAIKXXMKPAA

SEQ ID NO: 1776 - DNA, 696 bp, Panicum virgatum
  misc_feature (1)..(696): useful for making plants with increased cold tolerance as described in USSN 11/779,266
  misc_feature (1)..(696): Ceres CLONE ID no.2007485
agagcagggggatggaagaaaataaactactggccaaaccctagccgagccccgggtccgctcaccgccttcccacccccccacccacccacctgccccccccccccccccgccctcgccgtccgcgatgcgccgggcgaagccgccgcagccgcagccgtcgccgtcgccggagatccggtaccgcggcgtgcggaggcggccatcggggcgctacgccgccgagatccgggacccggccaagaagaccccgatctggctcggcaccttcgactccgccgaggccgccgcgcgcgcctacgacgccgccgcccgatccctccgcgggcccaccgcccgcaccaacttccccagcgccgcggcccccgcgccgcggcacagcaggccccccgccccctccgccgccgcgcaggcggctgccgcggcggcagcggccacgtccagccacagcagcaccatagagtcgtggagcgacggcgcgacccgcgccgcgctggcgcgtagcgctgcctccgtcctggcgcgcagcgccgctccgacggaggaggaagacgaggactgccgcagctactgcggatcctcgtcgtccgtcctctgcgaagacactgggggcgacgatgcggccgcctcccgcgcgcccctgccgttcgatctgaacctgccgccgcctcatgacgcggcctccgagaccgatca

SEQ ID NO: 1777 - protein, 201 aa, Panicum virgatum
  misc_feature (1)..(201): useful for making plants with increased cold tolerance as described in USSN 11/779,266
  misc_feature (1)..(201): Ceres CLONE ID no. 2007485
  misc_feature (17)..(80): Pfam Name: AP2 Pfam Description: AP2 domain
  misc_feature (1)..(201): Functional Homolog of Ceres CLONE ID no. 674166 Given in SEQ ID NO: 42
MRRAKPPQPQPSPSPEIRYRGVRRRPSGRYAAEIRDPAKKTPIWLGTFDSAEAAARAYDAAARSLRGPTARTNFPSAAAPAPRHSRPPAPSAAAQAAAAAAAATSSHSSTIESWSDGATRAALARSAASVLARSAAPTEEEDEDCRSYCGSSSSVLCEDTGGDDAAASRAPLPFDLNLPPPHDAASETDQMGARYDTLLRL

SEQ ID NO: 1778 - DNA, 698 bp, Panicum virgatum
  misc_feature (1)..(698): useful for making plants with increased cold tolerance as described in USSN 11/779,266
  misc_feature (1)..(698): Ceres CLONE ID no.2033803
acacagatacattcgtcgatccaccagaccaccactgtccagtgctcggctcggttacgcacgcacgcacacaaataggagtacctgttttacaccaagatactagcaagcccaagccgagtcgacaaacaagcagcaggaagaggcatggcgctcgcggaggggaacggcgcggccatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagcgcagctacggaaggccgggaaggtcaccgtcagggagacgacgctcaagcggctgggcgcaacgcacttcaagtacggcgtcgccgacggccacttcgaggtgacaaggttcgcgcttcccgccgacttgtggagcctggagatgaagaacgcctggagcgaggcttacaaccagctcgtggcggccatcaagcaggagatgaagcctgccgcatgatgctgcatgctgctacatactcggcctccgagttccccctacgatgcaccaccatctccaagttctttcattgtcttgtg

SEQ ID NO: 1779 - protein, 156 aa, Panicum virgatum
  misc_feature (1)..(156): useful for making plants with increased cold tolerance as described in USSN 11/779,266
  misc_feature (1)..(156): Ceres CLONE ID no. 2033803
  misc_feature (16)..(148): Pfam Name: Globin Pfam Description: Globin
  misc_feature (1)..(156): Functional homolog of Ceres Clone ID no. 30469
MALAEGNGAAIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALPADLWSLEMKNAWSEAYNQLVAAIKQEMKPAA

SEQ ID NO: 1780 - DNA, 724 bp, Panicum virgatum
  misc_feature (1)..(724): useful for making plants with increased cold tolerance as described in USSN 11/779,266
  misc_feature (1)..(724): Ceres CLONE ID no.2034916
aatccaatctcccccgatccccaatcgcgaattcccctctccggcaggcgaagcaatcgaggggcaccctttcatctcgtcaagatgcagatctttgtgaagaccctcactggtaagaccatcaccctcgaggttgagtcctcggataccattgacaacgtcaaggctaaaatccaggacaaggaggggatccctccggaccagcagcgcctcatctttgccggcaagcagctcgaagatgggaggacgcttgctgactacaacatccagaaggagtccaccctccacctcgtgctcaggctcaggggtggtatgcagatctttgtcaagactctcaccggcaagacgattactcttgaggttgagtcctcggacacgatcgacaatgtaaaggtgaagatccaagacaaggaggggatcccaccggaccagcagcgcctcatctttgccggcaagcagctcgaggatggccgcactctggctgactacaacattcagaaagagtcgacccttcaccttgtgctcaggctgaggggaggcatgcaaatatttgtcaagactctgactggcaagaccatcacgcttgaggtggagtcgtctgacaccattgataatgtgaaggcgaagatccaagacaaggagggcatcccgccggaccagcagcgcctgatctttgccggtaagcagctggaggatggtcgtaccctggcagactataatattc

SEQ ID NO: 1781 - protein, 213 aa, Panicum virgatum
  misc_feature (1)..(213): useful for making plants with increased cold tolerance as described in USSN 11/779,266
  misc_feature (1)..(213): Ceres CLONE ID no. 2034916
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(213): Functional Homolog of Ceres CLONE ID no. 2403 Given in SEQ ID NO: 40
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKVKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNI

SEQ ID NO: 1782 - DNA, 1194 bp, Glycine max
  misc_feature (1)..(1194): useful for making plants with increased cold tolerance as described in USSN 11/779,266
  misc_feature (1)..(1194): Ceres CLONE ID no.651581
  misc_feature (286)..(286): r is g or a
  misc_feature (468)..(468): r is g or a
  misc_feature (566)..(566): s is g or c
  misc_feature (654)..(654): m is a or c
  misc_feature (678)..(678): n is a, c, t, g, unknown, or other
  misc_feature (679)..(679): n is a, c, t, g, unknown, or other
  misc_feature (702)..(702): m is a or c
gtgtagttgaaggagcagaagaagaagaagagaaggtggtaccgccttcaattctctttttctctctccatttctcatcctcatcatcttattattcctcttccatctctattctccataacacccaccacaccacttgtgaaaaacctcattaatatcacacactgacatgtatctctgagctccaatccaatacaagaccacaccttgtcgtgtcggacgaaccttggtgtctgtttttttttttttttttcattattttctccgaagagatgaggaagggcaraggtggaggcgcctcggcggcggcggtggatgtgaacggatccattttaaaggagcctcggtaccggggcgtgaggaagagaccgtgggggagattcgccgcggagatcagagacccgttgaagaaagccagggtttggttgggaaccttcaattctgccgaggatgctgctcgtgcctacracgccgccgctcggactctccgaggtcccaaggccaaaacaaatttcccccctctctcacctttttgctatccacaccccaccaccgatcctttcttstacactggtttccacgatcaacaccaccaccacaacaacaacaaccttaacaaccctcaaagacccacttcaagtggcatgagtagcmccgttgagtccttcagtgggcccnnccctttttcccccaccaccaccmctaccaccacaaccacaactgcgacgccgtttttgactgctacgcggagatacccgcgcactccccctcttgtccctgaagactgccacagtgactgcgactcttcctcctccgtcgttgacgacggcgacgacaacatcgtttcgtcgtcgtttcgacctcccttgccgtttgatctcaacgcgctgccgtttgatgatgctgccgcggatgatgatctacgccgcaccgcgctttgtctctgatgatgattatcgtgcgatgatgatttttaatttctcatttttttacttgatttttttgttattgctatgcagaagaaatatatatttaaaatgatgatcagatgtaagattatggtaatatgatcttaattctgtgagaggaagattccgtgttggttatattttcttctttttattatttttttaaacatttttatttagaaggaaatattgaatgaaaagaaaaaagagaaagtaattatgatcg

SEQ ID NO: 1783 - protein, 224 aa, Glycine max
  misc_feature (1)..(224): useful for making plants with increased cold tolerance as described in USSN 11/779,266
  misc_feature (1)..(224): Ceres CLONE ID no. 651581
  misc_feature (24)..(87): Pfam Name: AP2 Pfam Description: AP2 domain
  misc_feature (1)..(224): Functional Homolog of Ceres CLONE ID no. 674166 Given in SEQ ID NO: 42
  misc_feature (137)..(137): Xaa is any aa, unknown or other
MRKGRGGGASAAAVDVNGSILKEPRYRGVRKRPWGRFAAEIRDPLKKARVWLGTFNSAEDAARAYDAAARTLRGPKAKTNFPPLSPFCYPHPTTDPFFYTGFHDQHHHHNNNNLNNPQRPTSSGMSSTVESFSGPRXFSPTTTTTTTTTTATPFLTATRRYPRTPPLVPEDCHSDCDSSSSVVDDGDDNIVSSSFRPPLPFDLNALPFDDAAADDDLRRTALCL

SEQ ID NO: 1784 - protein, 184 aa, Oryza sativa subsp. indica
  misc_feature (1)..(184): useful for making plants with increased cold tolerance as described in USSN 11/779,266
  misc_feature (7)..(70): Pfam Name: AP2 Pfam Description: AP2 domain
  misc_feature (1)..(184): Functional Homolog of Ceres CLONE ID no. 674166 Given in SEQ ID NO: 42
MCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 1785 - protein, 225 aa, Arabidopsis thaliana; identical to SEQ ID NO: 1744
  misc_feature (1)..(225): useful for making plants with increased cold tolerance as described in USSN 11/779,266
  misc_feature (1)..(225): Public GI ID no. 15223609
  misc_feature (26)..(89): Pfam Name: AP2 Pfam Description: AP2 domain
  misc_feature (1)..(225): Functional Homolog of Ceres CLONE ID no. 674166 Given in SEQ ID NO: 42

SEQ ID NO: 1786 - protein, 164 aa, Arabidopsis thaliana
  misc_feature (1)..(164): useful for making plants with increased cold tolerance as described in USSN 11/779,266
  misc_feature (1)..(164): Public GI ID no. 30683885
  misc_feature (1)..(164): Functional Homolog of Ceres CLONE ID no. 30087 Given in SEQ ID NO: 2
MASSFSSQAFFLLTLSMVLIPFSLAQAPMMAPSGSMSMPPMSSGGGSSVPPPVMSPMPMMTPPPMPMTPPPMPMTPPPMPMAPPPMPMASPPMMPMTPSTSPSPLTVPDMPSPPMPSGMESSPSPGPMPPAMAASPDSGAFNVRNNVVTLSCVVGVVAAHFLLV

SEQ ID NO: 1787 - protein, 218 aa, Pisum sativum
  misc_feature (1)..(218): useful for making plants with increased cold tolerance as described in USSN 11/779,266
  misc_feature (1)..(218): Public GI ID no. 56384582
  misc_feature (21)..(84): Pfam Name: AP2 Pfam Description: AP2 domain
  misc_feature (1)..(218): Functional Homolog of Ceres CLONE ID no. 674166 Given in SEQ ID NO: 42
MGRGGATTAAAAVEPVFFKEPRYRGVRKRPWGRFAAEIRDPLKKARVWLGTFDTAEEAARAYDTAARNLRGPKAKTNFPLAQPFYQNPEAGNPFGELRFYAGGAGEGFQDHRRPTSSGMSSTVESFGGPRPVRPPMPPSAVTGRRYPRTPPVAPGDCRSDCDSSSSVVDDADNDNAASSTMLSFKRQPLPFDLNAPPLEEGDVANGLGEDLHCTLLCL

SEQ ID NO: 1788 - protein, 225 aa, Nicotiana tabacum
  misc_feature (1)..(225): useful for making plants with increased cold tolerance as described in USSN 11/779,266
  misc_feature (1)..(225): Public GI ID no. 57012880
  misc_feature (26)..(89): Pfam Name: AP2 Pfam Description: AP2 domain
  misc_feature (1)..(225): Functional Homolog of Ceres CLONE ID no. 674166 Given in SEQ ID NO: 42
MRRGRAAAAPAPVTGEPNGSGGSKEIRFRGVRKRPWGRFAAEIRDPWKKTRVWLGTFDSAEDAARAYDAAARALRGPKAKTNFPLPYAHHHQFNQGHNPNNDPFVDSRFYPQDNPIISQRPTSSSMSSTVESFSGPRPPPAPRQQTTASSRKYTRSPPVVPDDCHSDCDSSSSVVDHGDCEKENDNDNDNIASSSFRKPLLFDLNLPPPMDDAGADDLHCTALCL

SEQ ID NO: 1789 - protein, 163 aa, Gossypium hirsutum
  misc_feature (1)..(163): useful for making plants with increased cold tolerance as described in USSN 11/779,266
  misc_feature (1)..(163): Public GI ID no. 62548111
  misc_feature (13)..(152): Pfam Name: Globin Pfam Description: Globin
  misc_feature (1)..(163): Functional homolog of Ceres Clone ID no. 30469
MATYEGKVFTEEQEALVVKSWTVMKKNAAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSLAA

SEQ ID NO: 1790 - protein, 153 aa, Gossypium hirsutum
  misc_feature (1)..(153): useful for making plants with increased cold tolerance as described in USSN 11/779,266
  misc_feature (1)..(153): Ceres CLONE ID no. 100021733
  misc_feature (1)..(74): Pfam Name: ubiquitin Pfam Description: Ubiquitin family
  misc_feature (77)..(150): Pfam Name: ubiquitin Pfam Description: Ubiquitin family
  misc_feature (1)..(153): Functional Homolog of Ceres CLONE ID no. 2403 Given in SEQ ID NO: 40
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 1791 - DNA, 775 bp, Brassica napus
  misc_feature (1)..(775): useful for making plants with increased cold tolerance as described in USSN 11/779,266
  misc_feature (1)..(775): Ceres CLONE ID no. 947579
  misc_feature (78)..(78): s is g or c
  misc_feature (79)..(79): w is a or t/u
  misc_feature (81)..(81): s is g or c
  misc_feature (83)..(83): m is a or c
  misc_feature (89)..(89): k is g or t/u
  misc_feature (98)..(98): s is g or c
  misc_feature (102)..(102): k is g or t/u
  misc_feature (105)..(105): r is g or a
  misc_feature (121)..(121): w is a or t/u
  misc_feature (126)..(126): w is a or t/u
  misc_feature (133)..(133): s is g or c
  misc_feature (151)..(151): w is a or t/u
  misc_feature (153)..(153): w is a or t/u
  misc_feature (155)..(155): y is t/u or c
  misc_feature (156)..(156): r is g or a
  misc_feature (159)..(159): m is a or c
  misc_feature (161)..(161): y is t/u or c
  misc_feature (165)..(165): m is a or c
  misc_feature (166)..(166): w is a or t/u
  misc_feature (171)..(171): w is a or t/u
  misc_feature (180)..(180): w is a or t/u
  misc_feature (201)..(201): w is a or t/u
  misc_feature (223)..(223): y is t/u or c
  misc_feature (236)..(236): y is t/u or c
  misc_feature (241)..(241): y is t/u or c
  misc_feature (254)..(254): w is a or t/u
  misc_feature (292)..(292): s is g or c
  misc_feature (296)..(296): k is g or t/u
  misc_feature (298)..(298): h is a or c or t/u
  misc_feature (362)..(362): m is a or c
  misc_feature (774)..(774): m is a or c
ctctctagatcttggatcactcggacgacatgtgttggatcccagtgcactggccctgccagcctactcaaaaaaacswtsamttttckctcccattstttkacractcatcgttggcacwtcctwctttctstatatattacttgacatwawcyrctmtycacmwcacawacacacacwtaaccatggccagcttcacawgctttccttttgctcacattgyctatggctttagytcatytctctttagctcwatctcccatgatggctccttctggctccatgtccatgscgckchatgccatagcggcggctctccaatgccaatgatgactccaccacctatgccaatgatgactccmccgcctatggctatggctccaccacctatgcctatgactccaccaccaatgcccatggctccgatgccaatgactccatcttcaagtccaatgagcccaccaactactatggccccaagtccagaaacagtccctgatatggcttcgccaccgatgatgccgggaatggagtcttctccttctccgggacccatgccaccggcaatggcctctccagattccggagcattcaatgtaagaaacgacgtcgtagcaatttcgttccttgttgcagctcatttgctcctagtttgagattattattaaattggccagcgtcgtgttgtgtaatttactttcattttttctcgagccattagttttcatgttttatcatatatttgggtttgtgtttgatatggtacgattcagmc

SEQ ID NO: 1792 - DNA, 1032 bp, Arabidopsis thaliana
  misc_feature (1)..(1032): useful for making plants with increased cold tolerance as described in USSN 11/779,266
  misc_feature (1)..(1032): Ceres CLONE ID no. 36046
gctcattagggtttctcatctacggcgtggtgttcctccttcctgctctgaaaaatggcgaagagaacgaagaaggttggaatcgtcggcaaatacggaacacgttatggtgcgagtatcaggaagcagattaagaagatggaggtcagccagcacagcaagtacttctgtgagttctgtggcaagtacggagtgaagcgaaaggctgttggtatctggggttgcaaggattgtggcaaggtcaaggcaggtggtgcttacacaatgaacaccgccagtgcggtcactgttagaagcacgatcagaaggttgagggagcagatcgagggttaaaagtctgctgaggaagatgctgagacagtatacgcttgtatcgacttggtatcaacgataatacagaggaagctgaggaagatcaaggagaaggactcagaccatggaaggcacatgaaaggtttcaacagattgaaggtaagggaaccagtgattgagccggttgtggaggatgttgaggacagtactgactcgagcgtaggagaagaagaagaagaggatgatttgatcaaggagattgtccgtaccaagactttcgagatgccaccattgactgtcgctgaggcagtcgagcagctggaactagtcagtcacgacttctatggcttccaaaatgaaaactggtgagataaacatagtgtacaagagaaaagaaggaggttacggtctgataatcccaaagaaagacgggaaggccgagaaggttgagccgcttccaaccgagcaattgaatgaacactctttcgccgagtagactgcctctgcacacaccaaaaccgataagctcatctctccttacagtttacctgtgtaggagttagggttcttgaataaacaatgcaacaaagattgtagaagtcagtgtacataaaaaaatggccaaccactctttgttacttttgtggtgaaaaggaagatcttaattctctttccatcagatgatagcaatacattttttcataaacaagaatgttacat

SEQ ID NO: 1793 - DNA, 492 bp, Parthenium argentatum
  misc_feature (1)..(492): useful for making plants with increased cold tolerance as described in USSN 11/779,266
  misc_feature (1)..(492): Ceres CLONE ID no. 1606506
atctagcttcaacctttttttcctctcactactcaattcaatatggctgtctcacgttacattatcctactcttatccttcacctacttggctgccttctccaccgctcaagctccatcaatgtcaccaatgatgatgcccatggcaccaccaccatcgacgatgcccatgacaccaccaccatcgacgatgcccatgacaccaccaccaacgcccatgaccatgacaccaccaccaatgatgatgcccatgacaccaccaccaatgcccatggggacaccaccaatgacaatgcccatgggaccgccaccaatgatgatgcccatgagcccaggaccatccatgatgccagcctccccgccatcacccatgggaccgtccatggcacctgaaccagctaccatgtcgcctggaccctccatgacgcctgctgagacaccagccagtggcgctatcatgcagtattctagcatcactatgttgggcattgtg

SEQ ID NO: 1794 - DNA, 970 bp, Glycine max
  misc_feature (1)..(970): useful for making plants with increased cold tolerance as described in USSN 11/779,266
  misc_feature (1)..(970): Ceres CLONE ID no. 546001
agatataatcgaaaaaaattactgtttggatatattccactatttagaaagcaaaatggactacgaaaacttgagtaacaaggtaagccacacaaatgggaatgactccccattacaatgaagggccaacttcattttcaatgaatcccactataaaaactttagcaatgcaaaagctaaaacatcaaccatttcctcatccactttcactggaatcacaatcctgaaacaaaaacatcttagcatttaacatactactagacaacatgaccaccacattggaaagaggtttctcggaagagcaagaagctctggtggtgaagtcatggaatgtcatgaagaagaattctggagagttgggtctcaagtttttcttgaaaatatttgagattgctccatcagctcagaaattgttctcattcttgagagattcaacggttcctttggagcaaaatcccaagctcaagccccatgccgtgtctgtctttgtaatgacctgtgattcagcagttcagctgcggaaggccgggaaagtcactgtcagagaatcaaacttgaaaaaattaggtgctacccattttagaaccggcgtagcaaacgagcatttcgaggtgacaaagtttgcactgttggagaccataaaagaagctgtaccagaaatgtggtcaccggctatgaagaatgcatggggagaagcttatgatcagctggtcgatgccattaaatctgaaatgaaaccaccctcctcttagactccagtttaagcagttcctttccttccctctcaattctcaaattgttatattaataaaagtgagaaagtttaggcttgtgcttttattttgtgtgaatgtaatatactttgtgtacgtagacttggctattgggagttgctaggttgggaagtgtttcgcattcaacaattctgtagttgaaggtgattaaatgaattatagctatttgtttcttc

SEQ ID NO: 1795 - DNA, 604 bp, Zea mays
  misc_feature (1)..(604): useful for making plants with increased cold tolerance as described in USSN 11/779,266
  misc_feature (1)..(604): Ceres CLONE ID no. 1554560
tcgtatccacccaacctcccactgtaaaaaagagcagcggaacgtgcgtgcatccatccaattccaatcccagtcccaatcccaccagtgtccagtgctcggggaaccgacacagctcctcagcagagaagccagcccgatcagcagacagcaggcatggcgctcgcggaggccgacgacggcgcggtggtcttcggcgaggagcaggaggcgctggtgctcaagtcgtgggccgtcatgaagaaggacgccgccaacctgggcctccgcttcttcctcaaggtcttcgagatcgcgccgtcggcgaagcagatgttctcgttcctgcgcgactccgacgtgccgctagagaagaaccccaagctcaagacgcacgccatgtccgtcttcgtcatgacctgcgaggcggcggcgcagctccgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcct

SEQ ID NO: 1796 - DNA, 846 bp, Triticum aestivum
  misc_feature (1)..(846): useful for making plants with increased cold tolerance as described in USSN 11/779,266
  misc_feature (1)..(846): Ceres CLONE ID no. 839727
acgccgtccgtttctggctcatcaggaggtccaaaggccgcgcaagtcgacctatataagcgcctccgctccagcttgggatcaaatcacgaccaacacgtaccggatcttgaccgaccgaaccattcagtgctcgcgctcactcacgcatcatagccaagttaagcgggaaggaaggaaggaaggaagccatgtctgccgcggagggagccgtcgtgttcagcgaggagaaggaggcgctggtgctcaagtcatgggccatcatgaagaaggattccgccaaccttgggctccgcttcttcctcaagatcttcgagatcgcgccgtcggcgaggcagatgttcccgttcctgcgcgactccgacgtgccgctggagaccaaccccaagctcaagacccacgccgtgtccgtcttcgtcatgacgtgcgaggctgctgcgcagctgcggaaagccgggaagatcaccgtcagggagaccaccctgaagaggctgggcggcacgcacttgaaatacggcgtggcagatggccactttgaggtgacgcggttcgctctgctcgagacgatcaaggaggcgcttccggcggacatgtgggggccggagatgaggaacgcgtggggcgaggcctacgaccaactggtcgcggccatcaagcaagagatgaagccctctgagtagctcatccattgtactcatatcatatgccacgcaacttccgtccatatccgtccaactttcgttgcttgaccggttcactcatgtcaccatattgtgtttgtattgtgtgtttacgtgtactaacgcatattgtaaaatgggcattcaataaaggaacaaattgtgc

SEQ ID NO: 1797 - DNA, 440 bp, Glycine max
  misc_feature (1)..(440): useful for making plants with increased cold tolerance as described in USSN 11/779,266
  misc_feature (1)..(440): Ceres CLONE ID no. 664936
ctcttgtcttagtctaataaacaacacggacgcagagccttcgatccagaaaccatgactaagagaacgaagaaggcaggcattgtcggaaaatatggtacccgatatggtgctagtttgcggaagcagattaagaagatggaagttagtcagcatagcaaattcttttgtgaattttgtgggaagtatgctgtgaagaggaaggctgtgggaatatggggatgcaaggattgtggtaaagtgaaagctggcggtgcctacactttgaatactgcaagtgctgtcactgtgcgcagcaccatccggaggttgagggaacaaaccgagggttgagctttttggttgatgttagattttgagcaaattaactggagaaatgattcgtttttgtttaggaagctgtattgtttcaacttacaatgcagtgtgaattgctttcg

SEQ ID NO: 1798 - DNA, 463 bp, Glycine max
  misc_feature (1)..(463): useful for making plants with increased cold tolerance as described in USSN 11/779,266
  misc_feature (1)..(463): Ceres CLONE ID no. 658438
  misc_feature (6)..(6): w is a or t/u
  misc_feature (34)..(34): k is g or t/u
  misc_feature (76)..(76): k is g or t/u
  misc_feature (93)..(93): s is g or c
  misc_feature (100)..(100): s is g or c
  misc_feature (106)..(106): y is t/u or c
  misc_feature (126)..(126): s is g or c
  misc_feature (197)..(197): r is g or a
  misc_feature (232)..(232): k is g or t/u
  misc_feature (269)..(269): s is g or c
  misc_feature (306)..(306): w is a or t/u
  misc_feature (307)..(307): s is g or c
  misc_feature (323)..(323): w is a or t/u
  misc_feature (324)..(324): k is g or t/u
  misc_feature (344)..(344): m is a or c
  misc_feature (358)..(358): w is a or t/u
  misc_feature (381)..(381): s is g or c
  misc_feature (382)..(382): w is a or t/u
  misc_feature (406)..(406): y is t/u or c
atatawcttgactctccgcaattccctgtctcckccgccgcagcttccgtctcccggatttcgccgcctgccgcakccgcagcagctcgccgsccacgcstcctayccgtcgacgagatgacgaascgcaccaagaaggctggaattgtcggcaaatatggtacccgttatggtgccagtttgcgtaagcagatcargaagatggaggtgtctcagcactccaagtacttckgtgagttctgtgggaagtttgctgtgaagaggaaagsagttggaatttggggatgcaatggactgtgggaaggwsaaggaaaccttcgccwkaaaccgtgagctcgaagtgmggtccactccaggwgggccatgctcggggccttgggswgcagtcttccccgaagctattgtyccgcaacggggtcaagtttggagaagctgtgtggttcaaggccgggtcccagatctt

SEQ ID NO: 1799 - DNA, 458 bp, Glycine max
  misc_feature (1)..(458): useful for making plants with increased cold tolerance as described in USSN 11/779,266
  misc_feature (1)..(458): Ceres CLONE ID no. 1049262
  misc_feature (224)..(224): n is a, c, t, g, unknown, or other
aacaaaccctcgttcacggttcaacttcagcagccgcgcctctaacttgtagcagcgatacctcttctcttatcactaaaaaatgaccaagagaaccaagaaggccggtattgttggaaaatacggcacccgatatggtgctagtttaaggaagcaaatcaagaagatggaagttagtcagcacagtaaattcttttgtgagttctgtggaaagtacgctgttnagaggaaggccgtgggtatttggggctgcaaagattgtggaaaagtgaaggctggaggtgcttacacattgaatactgcgagtgctgtcactgtccggagcaccattcggaggctgagagagcagactgagagttgaaagcagtttacacttttcatttgtttccaaagcttattttaaaattatcatacaattttggcaggtctatgttaggaatattagtaatgtgctactt

SEQ ID NO: 1800 - DNA, 600 bp, Triticum aestivum
  misc_feature (1)..(600): useful for making plants with increased cold tolerance as described in USSN 11/779,266
  misc_feature (1)..(600): Ceres CLONE ID no. 632613
ctcaaaaccctaggcttccatatataacttgactctccacaattccctgtctccgccgccgcagctttcgtctcccggatttcgccgccgcagccgctcaccgcccacgcctcctacccgtcgacgagatgacgaagcgcaccaagaaggctggtattgtcggcaaatatggtacccgttatggtgccagtttgcgtaagcagatcaagaagatggaggtgtctcagcactccaagtacttctgtgagttctgtgggaagtttgctgtgaagaggaaagcagttggaatttggggatgcaaggactgtgggaaggtgaaggctggcggtgcttacactatgaacactgccagtgcggtcactgtcaggagcactatccgtcgtttgagggagcagactgaagcataagttgctactagtgttttgtcctagtgaatcatctgggatttcgcagtttagacgatactttggattcagttccattggctgtttagtcaaggattatctttgtacttggtgcgatgatgttctgttatgttattctcccacccttttgttgcctgattccactctgatttactgtggattctgatttgccttc

SEQ ID NO: 1801 - DNA, 546 bp, Zea mays
  misc_feature (1)..(546): useful for making plants with increased cold tolerance as described in USSN 11/779,266
  misc_feature (1)..(546): Ceres CLONE ID no. 1390976
aagcatccacaattccacataacctcgcccgcgccgcctcccccacgagacgccttcttgctctcgcttccggtgacgcccgccacttcctccccgacgagatgacgaaacgcaccaagaaggcaggaatcgttggcaaatatggtaccaggtatggtgccagtttacgtaaacagatcaagaagatggaggtctcgcagcactccaaatacttctgtgagttctgtggcaagtttgccgtgaagaggaaagcagttggtatctggggatgcaaggactgtgggaaggttaaggccggtggcgcctacacaatgaacactgctagtgcggtcactgtgagaagcacaatccggcgcctgcgggagcagaccgaagcatgattgcgggcagcttgaaaaggagtacctggatttttgtagttcagccaagagccgtgaaccattttgcctttttagctaaatgaacaagaaatgtttatctatctgtagtgaccactttgtactcatggtttgtcatgctaaattgatggtatgcactatgcaatgc

SEQ ID NO: 1802 - DNA, 550 bp, Zea mays
  misc_feature (1)..(550): useful for making plants with increased cold tolerance as described in USSN 11/779,266
  misc_feature (1)..(550): Ceres CLONE ID no. 1457185
atatataacttgactctccgcaattccctgtctccgccgccgcagcttccgtctcccggatttcgccgccgccgcagccgcagcagctcgccgcccacgcctcctacccgtcgacgagatgacgaagcgcaccaagaaggctggaattgtcggcaaatatggtacccgttatggtgccagtttgcgtaagcagatcaagaagatggaggtgtctcagcactccaagtacttctgtgagttctgtgggaagtttgctgtgaagaggaaagcagttggaatttggggatgcaaggactgtgggaaggtgaaggctggcggtgcttacaccatgaacactgccagtgcggtcactgtcaggagcactatccgtcgcttgagggagcagactgaagcataagttgctactagtgttttgtcctagtgaatcatctgggattttgcagtttagacgatactttggattcagttctgttggctgtttagtcaaggattatctttgtacttggtgcgatgatgttctgttatgttattctctcaccctttttttgcc

SEQ ID NO: 1803 - DNA, 668 bp, Zea mays
  misc_feature (1)..(668): useful for making plants with increased cold tolerance as described in USSN 11/779,266
  misc_feature (1)..(668): Ceres CLONE ID no. 1482731
aaaaattcattgatcgaaaaaaagaaaaaagaaagaaaagaaaagatgcagatcttcgtgaaaaccttgaccggcaaaaccataaccctagaggttgaaagcagcgacaccatcgacaatgtcaaatccaaaatccaggacaaagaggggataccacctgatcaacagaggctcatctttgctgggaaacaacttgaggatggtcgaacgctagctgactacaacattcagaaagagtccactcttcacttggttctgaggcttaggggtgggaccatgatcaaggtcaagactctcactggtaaagaaatcgaaattgatatcgaacctaccgatactattgaccggatcaaggaacgtgttgaggagaaagaaggcatccctcctgttcaacaaaggctcatctatgctgggaaacagctagctgatgacaaaacggcaaaggactacaacatagagggaggctctgttcttcatctggtccttgctctcaggggtggttctgactaaataactatttgctctagagttcctttcaatggctttggttggttgaatccatgagacaaagtgaatacaatttggatttcgtgctttggttactatgatgctatttcagctggtttggatcaatttaccaaaaaaaaaaaaaaaaaaaaaaaaaaaag

SEQ ID NO: 1804 - DNA, 752 bp, Glycine max
  misc_feature (1)..(752): useful for making plants with increased cold tolerance as described in USSN 11/779,266
  misc_feature (1)..(752): Ceres CLONE ID no. 522921
  misc_feature (639)..(639): n is a, c, t, g, unknown, or other
  misc_feature (674)..(674): n is a, c, t, g, unknown, or other
  misc_feature (690)..(690): n is a, c, t, g, unknown, or other
  misc_feature (697)..(697): n is a, c, t, g, unknown, or other
  misc_feature (700)..(700): n is a, c, t, g, unknown, or other
  misc_feature (714)..(714): n is a, c, t, g, unknown, or other
aattacaaatacaaatacgaatacccttctctctcacacaaaacactagtccctcccttcttccttgtctctttctcttctcaacaacatgcagatcttcgtcaagactttgactggcaagaccatcaccctcgaggtcgagagtagcgacaccatcgacaacgtcaaggccaagatccaggacaaggaaggtatccctcctgaccagcagagtttgatttttgctggtaagcagctggaagatggtcgcactcttgctgattataacatacaaaaggaatcaacacttcacttggtcttgaggctcaggggaggaaccatgattaaagtgaagactctaactggaaaagaaattgaaattgacattgagccaactgatacaatcgaccggatcaaggaacgcgttgaagaaaaagagggaattccacctgtgcagcagagactcatatatgcaggtaaacagcttgctgatgacaaaacagctaaagagtacaacattgagggtggttctgtacttcacttggtgcttgcattgaggggtggtacttattagtgtagatgccatatcagaacccaaagacatgaaaggaagctctattcctgccccgtctctctgaagacatcattgttcttttatgngcttggtttttgtaattgtggctactattggtggncagtaactcagtatcnttttagntgnatgctatttaaaanccctaaggtgggcctttatatgaatatctgaaccaatg

SEQ ID NO: 1805 - DNA, 484 bp, Brassica napus
  misc_feature (1)..(484): useful for making plants with increased cold tolerance as described in USSN 11/779,266
  misc_feature (1)..(484): Ceres CLONE ID no. 1036726
  misc_feature (437)..(437): m is a or c
gaaatcaaataaaaaaatctttaagcaagaaaagaaagaaaatgcagatcttcgtcaaaaccctgacggggaaaaccataaccctggaggttgaaagcagcgacaccatcgacaatgtcaaagccaaaatccaggacaaagaaggaataccgccggatcagcagaggctgatcttcgctgggaagcaactagaagacggtagaacccttgcggactacaacatccagaaagagtccactcttcacttggtcttgaggcttaggggtggcaccatgatcaaggtcaagactctcactggcaaagaaatcgagattgacatcgaacctaccgacaccattgatcgcatcaaggagcgtgttgaggagaaagaaggcatccctcctgttcaacagaggctcatctacgctggaaaacagctagctgatgacaagacggcmaaagactacaacatcgagggaggctctgtttctgcatctggttcttg

SEQ ID NO: 1806 - DNA, 580 bp, Glycine max
  misc_feature (1)..(580): useful for making plants with increased cold tolerance as described in USSN 11/779,266
  misc_feature (1)..(580): Ceres CLONE ID no. 513071
  misc_feature (543)..(543): n is a, c, t, g, unknown, or other
aagaaaaaggaaattttcttgggcgttcttcggcttcgttgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaagccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtgttgaagagaaagaaggcattcctcccgtgcagcaaaggctcatctatgctggtaagcagcttgctgatgacaagaccgcaaaggactacaacatcgagggtggatctgtcctccatcttgtncttgctctgaggggtggttactagtctaaacctgatg

SEQ ID NO: 1807 - DNA, 987 bp, Brassica napus
  misc_feature (1)..(987): useful for making plants with increased cold tolerance as described in USSN 11/779,266
  misc_feature (1)..(987): Ceres CLONE ID no. 975672
  misc_feature (581)..(581): s is g or c
  misc_feature (643)..(643): s is g or c
attccatcaacttcagacacacagatctcttctcaatcacattacttctggttctcccaccatgaggaaagggagaggctcttccgccgttccacccgcccttcccggatctgtgaaggagccgaggtacagaggcgttaggaagagaccttggggccgtttcgccgccgagatccgtgaccccttgaaaaaatcccgagtctggctcggcacgttcgactccgcggaggaagccgcacgcgcctacgacgcagccgctcgtaacctccgcggtccaaaggccaagaccaacttccaaatcgactgttctccttcctctcctctccaaccactccatcatcggaaccagatcgatccctttatggaccaccggttatacggcggagagcaggaggttgttatcatcagccggccggcgagtagcagcatgagcagcaccgttaagtcgtgcagcggagtgagaccagcgtcttcttccgtggcgaaggcggcgacgaagagatatccacggactccgccggtggcgccggaggattgccgcagcgactgcgattcgtcgtcgtcggtggttgaagacggasacgacatagcttcgtcgtcttcgcggcggaaaccgccgtttgagtttgatcttaattttccsccgttggatggcgttgacttattcgtaggcgcggacgatctccactgcaccgatctgcgtctttgatctttgagcacaatgacaacaaagatgatgaagaagtgatagggagagagagtttgtgttaagatctgttgttgtaagaaccagatctgtgtttcattcacttgtctgtttcttataaagatcaaacctttgttacatgtaacacttatatagctgctgatgattcttaattattcaaaatccaaagtctgtagaatttatacagtatctatcactgatgtgcttatggatggtttggagtatgaggctacattttcataaatacattcaatgtgtgt

SEQ ID NO: 1808 - DNA, 1034 bp, Zea mays
  misc_feature (1)..(1034): useful for making plants with increased cold tolerance as described in USSN 11/779,266
  misc_feature (1)..(1034): Ceres CLONE ID no. 273307
ctctccttccttcacggattcccaaatactcgcttccaataccaattctccgatccacgttcgttcccgcaccctcgcgctccgctgatccggcggcatgcggcgccgcggcgtggcggcggctgatgcggacggtgacgtggagttgcggttccgcggggtgcggaagaggccgtggggccggtacgcagcggagatccgggacccggcgaagaaggcgcgcgtctggctcggcacattcgactccgccgaggacgccgcccgcgcctacgacgccgcagcgcggatgctgcgcgggcccaaggccaggaccaacttcccgctccccgccgcagccgccctccaccacccccacatgcccgctgctgccgccgcagcagctccaccatacacaacatatcccaccgccacgggcgtcgtctcgacgccgccggtcgccagaccggcttgcagcagcctcagctccaccgtggagtccttcagcggcgcgcggccgcggcctgtgctcccgccgcggttccctccgccgtcgattcctgatggcgactgccgcagcgactgtggttcctcggcctcggtcgtggacgacgactgcacggacgcggccgcctctgcgtcgtgccccttcccgctcccgttcgacctcaacctgcccccaggcggcggcggagccggcgtcgggttttacgccgatgaggaggatgagctcaggctcacggcgctgcggctgtgacgtcgagctcaatcgagccgctgcttagaaagaggaaaaggagaaaaatatttggttcttcccttctcttgtagccgacacgaactctccatccactacgatgttgttgtttacttgatctgattatgatatttgcctgaatcctagtcaacttacctgcatgcatgcctgcttgttttctggcgattgaggattatcgccaaacgccaaatcttgcagcagctgttgtactgtaatatatcaacattttacttccttcctcttatgaggaaagagacagataaagtaacttatttcaatc

SEQ ID NO: 1809 - DNA, 911 bp, Triticum aestivum
  misc_feature (1)..(911): useful for making plants with increased cold tolerance as described in USSN 11/779,266
  misc_feature (1)..(911): Ceres CLONE ID no. 1055099
aaacaaaaaaccaccaggggaagaagggaaagacacacgccactgtgaccaaaccctaggccggccgcgatgcgcaaggcgaggccgccgcagccccagccgcagccgtcgcagcagtcgccggagatccggtaccgcggcgtgcggaagcgcccctcgggccgctacgccgccgagatccgggaccccgccaagaagacgccgatctggctcggcaccttcgactgcgccgaggacgccgcccgcgcctacgactccgccgcccgatccctccgcgggcccaccgcccgcaccaacttcccgccctcctccgccacgcagccgccgccgaggccccctccccccgcggccgcggccgcggccgccacgtccagccagagcagcaccgtcgagtcctggagcggcggcgggccccgcgcccccgccagggcccgcagcgccgcccgagcgggcacggccaaggagggggaggaggactgccgcagctactgcggctcctcgtcctccgtcctcctcgaggagggcgcggacgacgcggccgcctcccgctccccgctgcccttcgatctgaacatgccgcccccgcaggagggggcgcttgacgccgaggccgatcagatgacctgccggtacgacacgctgctccgcctctagctccacgacgacgagagcaaggattcgtgggaggggaactgggaaaaggaacgagaaaagcgcttgcccccgctccgctccggtccgtcttccgatgatctcgtggtgttctctctttgttagaaatggataattcttgccatttttttttcttactttctttccttcttcttttttttttcttcttaccactttgattcgatatgtgaataattgagtcatgtaagctgcgagcaaggaaatctgagcttttcctt

SEQ ID NO: 1810 - protein, 160 aa, Arabidopsis thaliana; identical to SEQ ID NO: 1710
  misc_feature (1)..(160): useful for making plants with increased cold tolerance as described in USSN 11/779,266
  misc_feature (1)..(160): Ceres GI ID no. GI_15226675
  misc_feature (13)..(152): Pfam Name: Globin Pfam Description: Globin
  misc_feature (1)..(160): Functional homolog of Ceres Clone ID no. 30469

SEQ ID NO: 1811 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 100021733
  misc_feature (1)..(33): Ceres CLONE ID no. 100021733_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1812 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 1036726
  misc_feature (1)..(33): Ceres CLONE ID no. 1036726_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1813 - protein, 33 aa, Artificial Sequence
  misc_feature (1)..(33): useful for making plants with increased cold tolerance as described in USSN 11/779,266
  misc_feature (1)..(33): Truncated version of Ceres CLONE ID no. 1482731
  misc_feature (1)..(33): Ceres CLONE ID no. 1482731_T
  misc_feature (1)..(33): Pfam Name: ubiquitin Pfam Description: Ubiquitin family
  misc_feature (1)..(33): Functional homolog of Ceres Clone ID no. 2403
MQIFVKTLTGKTITLEVESSDTIDNVKSKIQDK

SEQ ID NO: 1814 - protein, 80 aa, Artificial Sequence
  misc_feature (1)..(80): useful for making plants with increased cold tolerance as described in USSN 11/779,266
  misc_feature (1)..(80): Truncated version of Ceres CLONE ID no. 1554560
  misc_feature (1)..(80): Ceres CLONE ID no. 1554560_T
  misc_feature (17)..(78): Pfam Name: Globin Pfam Description: Globin
  misc_feature (1)..(80): Functional homolog of Ceres Clone ID no. 30469
MALAEADDGAVVFGEEQEALVLKSWAVMKKDAANLGLRFFLKVFEIAPSAKQMFSFLRDSDVPLEKNPKLKTHAMSVFVM

SEQ ID NO: 1815 - protein, 77 aa, Artificial Sequence
  misc_feature (1)..(77): useful for making plants with increased cold tolerance as described in USSN 11/779,266
  misc_feature (1)..(77): Truncated version of Ceres CLONE ID no. 1802327
  misc_feature (1)..(77): Ceres CLONE ID no. 1802327_T
  misc_feature (14)..(75): Pfam Name: Globin Pfam Description: Globin
  misc_feature (1)..(77): Functional homolog of Ceres Clone ID no. 30469
MALAEGNVIFGEEQEALVLKSWALMKKDSADLGLRFFLKIFEIAPSAKQMFSFLRDSDVPLEKNPKLKNHAMSVFVM

SEQ ID NO: 1816 - protein, 77 aa, Artificial Sequence
  misc_feature (1)..(77): useful for making plants with increased cold tolerance as described in USSN 11/779,266
  misc_feature (1)..(77): Truncated version of Ceres CLONE ID no. 1876458
  misc_feature (1)..(77): Ceres CLONE ID no. 1876458_T
  misc_feature (14)..(75): Pfam Name: Globin Pfam Description: Globin
  misc_feature (1)..(77): Functional homolog of Ceres Clone ID no. 30469
MALAEGNVIFGEEQEALVLKSWALMKKDSADLGLRFFLKIFEIAPSAKQMFSFLRDSDVPLEKNPKLKTHAMSVFVM

SEQ ID NO: 1817 - protein, 79 aa, Artificial Sequence
  misc_feature (1)..(79): useful for making plants with increased cold tolerance as described in USSN 11/779,266
  misc_feature (1)..(79): Truncated version of Ceres CLONE ID no. 1879148
  misc_feature (1)..(79): Ceres CLONE ID no. 1879148_T
  misc_feature (16)..(77): Pfam Name: Globin Pfam Description: Globin
  misc_feature (1)..(79): Functional homolog of Ceres Clone ID no. 30469
MALADGNGAAIFGEEQEALVLKSWALMKKDSADLGLRFFLKIFEIAPSAKQMFSFLRDSDVPLEKNPKLKTHAMSVFVM

SEQ ID NO: 1818 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 1884696
  misc_feature (1)..(33): Ceres CLONE ID no. 1884696_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1819 - protein, 76 aa, Artificial Sequence
  misc_feature (1)..(76): useful for making plants with increased cold tolerance as described in USSN 11/779,266
  misc_feature (1)..(76): Truncated version of Ceres CLONE ID no. 1916866
  misc_feature (1)..(76): Ceres CLONE ID no. 1916866_T
  misc_feature (13)..(74): Pfam Name: Globin Pfam Description: Globin
  misc_feature (1)..(76): Functional homolog of Ceres Clone ID no. 30469
MATYEGKVFTEEQEALVVKSWTVMKKNAAELGLKFFLKIFEIAPSAKKLFSFLRDSNVPLEQNTKLKPHAMSVFVM

SEQ ID NO: 1820 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 1950105
  misc_feature (1)..(33): Ceres CLONE ID no. 1950105_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1821 - protein, 79 aa, Artificial Sequence
  misc_feature (1)..(79): useful for making plants with increased cold tolerance as described in USSN 11/779,266
  misc_feature (1)..(79): Truncated version of Ceres CLONE ID no. 1990746
  misc_feature (1)..(79): Ceres CLONE ID no. 1990746_T
  misc_feature (16)..(77): Pfam Name: Globin Pfam Description: Globin
  misc_feature (1)..(79): Functional homolog of Ceres Clone ID no. 30469
MALAEGNGAAIFGEEQEALVLKSWALMKKDSADLGLRFFLKIFEIAPSAKQMFSFLRDSDVPLEKNPKLKTHAMSVFVM

SEQ ID NO: 1822 - protein, 79 aa, Artificial Sequence; identical to SEQ ID NO: 1821
  misc_feature (1)..(79): useful for making plants with increased cold tolerance as described in USSN 11/779,266
  misc_feature (1)..(79): Truncated version of Ceres CLONE ID no. 2033803
  misc_feature (1)..(79): Ceres CLONE ID no. 2033803_T
  misc_feature (16)..(77): Pfam Name: Globin Pfam Description: Globin
  misc_feature (1)..(79): Functional homolog of Ceres Clone ID no. 30469

SEQ ID NO: 1823 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 2034916
  misc_feature (1)..(33): Ceres CLONE ID no. 2034916_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1824 - protein, 33 aa, Artificial Sequence
  misc_feature (1)..(33): useful for making plants with increased cold tolerance as described in USSN 11/779,266
  misc_feature (1)..(33): Truncated version of Ceres CLONE ID no. 513071
  misc_feature (1)..(33): Ceres CLONE ID no. 513071_T
  misc_feature (1)..(33): Pfam Name: ubiquitin Pfam Description: Ubiquitin family
  misc_feature (1)..(33): Functional homolog of Ceres Clone ID no. 2403
MQIFVKTLTGKTITLEVESSDTVDNVKAKIQDK

SEQ ID NO: 1825 - protein, 33 aa, Artificial Sequence; identical to SEQ ID NO: 1741
  misc_feature (1)..(33): useful for making plants with increased cold tolerance as described in USSN 11/779,266
  misc_feature (1)..(33): Truncated version of Ceres CLONE ID no. 522921
  misc_feature (1)..(33): Ceres CLONE ID no. 522921_T
  misc_feature (1)..(33): Pfam Name: ubiquitin Pfam Description: Ubiquitin family
  misc_feature (1)..(33): Functional homolog of Ceres Clone ID no. 2403

SEQ ID NO: 1826 - protein, 76 aa, Artificial Sequence
  misc_feature (1)..(76): useful for making plants with increased cold tolerance as described in USSN 11/779,266
  misc_feature (1)..(76): Truncated version of Ceres CLONE ID no. 546001
  misc_feature (1)..(76): Ceres CLONE ID no. 546001_T
  misc_feature (13)..(74): Pfam Name: Globin Pfam Description: Globin
  misc_feature (1)..(76): Functional homolog of Ceres Clone ID no. 30469
MTTTLERGFSEEQEALVVKSWNVMKKNSGELGLKFFLKIFEIAPSAQKLFSFLRDSTVPLEQNPKLKPHAVSVFVM

SEQ ID NO: 1827 - protein, 76 aa, Artificial Sequence
  misc_feature (1)..(76): useful for making plants with increased cold tolerance as described in USSN 11/779,266
  misc_feature (1)..(76): Truncated version of Ceres CLONE ID no. 651581
  misc_feature (1)..(76): Ceres CLONE ID no. 651581_T
  misc_feature (13)..(74): Pfam Name: Globin Pfam Description: Globin
  misc_feature (1)..(76): Functional homolog of Ceres Clone ID no. 30469
MESEGKIVFTEEQEALVVKSWSVMKKNSADLGLKLFIKIFEIAPTAKKLFSFLRDSPIPAEQNPKLKPHAMSVFVM

SEQ ID NO: 1828 - protein, 77 aa, Artificial Sequence
  misc_feature (1)..(77): useful for making plants with increased cold tolerance as described in USSN 11/779,266
  misc_feature (1)..(77): Truncated version of Ceres CLONE ID no. 839727
  misc_feature (1)..(77): Ceres CLONE ID no. 839727_T
  misc_feature (14)..(75): Pfam Name: Globin Pfam Description: Globin
  misc_feature (1)..(77): Functional homolog of Ceres Clone ID no. 30469
MSAAEGAVVFSEEKEALVLKSWAIMKKDSANLGLRFFLKIFEIAPSARQMFPFLRDSDVPLETNPKLKTHAVSVFVM

SEQ ID NO: 1829 - protein, 76 aa, Artificial Sequence
  misc_feature (1)..(76): useful for making plants with increased cold tolerance as described in USSN 11/779,266
  misc_feature (1)..(76): Truncated version of Public GI ID no. 11095158
  misc_feature (1)..(76): Public GI ID no. 11095158_T
  misc_feature (13)..(76): Pfam Name: Globin Pfam Description: Globin
  misc_feature (1)..(76): Functional homolog of Ceres Clone ID no. 30469
MGTLDTKGFTEEQEALVVKSWNAMKKNSAELGLKLFLKIFEIAPSAQKLFSFLKDSKVPLEQNTKLKPHAMSVFLM

SEQ ID NO: 1830 - protein, 71 aa, Artificial Sequence
  misc_feature (1)..(71): useful for making plants with increased cold tolerance as described in USSN 11/779,266
  misc_feature (1)..(71): Truncated version of Public GI ID no. 12963875
  misc_feature (1)..(71): Public GI ID no. 12963875_T
  misc_feature (8)..(69): Pfam Name: Globin Pfam Description: Globin
  misc_feature (1)..(71): Functional homolog of Ceres Clone ID no. 30469
MSSFSEEQEALVVKSWGSMKKDAGEWGLKFFLKIFEIAPSAKKMFSFLKDSNVPLDQNPKLKIHAKSVLVM

SEQ ID NO: 1831 - protein, 84 aa, Artificial Sequence
  misc_feature (1)..(84): useful for making plants with increased cold tolerance as described in USSN 11/779,266
  misc_feature (1)..(84): Truncated version of Public GI ID no. 14701800
  misc_feature (1)..(84): Public GI ID no. 14701800_T
  misc_feature (21)..(82): Pfam Name: Globin Pfam Description: Globin
  misc_feature (1)..(84): Functional homolog of Ceres Clone ID no. 30469
MALVEGNNGVSGGAVSFSEEQEALVLKSWAIMKKDSANIGLRFFLKIFEVAPSASQMFSFLRNSDVPLEKNPKLKTHAMSVFVM

SEQ ID NO: 1832 - protein, 76 aa, Artificial Sequence
  misc_feature (1)..(76): useful for making plants with increased cold tolerance as described in USSN 11/779,266
  misc_feature (1)..(76): Truncated version of Public GI ID no. 15226675
  misc_feature (1)..(76): Public GI ID no. 15226675_T
  misc_feature (13)..(74): Pfam Name: Globin Pfam Description: Globin
  misc_feature (1)..(76): Functional homolog of Ceres Clone ID no. 30469
MESEGKIVFTEEQEALVVKSWSVMKKNSAELGLKLFIKIFEIAPTTKKMFSFLRDSPIPAEQNPKLKPHAMSVFVM

SEQ ID NO: 1833 - protein, 76 aa, Artificial Sequence
  misc_feature (1)..(76): useful for making plants with increased cold tolerance as described in USSN 11/779,266
  misc_feature (1)..(76): Truncated version of Public GI ID no. 15824736
  misc_feature (1)..(76): Public GI ID no. 15824736_T
  misc_feature (13)..(74): Pfam Name: Globin Pfam Description: Globin
  misc_feature (1)..(76): Functional homolog of Ceres Clone ID no. 30469
MATYEGKVFTEEQEALVVKSWTVMKKKTAELGLKFFLKIFEIAPSAKKLFSFLRDSNVPLEQNTKLKPHAMSVFVM

SEQ ID NO: 1834 - protein, 76 aa, Artificial Sequence; identical to SEQ ID NO: 1827
  misc_feature (1)..(76): useful for making plants with increased cold tolerance as described in USSN 11/779,266
  misc_feature (1)..(76): Truncated version of Public GI ID no. 30909306
  misc_feature (1)..(76): Public GI ID no. 30909306_T
  misc_feature (13)..(74): Pfam Name: Globin Pfam Description: Globin
  misc_feature (1)..(76): Functional homolog of Ceres Clone ID no. 30469

SEQ ID NO: 1835 - protein, 73 aa, Artificial Sequence
  misc_feature (1)..(73): useful for making plants with increased cold tolerance as described in USSN 11/779,266
  misc_feature (1)..(73): Truncated version of Public GI ID no. 37903656
  misc_feature (1)..(73): Public GI ID no. 37903656_T
  misc_feature (10)..(71): Pfam Name: Globin Pfam Description: Globin
  misc_feature (1)..(73): Functional homolog of Ceres Clone ID no. 30469
MEGKVFTEEQETLVVKSWGVMKKNAAELGLKFFLKIFEIAPSAQKLFSFLRDSDIPLEKNPKLKPHAMSVFVM

SEQ ID NO: 1836 - protein, 76 aa, Artificial Sequence; identical to SEQ ID NO: 1819
  misc_feature (1)..(76): useful for making plants with increased cold tolerance as described in USSN 11/779,266
  misc_feature (1)..(76): Truncated version of Public GI ID no. 62548111
  misc_feature (1)..(76): Public GI ID no. 62548111_T
  misc_feature (13)..(74): Pfam Name: Globin Pfam Description: Globin
  misc_feature (1)..(76): Functional homolog of Ceres Clone ID no. 30469

SEQ ID NO: 1837 - protein, 99 aa, Populus balsamifera subsp. trichocarpa
  misc_feature (1)..(99): useful for making plants with increased cold tolerance as described in USSN 12/514,991
  misc_feature (1)..(99): Ceres ANNOT ID no.1460715
  misc_feature (1)..(97): Pfam Name: Auxin_inducible Pfam Description: Auxin responsive protein
  misc_feature (1)..(99): Score of 137.2 for HMM of FIGURE 1 of USSN 12/514,991.
  misc_feature (1)..(99): Functional Homolog Of Ceres SEEDLINE ID no. ME12469
MAIRLLGFLAKQSLRRPVSCAHKAASKSSDVPKGFLAVYVGETEKKRFVVPVSYLNQASFQDLLSKAEEEFGFDHPMGGLTIPCAEDTFLDVTSSLSRL

SEQ ID NO: 1838 - protein, 223 aa, Vitis vinifera
  misc_feature (1)..(223): useful for making plants with increased cold tolerance as described in USSN 12/514,991
  misc_feature (1)..(223): Public GI ID no.147804681
  misc_feature (122)..(221): Pfam Name: Auxin_inducible Pfam Description: Auxin responsive protein
  misc_feature (1)..(223): Score of 196.2 for HMM of FIGURE 1 of USSN 12/514,991.
  misc_feature (1)..(223): Functional Homolog Of Ceres SEEDLINE ID no. ME12469
  misc_feature (69)..(69): Xaa is any aa, unknown or other
  misc_feature (100)..(100): Xaa is any aa, unknown or other
  misc_feature (108)..(108): Xaa is any aa, unknown or other
  misc_feature (112)..(112): Xaa is any aa, unknown or other
  misc_feature (118)..(118): Xaa is any aa, unknown or other
MGFRLPGIVNAKQVVQQVCKGAEAKNVPKGYFAVYVGEVQKKRFVVPISYLKNPSFQNLLSQAEEQFGXDHPMGEPLDQLLPEELGKLKASHLRIWDENXGIYIAISXMHYXNNNFKXDYAACSVEWQATMNQQRIIPAKQILRRILPSLESTNVPKGHVPVYVGETQKKRFVIPISYLKHPSFQNLLSQAEEEFGFDHPLGGLTIPCREEAFIDLTCSLNCS

SEQ ID NO: 1839 - DNA, 774 bp, Populus balsamifera subsp. trichocarpa
  misc_feature (1)..(774): useful for making plants with increased cold tolerance as described in USSN 12/514,991
  misc_feature (1)..(774): Ceres ANNOT ID no.1450469
atgggtttccgtttgtcagcaattgtgcgtgctaagcaagtccttcagctttctccatccgcaacaagccaagcagcttctaatgtcccaaagggctgcctagcagtttatgttggagaaatccaaaagaagagatttgtcattccaatatcatacttgaaccagcctaattttcaagagttgctaagtcaagctgaagaagaattcggatatgttcatcctatgggtggtctaacaattccttgcagagaagacattttccttgctgtcatttcttgcttaacactgcttatcactagcttgaaaagtttggttgtcatggggacagaggaagattatgtcattcctaaaatgcttgcaaatcctacgatgactcaactgaaggttcacaaggaaaagaatatgagaaagtccaaagctgaagcctgcttatatgttgccgtgtcgagtacaatatttataagaatcatgaacctgaagtctgcaaagggcatttgggactatctaaaaaaggaataccagagaaatgaaagaacaaaaaatatgcaggtactcaatttgatgagagaatttaaaatgcagaagatgaaggagttaaaaaacatcaaagactatattgacaagttgctgagtatgataaacaagggtgcttttcaagcaaaggcacaaaactcaggaaaaggcaaagacaagagaatcaataagaaaaagaacaacaaaaaaactgaaaatgatagaaacaatgaggaatcatatctaccatgttcatactaa

SEQ ID NO: 1840 - protein, 257 aa, Populus balsamifera subsp. trichocarpa
  misc_feature (1)..(257): useful for making plants with increased cold tolerance as described in USSN 12/514,991
  misc_feature (1)..(257): Ceres ANNOT ID no.1450469
  misc_feature (1)..(95): Pfam Name: Auxin_inducible Pfam Description: Auxin responsive protein
  misc_feature (1)..(257): Score of 138.4 for HMM of FIGURE 1 of USSN 12/514,991.
  misc_feature (1)..(257): Functional Homolog Of Ceres SEEDLINE ID no. ME12469
MGFRLSAIVRAKQVLQLSPSATSQAASNVPKGCLAVYVGEIQKKRFVIPISYLNQPNFQELLSQAEEEFGYVHPMGGLTIPCREDIFLAVISCLTLLITSLKSLVVMGTEEDYVIPKMLANPTMTQLKVHKEKNMRKSKAEACLYVAVSSTIFIRIMNLKSAKGIWDYLKKEYQRNERTKNMQVLNLMREFKMQKMKELKNIKDYIDKLLSMINKGAFQAKAQNSGKGKDKRINKKKNNKKTENDRNNEESYLPCSY

SEQ ID NO: 1841 - DNA, 297 bp, Populus balsamifera subsp. trichocarpa
  misc_feature (1)..(297): useful for making plants with increased cold tolerance as described in USSN 12/514,991
  misc_feature (1)..(297): Ceres ANNOT ID no.1460702
atgggtatccttagttttccttctgtggctcataatgccaagaaaatcctcaaacatcagtctcttcttggtagaaatcactcaaatcttccggaagggcacgttgcagtgtacgttggagaattccaaaagaagcggtttgtggtcccaatttcatatattaatcatccttctttcctagccttgcttaatcaatccgaggaagaatttggcttcaatcatccaatgggtggtcttacaattccttgcaaagaagatgccttcactgatctcacttctcggctacacgactcgtga

SEQ ID NO: 1842 - protein, 98 aa, Populus balsamifera subsp. trichocarpa
  misc_feature (1)..(98): useful for making plants with increased cold tolerance as described in USSN 12/514,991
  misc_feature (1)..(98): Ceres ANNOT ID no.1460702
  misc_feature (3)..(96): Pfam Name: Auxin_inducible Pfam Description: Auxin responsive protein
  misc_feature (1)..(98): Score of 126.2 for HMM of FIGURE 1 of USSN 12/514,991.
  misc_feature (1)..(98): Functional Homolog Of Ceres SEEDLINE ID no. ME12469
MGILSFPSVAHNAKKILKHQSLLGRNHSNLPEGHVAVYVGEFQKKRFVVPISYINHPSFLALLNQSEEEFGFNHPMGGLTIPCKEDAFTDLTSRLHDS

SEQ ID NO: 1843 - DNA, 297 bp, Populus balsamifera subsp. trichocarpa
  misc_feature (1)..(297): useful for making plants with increased cold tolerance as described in USSN 12/514,991
  misc_feature (1)..(297): Ceres ANNOT ID no.1460705
atgggtattcgtttaccatccatgattagcagtgtcaaacatgtaatcaaagggaagtctcttcatggtagaaatcagcctgatgtacccaaaggacatgtagctgtatatgttggagaaatgcaaaagaggaggtttgtggtgccaatatcatacttgagccatccttcatttcaagatttgcttaaccgagctgaggaagagtttggcttcaatcctccaatgggaggtcttacgattccatgcagagaagatgccttcatcaagcttgcctctagattgcaagcctcatcatga

SEQ ID NO: 1844 - protein, 91 aa, Populus balsamifera subsp. trichocarpa
  misc_feature (1)..(91): useful for making plants with increased cold tolerance as described in USSN 12/514,991
  misc_feature (1)..(91): Ceres ANNOT ID no.1460705
  misc_feature (1)..(88): Pfam Name: Auxin_inducible Pfam Description: Auxin responsive protein
  misc_feature (1)..(91): Score of 124.2 for HMM of FIGURE 1 of USSN 12/514,991.
  misc_feature (1)..(91): Functional Homolog Of Ceres SEEDLINE ID no. ME12469
MISSVKHVIKGKSLHGRNQPDVPKGHVAVYVGEMQKRRFVVPISYLSHPSFQDLLNRAEEEFGFNPPMGGLTIPCREDAFIKLASRLQASS

SEQ ID NO: 1845 - DNA, 1947 bp, Gossypium hirsutum
  misc_feature (1)..(1947): useful for making plants with increased cold tolerance as described in USSN 12/514,991
  misc_feature (1)..(1947): Ceres CLONE ID no.1948584
attctcaattactaaacttcttcctttctagaggcacaaatccatcaaaaacaaagaaaactatggctatccgcctccatcaattgaagattttgtttcttttctgaatttccgacgctcccttgttcttgttcgatctttaattctaccgtacatgatctaccttggtctaaaattacttcctgctaccacttttcttgtgcgtattatgagtaggattctaaaaaatcaaatctgtccataatttacagaatctgcagattcaggccatcctttagcaggggaccaagtcctttaattcagtgtgaggtgagaaaattaaagagacaagaaaatgtgactactaaatcatttaattaaactttaattccggattttaatccctgaaaattgtgtaaacttgttttttgttcaaggaaagtcaaagaaaggaataaataaatagtcaattacttgtatcttgaagtgatttactttcttttttatacttttcagtcattcagcacacacacatatatgtttctaagttctcttatatttttataagttgctggatttgatcattctaggagtaatatcacatgtttaggggcttaatgttgcgcttaaatcattcactcctttggattaggccacagttcttatcatcactcctccatgatgtttcaagcagcagcatcgcatgaactgattggcttcctcgttcttgtgtctggcaatgatgaaaataaacagggtagagattgcaactccttgagaattgacaattatttagactatgaagtcattttatcctaatgatagttgaagatttctttgtctaatccatggatctcttgtgattctggaggattagcaataataccataaattacaaggttggttcgtgctttagttcaatcaatcactcctttaaaaatcgaggctcaactgaccaagttctttagggcttccttgttgaatgcaccatacaaagtcacatggactgctaacttgtttgtttatgtgttcaagcaaacatgtaggaccgtacttatcgactgatagttgctagtggagattatcattttgatatttttctggtctgcacttcattgcatttcatccatatgatctgctaagtgtttattaagtgaagtcatcatcatctggccttgattcaatgatattagtatttcaaatgggccacttttgttggtttcattaaatggtgagctctaaggtaccaaacttgttgaaatattatgatttgttgggatgcaaggccatgtgattcctcccaatacatgtctccaaaccattcactcttcaccactcaattagcctgagactgctgaccctacaccatttgctctttataaatacagattctaatggatagcttcacccagcgccaaagcctttcctagcaggttctctaagttactcacatttcctcatcctaactatctcataaaaaagccatgggtttctgcttgccaagaattgttaatgctaagcctagtctgaaacggagcctttcatcttcggagacaacaatggtgcccaaaggccactttgctgtttatgttggagaagttgatgaaaagaagcgattcgttgttcctatatcattgctgaagcatccttcattccagaatttgttgagtcaagctgaagaagagtttggtttcaatcaccccaagggtgcattgacaatcccttgtagcgaagaagctttcattgatctcacttgcaatctgaaaagttcatgagaagaaattggctaaccaagcagagattgattgatctttagctcatctaacacctcccaaattttagttttaggaagcaagtgtgtaaggtgggttgttttttgcaatcccatgcccttgtcaacgaaattgatttttgtaaccaatatataaatttttcaatgaaactttctaaaaaaaaaaaaaaaaaaaa

SEQ ID NO: 1846 - protein, 96 aa, Gossypium hirsutum
  misc_feature (1)..(96): useful for making plants with increased cold tolerance as described in USSN 12/514,991
  misc_feature (1)..(96): Ceres CLONE ID no.1948584
  misc_feature (1)..(94): Pfam Name: Auxin_inducible Pfam Description: Auxin responsive protein
  misc_feature (1)..(96): Score of 131.4 for HMM of FIGURE 1 of USSN 12/514,991.
  misc_feature (1)..(96): Functional Homolog Of Ceres SEEDLINE ID no. ME12469
MGFCLPRIVNAKPSLKRSLSSSETTMVPKGHFAVYVGEVDEKKRFVVPISLLKHPSFQNLLSQAEEEFGFNHPKGALTIPCSEEAFIDLTCNLKSS

SEQ ID NO: 1847 - DNA, 291 bp, Populus balsamifera subsp. trichocarpa
  misc_feature (1)..(291): useful for making plants with increased cold tolerance as described in USSN 12/514,991
  misc_feature (1)..(291): Ceres ANNOT ID no.1450465
atggccatccttcttaagggcatcatgaatgctaagcaaattctccgtcgatcaaatttgcttgctaaccaagcaaccgaagttcctaaaggctactttgcggtctatgttggagagagccaaaagaaaagattcacagttccaatttcattcttgaatcaaccttcattccaagaattgctaagaaaagccgaagaagaattcggatatagtcatccgatgggcggtcttacacttccttgccgagaagatacctttattgacatcatttcaggcttgaatttatcataa

SEQ ID NO: 1848 - protein, 96 aa, Populus balsamifera subsp. trichocarpa
  misc_feature (1)..(96): useful for making plants with increased cold tolerance as described in USSN 12/514,991
  misc_feature (1)..(96): Ceres ANNOT ID no.1450465
  misc_feature (1)..(94): Pfam Name: Auxin_inducible Pfam Description: Auxin responsive protein
  misc_feature (1)..(96): Score of 136.8 for HMM of FIGURE 1 of USSN 12/514,991.
  misc_feature (1)..(96): Functional Homolog Of Ceres SEEDLINE ID no. ME12469
MAILLKGIMNAKQILRRSNLLANQATEVPKGYFAVYVGESQKKRFTVPISFLNQPSFQELLRKAEEEFGYSHPMGGLTLPCREDTFIDIISGLNLS

SEQ ID NO: 1849 - DNA, 792 bp, Populus balsamifera subsp. trichocarpa
  misc_feature (1)..(792): useful for making plants with increased cold tolerance as described in USSN 12/514,991
  misc_feature (1)..(792): Ceres ANNOT ID no.1450481
atgggtgtccttagttttccttctgtgattcataatgccaggaaaatcctcaggcatcagtctcttcctagtagaaatcactcggatgtcccaagaggccacattgcagtgtatgttggggaattccagaagaagcggtttgaggtcccaatatcatatattaatcatccttctttcctagctttgctcaatcgagctgaggacgaatttggcttcagtcatccaatgggtggccttacaattccttgcaaagaagatgccttcattgatctcacttctcggttgcatgactcgtcgaagaaatcaaaggaggacgactatggtattcataccataaacatggcggggcctcttctgatggaatcaacccatgccaggtacttagatatggagaggaaaatcaacagagcggtgtttgtaacaaatgatactgtaaggggttatgaaggctgcaacaaagaggaggggggtgttgccatggtggagactggggatgatgaacaggaagctggtgagaagagtgacgatgggacctcttttgcctcgtgtgagactacggaacagcatggagtggatgcgtttgcagaggagttcataagtaaaatgaaagggatttggaggcatgaaaatcagaaatcagaagaggattgtattgagagctggaaggagcatagagtggatgctattgcagaggacttcataaataaaacgagagggagctggaagcttgaaaagcagaaatcggtggaggagtatattcagagatgggctcggctccatgagtattattaa

SEQ ID NO: 1850 - protein, 263 aa, Populus balsamifera subsp. trichocarpa
  misc_feature (1)..(263): useful for making plants with increased cold tolerance as described in USSN 12/514,991
  misc_feature (1)..(263): Ceres ANNOT ID no.1450481
  misc_feature (1)..(96): Pfam Name: Auxin_inducible Pfam Description: Auxin responsive protein
  misc_feature (1)..(263): Score of 123.5 for HMM of FIGURE 1 of USSN 12/514,991.
  misc_feature (1)..(263): Functional Homolog Of Ceres SEEDLINE ID no. ME12469
MGVLSFPSVIHNARKILRHQSLPSRNHSDVPRGHIAVYVGEFQKKRFEVPISYINHPSFLALLNRAEDEFGFSHPMGGLTIPCKEDAFIDLTSRLHDSSKKSKEDDYGIHTINMAGPLLMESTHARYLDMERKINRAVFVTNDTVRGYEGCNKEEGGVAMVETGDDEQEAGEKSDDGTSFASCETTEQHGVDAFAEEFISKMKGIWRHENQKSEEDCIESWKEHRVDAIAEDFINKTRGSWKLEKQKSVEEYIQRWARLHEYY

SEQ ID NO: 1851 - DNA, 300 bp, Populus balsamifera subsp. trichocarpa
  misc_feature (1)..(300): useful for making plants with increased cold tolerance as described in USSN 12/514,991
  misc_feature (1)..(300): Ceres ANNOT ID no.1450466
atgactagacatctggctgctgctctagccaaacaaattctacgccgatctgtatggaatgcgagtaaaccagcttcaagatctttagatgtaccgaaaggtttcttagctgtctacattggcgaaagagagaagaagcgatttgtagttccagtgtcctatctgaatgagccttcatttcaagatttgcttactaaagctgaagaggagtttggttttaatcatccaatgggtggtttgacaattccttgcagagaagataaattcattgatgtcctttccagcttgagcagatcataa

SEQ ID NO: 1852 - protein, 99 aa, Populus balsamifera subsp. trichocarpa
  misc_feature (1)..(99): useful for making plants with increased cold tolerance as described in USSN 12/514,991
  misc_feature (1)..(99): Ceres ANNOT ID no.1450466
  misc_feature (1)..(97): Pfam Name: Auxin_inducible Pfam Description: Auxin responsive protein
  misc_feature (1)..(99): Score of 123.4 for HMM of FIGURE 1 of USSN 12/514,991.
  misc_feature (1)..(99): Functional Homolog Of Ceres SEEDLINE ID no. ME12469
MTRHLAAALAKQILRRSVWNASKPASRSLDVPKGFLAVYIGEREKKRFVVPVSYLNEPSFQDLLTKAEEEFGFNHPMGGLTIPCREDKFIDVLSSLSRS

SEQ ID NO: 1853 - DNA, 490 bp, Glycine max
  misc_feature (1)..(490): useful for making plants with increased cold tolerance as described in USSN 12/514,991
  misc_feature (1)..(490): Ceres CLONE ID no.586790
aacgcaagccatttgcatccttaagcatcaccatttgggttcttcttccttcaaacaagcacaaaaatgggtttccgttttcctgccattcgacgggcatcattcaacgctaaccaagcagcttcaaaatcagtacaagttccgaagggctatgttgcagtctatgttggagaaaatatgaggaggttcgtgatccccatatcatacttaaaccaaccttcattccaagacttattgagtcaagctgaggaagagtttggatatgatcatcccatgggtggcctcacaattccttgcagtgaagatgtcttccaacagacaacttctcgcttaaatgaacaataaatcccacactttaggaaactaacatagattagtagatacattttgtacaatataggcatgttctctagcgtgtaacaattgttaccaatttttgagtaatgacaacaaattcaattgctaaaaaaaaaaaaaaaaaaaaaaaaaa

SEQ ID NO: 1854 - protein, 92 aa, Glycine max
  misc_feature (1)..(92): useful for making plants with increased cold tolerance as described in USSN 12/514,991
  misc_feature (1)..(92): Ceres CLONE ID no.586790
  misc_feature (1)..(90): Pfam Name: Auxin_inducible Pfam Description: Auxin responsive protein
  misc_feature (1)..(92): Score of 120.7 for HMM of FIGURE 1 of USSN 12/514,991.
  misc_feature (1)..(92): Functional Homolog Of Ceres SEEDLINE ID no. ME12469
MGFRFPAIRRASFNANQAASKSVQVPKGYVAVYVGENMRRFVIPISYLNQPSFQDLLSQAEEEFGYDHPMGGLTIPCSEDVFQQTTSRLNEQ

SEQ ID NO: 1855 - DNA, 455 bp, Brassica napus
  misc_feature (1)..(455): useful for making plants with increased cold tolerance as described in USSN 12/514,991
  misc_feature (1)..(455): Ceres CLONE ID no.966537
aaccaaaaacaagcaatccagtaacattaaccctttcatacattttcaaaagaattcaaactttcagaaaaatggctttggtgagaagtctattgggagcaaagaagattcttggccgctctgtaacagcaacagcttctacgagcaaaagagcagcctcagcggcaccaaaagggtttcttgcggtgtacgtaggagagaaccagaagaagagatatgtggtgccagtctcatacttgagtcagccttcgtttcaagctcttctcagtaaatctgaagaagagtttgggtttgatcatccaatgggtggcttaaccatcccttgtcctgaggacactttcatcaatatgacttctcggcttcaatgatgattatccaacatattgttcgtctagttagagatagacttggtccttgtaaatagaggagtttttttctcctgttcttgaaagagt

SEQ ID NO: 1856 - protein, 121 aa, Brassica napus
  misc_feature (1)..(121): useful for making plants with increased cold tolerance as described in USSN 12/514,991
  misc_feature (1)..(121): Ceres CLONE ID no.966537
  misc_feature (24)..(121): Pfam Name: Auxin_inducible Pfam Description: Auxin responsive protein
  misc_feature (1)..(121): Score of 124.6 for HMM of FIGURE 1 of USSN 12/514,991.
  misc_feature (1)..(121): Functional Homolog Of Ceres SEEDLINE ID no. ME12469
PKTSNPVTLTLSYIFKRIQTFRKMALVRSLLGAKKILGRSVTATASTSKRAASAAPKGFLAVYVGENQKKRYVVPVSYLSQPSFQALLSKSEEEFGFDHPMGGLTIPCPEDTFINMTSRLQ

SEQ ID NO: 1857 - DNA, 469 bp, Glycine max
  misc_feature (1)..(469): useful for making plants with increased cold tolerance as described in USSN 12/514,991
  misc_feature (1)..(469): Ceres CLONE ID no.587445
aaccaaaatcattgacatcctaaagcattcgtagttcaaaaattccatcttcaatttacaagtctttttggacactctgtccctaatttcaacacatacaacaatgggttttcgtttgcctggtatcagaaaggcatcattttctgcaaaccaagcatcttcgaaagccgtggatgtggaaaagggctaccttgcagtctatgtcggagagaaaatgaggcggtttgtgatccccgtatcttacttgaacaaaccctcattccaggacttgttaagtcaggctgaggaagagtttggatatcatcatcccaacggtggcctcacaattccttgcagtgaagatgtcttccaacatataacttctttcttgaattaataaatgtcaattttttttggaggctgcatagattagcgaagacattttgtacaataggcgtcttctcaacttgtaaagatctcccttttcgag

SEQ ID NO: 1858 - protein, 90 aa, Glycine max
  misc_feature (1)..(90): useful for making plants with increased cold tolerance as described in USSN 12/514,991
  misc_feature (1)..(90): Ceres CLONE ID no.587445
  misc_feature (1)..(90): Pfam Name: Auxin_inducible Pfam Description: Auxin responsive protein
  misc_feature (1)..(90): Score of 124.5 for HMM of FIGURE 1 of USSN 12/514,991.
  misc_feature (1)..(90): Functional Homolog Of Ceres SEEDLINE ID no. ME12469
MGFRLPGIRKASFSANQASSKAVDVEKGYLAVYVGEKMRRFVIPVSYLNKPSFQDLLSQAEEEFGYHHPNGGLTIPCSEDVFQHITSFLN

SEQ ID NO: 1859 - DNA, 438 bp, Brassica napus
  misc_feature (1)..(438): useful for making plants with increased cold tolerance as described in USSN 12/514,991
  misc_feature (1)..(438): Ceres CLONE ID no.947173
acatccacacctttcttaaaacagaccaaactctctcttctctctctagacaagttaggtttcaataagctcaaatcatggcgttaaagaagtctaacaaagtggcagcgtctcaagcagcatctctaaagaaaatcttgaagagatgctcaagtcttggaaagaagaatcaaagtaactgctacttcaacgacgtgccaaagggtcacttcccggtctacgttggtcagcaacgtagtcgctacgtggtcccaatctcatggctagatcatcctgagtttcagacactcctccaactggctgaggaagagtttggattcgagcacgacatgggtctcactatcccttgtgacgaagttgtctttcaatcactcatctccatgttcagatagaactcgagattatgatccttattaagattcttaagggtttgatcac

SEQ ID NO: 1860 - protein, 104 aa, Brassica napus
  misc_feature (1)..(104): useful for making plants with increased cold tolerance as described in USSN 12/514,991
  misc_feature (1)..(104): Ceres CLONE ID no.947173
  misc_feature (7)..(104): Pfam Name: Auxin_inducible Pfam Description: Auxin responsive protein
  misc_feature (1)..(104): Score of 172.5 for HMM of FIGURE 1 of USSN 12/514,991.
  misc_feature (1)..(104): Functional Homolog Of Ceres SEEDLINE ID no. ME12469
MALKKSNKVAASQAASLKKILKRCSSLGKKNQSNCYFNDVPKGHFPVYVGQQRSRYVVPISWLDHPEFQTLLQLAEEEFGFEHDMGLTIPCDEVVFQSLISMFR

SEQ ID NO: 1861 - protein, 116 aa, Gossypium hirsutum
  misc_feature (1)..(116): useful for making plants with increased cold tolerance as described in USSN 12/514,991
  misc_feature (1)..(116): Public PUBLICCLONE ID no.100005071
  misc_feature (16)..(116): Pfam Name: Auxin_inducible Pfam Description: Auxin responsive protein
  misc_feature (1)..(116): Score of 177.7 for HMM of FIGURE 1 of USSN 12/514,991.
  misc_feature (1)..(116): Functional Homolog Of Ceres SEEDLINE ID no. ME12469
LNSYLQSQMRMAISRKSNKLAQTAMIKQILKRCSSLGKKQSYGDEQGLPLDVPKGHFVVYVGENRSRYIVPISFLTRPEFQSLLHQAEEEFGFDHDMGLTIPCEEVLFQSLTSMLR

SEQ ID NO: 1862 - DNA, 397 bp, Brassica napus
  misc_feature (1)..(397): useful for making plants with increased cold tolerance as described in USSN 12/514,991
  misc_feature (1)..(397): Ceres CLONE ID no.1035090
aacatttcttcaaacaaaacccaagtttcagagaaaaaggaaaagattaaaaattaaataatgacaataaagaggtcatctcaagcaacatcgatcaagcaaatcttaaagagatgctcgagtctagggaagaagaagaacgtcaacggttgctactataatcaagaagatgatagttttccacaagacgtgccaaaaggtcattttccggtttatgttggaccaaaccgaagtcgctacatcgttcccatctcgtggctcgaatactccgagtttcaaacgttgctccgactagccgaggaagagtttggttttgaccataatatgggtcttatcataccctgtgatgaagggttcttcaggtctctgatctccatgttcagataaagttcgatct

SEQ ID NO: 1863 - protein, 108 aa, Brassica napus
  misc_feature (1)..(108): useful for making plants with increased cold tolerance as described in USSN 12/514,991
  misc_feature (1)..(108): Ceres CLONE ID no.1035090
  misc_feature (2)..(108): Pfam Name: Auxin_inducible Pfam Description: Auxin responsive protein
  misc_feature (1)..(108): Score of 139.7 for HMM of FIGURE 1 of USSN 12/514,991.
  misc_feature (1)..(108): Functional Homolog Of Ceres SEEDLINE ID no. ME12469
MTIKRSSQATSIKQILKRCSSLGKKKNVNGCYYNQEDDSFPQDVPKGHFPVYVGPNRSRYIVPISWLEYSEFQTLLRLAEEEFGFDHNMGLIIPCDEGFFRSLISMFR

SEQ ID NO: 1864 - protein, 161 aa, Arabidopsis thaliana
  misc_feature (1)..(161): useful for making plants with increased cold tolerance as described in USSN 12/514,991
  misc_feature (1)..(161): Ceres SEEDLINE ID no.ME30329
  misc_feature (77)..(142): Pfam Name: Auxin_inducible Pfam Description: Auxin responsive protein
  misc_feature (1)..(161): Score of 145.8 for HMM of FIGURE 1 of USSN 12/514,991.
  misc_feature (1)..(161): Functional Homolog Of Ceres SEEDLINE ID no. ME12469
MDDQGGSKPTGIRQIVRLKEILQKWQTITLCTMPSTDTPHSEENHGVFCPPINQRLKNIMSFDSDEDSCHGSEPPPDVPKGYLAVYVGPELRRFIIPTSYLSHPVFTILLEKAEEEFGYDHNGGLTLPCEIETFKYLLKCIENHPNNHPVGSSVSEQLEIH

SEQ ID NO: 1865 - DNA, 950 bp, Brassica napus
  misc_feature (1)..(950): useful for making plants with increased cold tolerance as described in USSN 12/514,991
  misc_feature (1)..(950): Ceres CLONE ID no.870882
accctcccacgagcccacctgacattttctctctagctttctcgtgaagaaatagagattatacttcgatttagactaaaccggagaaagaaccaaaataatggccggaggtctcgtaaaatgcagcaagatccgccacattgtcagtctcaagcaaatgctccggcgatggcgcaacaaagcacggttatcttcagtcagccgttgtgtgccgtcggatgttccatctggacacgtggcggtctgtattggtagcagttgcaggagattcgtggtgcgcgcgtcgtacctgaaccacccaatcctgagtaatctgcttgtccaagccgaggaagagttcggtttcgcgaaccagggaccgttggttatcccctgcgaagaatcggttttcgaggaagcgatccggttcatttcccggtctgattcttcccggtcaagccggtttacttgtcccgacgatcttcagaaatgccacggaggaatcaaaagcatgttgatcgaatctaggccgttgcttcacgccgccgtcgtcgagaaagtcgtatggtgaagagtgttggttcgtacgatttctgattcagttttgactcgaaatgagtttggtcgccacgtgaaaggaagcagacgagttttgtaataaaaatcgtcaaagactccgctgagttaccaccggttcgggtggtgctaattttaatcgggatcagggttttttttttgtttactaaatatatatttatatgggcggggtggcgaggtacgcactgagtcgagatggacgaggttacggattgagaaggagatggcggtttattagagtatataagattgattgaaccggtggtttaatgtgaaaacccggtagagtagctagtataaatactgatgatgattgtagaatacacttgagttgaataatacaagatttttactctgtaaaaaaaaaaaaaaaa

SEQ ID NO: 1866 - protein, 149 aa, Brassica napus
  misc_feature (1)..(149): useful for making plants with increased cold tolerance as described in USSN 12/514,991
  misc_feature (1)..(149): Ceres CLONE ID no.870882
  misc_feature (1)..(149): Score of 193.9 for HMM of FIGURE 1 of USSN 12/514,991.
  misc_feature (7)..(105): Pfam Name: Auxin_inducible Pfam Description: Auxin responsive protein
  misc_feature (1)..(149): Functional Homolog Of Ceres SEEDLINE ID no. ME12469
MAGGLVKCSKIRHIVSLKQMLRRWRNKARLSSVSRCVPSDVPSGHVAVCIGSSCRRFVVRASYLNHPILSNLLVQAEEEFGFANQGPLVIPCEESVFEEAIRFISRSDSSRSSRFTCPDDLQKCHGGIKSMLIESRPLLHAAVVEKVVW

SEQ ID NO: 1867 - protein, 124 aa, Arabidopsis thaliana
  misc_feature (1)..(124): useful for making plants with increased cold tolerance as described in USSN 12/514,991
  misc_feature (1)..(124): Ceres SEEDLINE ID no.ME27667
  misc_feature (3)..(119): Pfam Name: Auxin_inducible Pfam Description: Auxin responsive protein
  misc_feature (1)..(124): Score of 141.5 for HMM of FIGURE 1 of USSN 12/514,991.
  misc_feature (1)..(124): Functional Homolog Of Ceres SEEDLINE ID no. ME12469
MAIKKGGAAASGLKQILRRCSSLGRRQQQQHSEYEEEYNDEEEEASGLPSDVPRGHFAVYVGERRRRFVVPIALLDRPEFRTLLRRAEEEFGFAGAGAGGILVLPCEEVAFRSLTSALACAGAR

SEQ ID NO: 1868 - DNA, 998 bp, Gossypium hirsutum
  misc_feature (1)..(998): useful for making plants with increased cold tolerance as described in USSN 12/514,991
  misc_feature (1)..(998): Ceres CLONE ID no.1838450
aaaagatccatttttttctcgattctcaaagcaaagccaaaaaaaaataaaaaaaatcaaagcttttttttttttttttgtgggtgttttagtctaaccggaaaaaaatgtcgtcgtcggcgggacttggaaaatgcagcaagatccgccacattgtgaggctccgacaaatgctgcggcggtggaggaacaaggctcgcatgtcggccagtcgtatcccgtctgatgttccggcgggacatgtggcggtcacagtggggactagttgccggaggttcgtcgtgagggcgacgtacttgaaccatcccgtgtttaggaaactcctcatccaagccgaagaagagtacggattcactaaccaaggcccattggcgatcccctgcgacgagacggtattcgaggaagtgatccggttcatttcccggtcggagtcgggtaaatccgccgccgctaagttcgtcaacatcgagggtaactgtcacgtcggaatgtggagtaataagctcgatttgtggaccgaatctcgaccgttactcaatgggttggctgaaaaaacaatttggtaaataaaaaaaatacagtggaaagtgaaaaaaagaaggaaactttgattcttacccgaccgtgttagctcaagtcaagtgagtaatcaacgagttggccgagttgaggaggttcatacttaatactaattcatgggttttacttaccactgtaaaaaaaaggtaggttggttattttacttctttttttttccataattgagggaggaggggggtaaaagtttaaaacgtgttgagtcaatggagatggctgaaaaggtgggtgagtgatccgccgagtcgtcccgcgttcggatgcagactttgacacacgtgaaaattcactgctgtaaattccgtgattgaggaggaaaaaaaaaattgtagagattatataatatattttccaatcaatgatatttaattattttccattaaaaaaaaaaaaaaaaaaaa

SEQ ID NO: 1869 - protein, 152 aa, Gossypium hirsutum
  misc_feature (1)..(152): useful for making plants with increased cold tolerance as described in USSN 12/514,991
  misc_feature (1)..(152): Ceres CLONE ID no.1838450
  misc_feature (1)..(152): Score of 182.2 for HMM of FIGURE 1 of USSN 12/514,991.
  misc_feature (9)..(105): Pfam Name: Auxin_inducible Pfam Description: Auxin responsive protein
  misc_feature (1)..(152): Functional Homolog Of Ceres SEEDLINE ID no. ME12469
MSSSAGLGKCSKIRHIVRLRQMLRRWRNKARMSASRIPSDVPAGHVAVTVGTSCRRFVVRATYLNHPVFRKLLIQAEEEYGFTNQGPLAIPCDETVFEEVIRFISRSESGKSAAAKFVNIEGNCHVGMWSNKLDLWTESRPLLNGLAEKTIW

SEQ ID NO: 1870 - DNA, 1079 bp, Gossypium hirsutum
  misc_feature (1)..(1079): useful for making plants with increased cold tolerance as described in USSN 12/514,991
  misc_feature (1)..(1079): Ceres CLONE ID no.1934672
ctccttccagaagtccaaagcaaagtcaagcccgaacaagcaaagactgactttgttttttggttttttatatttgagatcttaatttttccgggaaaatgtcggcggggcttggaaaatgcggtaaaatccgccacattgtgaggcttcgccaaatgttgcggcggtggaggaacaagtcccgcatgtcggccagtcgcatcccatccgatgttccggcggggcacgttgcagtttgcgttgggacgagctgcagaagattcgtggtgcgcgccacgtacctcaaccatcccatttttaagagactccttatccaagccgaggaagagtacggcttcactaaccaaggcccattggcgatcccctgcgacgagtcagttttcgaagaagtgatccggtttatttctcgctcggagtcgggtcactccggtatgttcgtgaacaccgaggactttaaagtgaagtgtcacgtgggaaggagtaagcttgatttgtggacagaatcgcgacctttacttcatgggtttaaagaagtagtgggaagagaaagacaacggttttgattctatcgggatttcggactcggctcctggataactcgagtcaacagctagttacggactactgaaataagtgagccggccgagctgaggaggtggcaactaaatataccaccatataagttgatgagggattttagtttaaaaattgcatgtacttgattggggggggtaaaggaaaatagctccggagaacgtgtggagatggcagaaaaggcgggtgagtgatcgccgagtcgtcccggttcaaatcgtaatggaattggaggcaaaagaaaaaaggtgaagacgttgtcacagttgaattcttgaagaatgtagaaggaaaaagatgatgattgttaaacaaaaaaaactgctgtacattctgtaatttattgattgatgaagtcaaatattgtagtgatattccgttaattatgtatcattttttttccattccacctttgatttattaaacttttctattttatgttttgacttttaaaataataacaattaaggaaccagttacacatg

SEQ ID NO: 1871 - protein, 154 aa, Gossypium hirsutum
  misc_feature (1)..(154): useful for making plants with increased cold tolerance as described in USSN 12/514,991
  misc_feature (1)..(154): Ceres CLONE ID no.1934672
  misc_feature (1)..(154): Score of 182 for HMM of FIGURE 1 of USSN 12/514,991.
  misc_feature (7)..(103): Pfam Name: Auxin_inducible Pfam Description: Auxin responsive protein
  misc_feature (1)..(154): Functional Homolog Of Ceres SEEDLINE ID no. ME12469
MSAGLGKCGKIRHIVRLRQMLRRWRNKSRMSASRIPSDVPAGHVAVCVGTSCRRFVVRATYLNHPIFKRLLIQAEEEYGFTNQGPLAIPCDESVFEEVIRFISRSESGHSGMFVNTEDFKVKCHVGRSKLDLWTESRPLLHGFKEVVGRERQRF

SEQ ID NO: 1872 - DNA, 528 bp, Zea mays
  misc_feature (1)..(528): useful for making plants with increased cold tolerance as described in USSN 12/514,991
  misc_feature (1)..(528): Ceres CLONE ID no.1678318
gcctgcaaaagccagccaccagcccaccaccgtgcccatttcacctcaccactaccaggaacccccgccattgattggcccattcccaacccaaccgcgcggctagaggcacaggcacctcgaccggcgaccgggagtgcgtgcgctcgctcgctcactcgtgcggtgggcatggagaaatgcagcagcaagatccggtccatcgtgtggctgcggcagacgctgcggcggtggcggtcccgagcggcgtcgcgcgcggcggcggcggcggcggctgatgcggcggtcccgtcgggccacgtggcggtgtgcgtgggcggcgcgtcgcggcggttcgtggtgcgggcggcgcacctgaaccaccccgtgttccgggagctgctccggcaggcggaggaggagtacgggttcccgcgcgcgggccccatcgcgctcccctgcgacgaggccctcttcgagcacgtcctccgccacctctccgccccgtccaaatcctcctcccgcttcgtcaccctcgacgacctccaa

SEQ ID NO: 1873 - protein, 119 aa, Zea mays
  misc_feature (1)..(119): useful for making plants with increased cold tolerance as described in USSN 12/514,991
  misc_feature (1)..(119): Ceres CLONE ID no.1678318
  misc_feature (1)..(119): Score of 125.4 for HMM of FIGURE 1 of USSN 12/514,991.
  misc_feature (4)..(103): Pfam Name: Auxin_inducible Pfam Description: Auxin responsive protein
  misc_feature (1)..(119): Functional Homolog Of Ceres SEEDLINE ID no. ME12469
MEKCSSKIRSIVWLRQTLRRWRSRAASRAAAAAAADAAVPSGHVAVCVGGASRRFVVRAAHLNHPVFRELLRQAEEEYGFPRAGPIALPCDEALFEHVLRHLSAPSKSSSRFVTLDDLQ

SEQ ID NO: 1874 - DNA, 985 bp, Gossypium hirsutum
  misc_feature (1)..(985): useful for making plants with increased cold tolerance as described in USSN 12/514,991
  misc_feature (1)..(985): Ceres CLONE ID no.1839566
ctctctaaagatccatttttttctcgattctcaaagcaaagccaaaaaaaaacaaagcttttttttttgtgggtgttttagtcttaccggaaaaaaaatgtcgtcggtgggacttggaaaatgcagcaagatccgccacattgtgaggctccgacaaatgctgcggcggtggaggaacaaggctcgcatgtcggccagtcgtatcccgtctgatgttccggcgggacatgtggcggtcacagtggggactagttgccggaggttcgtcgtcagggcgacgcacttgaaccaccccgtgtttaggaaactcctcatccaagccgaagaagagtacggattcactaaccaaggcccattggcgatcccctgcgacgagacggtattcgaggaagtgatccggttcatttgtcggtcggagtcgggtcactccgccgccgctaagttcgtcaacatcgggggtaactgtcacgtcggaatgtggagtaataagctcgatttgtggaccgaatctcgaccgttactcaatgggttggctgaaaaaacaatttggtaaataaaaaaatacagtggaaagtgaaaaaagaaggaaactttgattcttacccgaccgagttagctcaagtcaagtgagtaatcaacgagttggccgagttgaggaggttcatacttaatactaattcatgggttttacttaccactgtaaaaaaaagtaagttggttggttattttacttctttttttttccataattgagggaggaggggtaaaagttaaaacgtgttgagtcaatggagatggctgaaaaggtgggtgagtgatccgccgagtcgtcccgagttcggatggagactttgacacgcgtgaaattcactgctgtaaattccgtgattgaggagggaaaaaaattgtagagattatattatataatatattttccaatcaatgatatttaattattttccattaaaaaaaaaaaaaaaaaaaa

SEQ ID NO: 1875 - protein, 151 aa, Gossypium hirsutum
  misc_feature (1)..(151): useful for making plants with increased cold tolerance as described in USSN 12/514,991
  misc_feature (1)..(151): Ceres CLONE ID no.1839566
  misc_feature (1)..(151): Score of 177.9 for HMM of FIGURE 1 of USSN 12/514,991.
  misc_feature (8)..(104): Pfam Name: Auxin_inducible Pfam Description: Auxin responsive protein
  misc_feature (1)..(151): Functional Homolog Of Ceres SEEDLINE ID no. ME12469
MSSVGLGKCSKIRHIVRLRQMLRRWRNKARMSASRIPSDVPAGHVAVTVGTSCRRFVVRATHLNHPVFRKLLIQAEEEYGFTNQGPLAIPCDETVFEEVIRFICRSESGHSAAAKFVNIGGNCHVGMWSNKLDLWTESRPLLNGLAEKTIW

SEQ ID NO: 1876 - DNA, 336 bp, Populus balsamifera subsp. trichocarpa
  misc_feature (1)..(336): useful for making plants with increased cold tolerance as described in USSN 12/514,991
  misc_feature (1)..(336): Ceres ANNOT ID no.1497445
atgggtggtggagaaaagagcctaaagaacttccacctccacctgccgaatcttcatcatcaccatcacaagaagcaggcgagagatgttccgaaagggtgtttggcaatcaaggtgggccagggagaggagcagcagagatttgtggtgcctgtcatatacttcaatcacccactgttcatacagttattgaaggaagcagaagaagaatatggttttgatcaaaaaggcaccatcactatcccttgtcatgtggaggagtttatgtacgtccaaggcatgattgacaaggaaaagcccatccatcatcaccatgttggatgttttagggtttga

SEQ ID NO: 1877 - protein, 111 aa, Populus balsamifera subsp. trichocarpa
  misc_feature (1)..(111): useful for making plants with increased cold tolerance as described in USSN 12/514,991
  misc_feature (1)..(111): Ceres ANNOT ID no.1497445
  misc_feature (1)..(111): Score of 129.4 for HMM of FIGURE 1 of USSN 12/514,991.
  misc_feature (1)..(96): Pfam Name: Auxin_inducible Pfam Description: Auxin responsive protein
  misc_feature (1)..(111): Functional Homolog Of Ceres SEEDLINE ID no. ME12469
MGGGEKSLKNFHLHLPNLHHHHHKKQARDVPKGCLAIKVGQGEEQQRFVVPVIYFNHPLFIQLLKEAEEEYGFDQKGTITIPCHVEEFMYVQGMIDKEKPIHHHHVGCFRV

SEQ ID NO: 1878 - DNA, 408 bp, Populus balsamifera subsp. trichocarpa
  misc_feature (1)..(408): useful for making plants with increased cold tolerance as described in USSN 12/514,991
  misc_feature (1)..(408): Ceres ANNOT ID no.1467597
atggggagtggagataaaaatcatttgagtttccatattcacttgccaaatcaccatcaccaccaccaccatcatcaccaccaccaccaccatgatcatcatggcaagaagcagttgaaagatatcccaaaagggtgtctggcagtcatggtagggcaaggtgaggagcaacagaggtttgtgattcctgtgatttatataaatcacccgctgttcatgcagttattgaaagaagctgaggaagagtttggatttgatcaagaaggccccatcactattccttgccatgttgaggagtttcgcaatgttcaaggcatgattgaagaggaaaagtcctcccaagatcatcaacaacaacaacaccaccaccaccaccatcaccatcatatcttgtgctttagggtttga

SEQ ID NO: 1879 - protein, 135 aa, Populus balsamifera subsp. trichocarpa
  misc_feature (1)..(135): useful for making plants with increased cold tolerance as described in USSN 12/514,991
  misc_feature (1)..(135): Ceres ANNOT ID no.1467597
  misc_feature (1)..(135): Score of 115 for HMM of FIGURE 1 of USSN 12/514,991.
  misc_feature (1)..(108): Pfam Name: Auxin_inducible Pfam Description: Auxin responsive protein
  misc_feature (1)..(135): Functional Homolog Of Ceres SEEDLINE ID no. ME12469
MGSGDKNHLSFHIHLPNHHHHHHHHHHHHHHDHHGKKQLKDIPKGCLAVMVGQGEEQQRFVIPVIYINHPLFMQLLKEAEEEFGFDQEGPITIPCHVEEFRNVQGMIEEEKSSQDHQQQQHHHHHHHHHILCFRV

SEQ ID NO: 1880 - protein, 136 aa, Arabidopsis thaliana
  misc_feature (1)..(136): useful for making plants with increased cold tolerance as described in USSN 12/514,991
  misc_feature (1)..(136): Public GI ID no.15228626
  misc_feature (1)..(136): Score of 130.5 for HMM of FIGURE 1 of USSN 12/514,991.
  misc_feature (1)..(97): Pfam Name: Auxin_inducible Pfam Description: Auxin responsive protein
  misc_feature (1)..(136): Functional Homolog Of Ceres SEEDLINE ID no. ME12469
MGSGEKILKSVHSNRPNNVKSNSKHGIKDVPKGCLAIKVGSKEEEKQRFVVPVFYFNHPLFMQLLREAEEEYGFEQKGTITIPCHVEVFRYVQDMINRERSLDDDDDASKQTGCGAKHGLTHKIRSRSSSGVWKYP

SEQ ID NO: 1881 - DNA, 357 bp, Populus balsamifera subsp. trichocarpa
  misc_feature (1)..(357): useful for making plants with increased cold tolerance as described in USSN 12/514,991
  misc_feature (1)..(357): Ceres ANNOT ID no.1472947
atggggagtggggataaactccatttgaatttccatattcacttgccaaaaaaccaccaccaccaccaccaccacaggaagaaagagttgaaagatatcccaaaagggtgtcttgctgtcatggtaggtcaaggtgaggagcaacaaaggtttgtgattcctgtgatttatataaatcatccactcttcatgcacctgttgaaagaagctgaggaagagtttggatttgatcaacaaggccccatcactattccttgtcatgttgaggagtttcgcaatattgttcaaggcatgatcgaagaggagaattcccagtatcaccaccaccactatcatgtttggtgctttagggtttga

SEQ ID NO: 1882 - protein, 118 aa, Populus balsamifera subsp. trichocarpa
  misc_feature (1)..(118): useful for making plants with increased cold tolerance as described in USSN 12/514,991
  misc_feature (1)..(118): Ceres ANNOT ID no.1472947
  misc_feature (1)..(118): Score of 116.4 for HMM of FIGURE 1 of USSN 12/514,991.
  misc_feature (1)..(100): Pfam Name: Auxin_inducible Pfam Description: Auxin responsive protein
  misc_feature (1)..(118): Functional Homolog Of Ceres SEEDLINE ID no. ME12469
MGSGDKLHLNFHIHLPKNHHHHHHHRKKELKDIPKGCLAVMVGQGEEQQRFVIPVIYINHPLFMHLLKEAEEEFGFDQQGPITIPCHVEEFRNIVQGMIEEENSQYHHHHYHVWCFRV

SEQ ID NO: 1883 - DNA, 922 bp, Brassica napus
  misc_feature (1)..(922): useful for making plants with increased cold tolerance as described in USSN 12/514,991
  misc_feature (1)..(922): Ceres CLONE ID no.943320
  misc_feature (568)..(568): y is t/u or c
  misc_feature (571)..(571): y is t/u or c
  misc_feature (575)..(575): m is a or c
  misc_feature (624)..(624): y is t/u or c
  misc_feature (782)..(782): y is t/u or c
attctcaaaacaaaaaaaaacataatatacatctatgcttagcatatcatgagcaatatccccacatctctcaccgactcatctctttctatctttctcctcactatctcttctgccgtcgatccttggcccttttctatctccgtcttctaacatcaacctctgccttttcaccgtccttcagcgtttcattcaatcagtaagaaagactttatcattttaatgggttttgaagatcaagaagaacagaaacagagtccaaaacagagtcagagccagatggtgttcaagtttcacttttatgttccccatctccacatacaccatcatcataaccaccatcatgttccgaaaggctgtgtcgcgatcatggtgggacacgaaggagatgaagaaggtctacacagattcgtggttccgttgatgttcttgagccatcctctgtttttgagtctcttgaaagaagctgaacaagagtacggattcaaacacgcgggcccgattacgattccttgccgcgtcgatgagtttaagcatgttcaggagattatcgacgaggagactcatygtygtcmcagtcacggacacaactaccaccaccaccacaaccatttgccatgtatytgaagatctgttggttaggtttggtttgatttgacatataattgggtatattggtttggtttgactttccttttgagattgttttagttattgcataattttcgtttgtagttagtgatgatgatgaaaaacagcgagtagttgaatgcgaatgcttytcatctattacgaatgaaatcgtgaggagtacgaaatttcagtttgtggttgtgggataatgtatttatttgttttttttttttcaagaaaaggaatgtaaaatttcttttatttttaattgatttttacgcgttcggcc

SEQ ID NO: 1884 - protein, 115 aa, Brassica napus
  misc_feature (1)..(115): useful for making plants with increased cold tolerance as described in USSN 12/514,991
  misc_feature (1)..(115): Ceres CLONE ID no.943320
  misc_feature (1)..(115): Score of 106.3 for HMM of FIGURE 1 of USSN 12/514,991.
  misc_feature (1)..(92): Pfam Name: Auxin_inducible Pfam Description: Auxin responsive protein
  misc_feature (1)..(115): Functional Homolog Of Ceres SEEDLINE ID no. ME12469
  misc_feature (97)..(97): Xaa is any aa, unknown or other
  misc_feature (98)..(98): Xaa is any aa, unknown or other
  misc_feature (99)..(99): Xaa is any aa, unknown or other
  misc_feature (115)..(115): Xaa is any aa, unknown or other
MVFKFHFYVPHLHIHHHHNHHHVPKGCVAIMVGHEGDEEGLHRFVVPLMFLSHPLFLSLLKEAEQEYGFKHAGPITIPCRVDEFKHVQEIIDEETHXXXSHGHNYHHHHNHLPCX

SEQ ID NO: 1885 - DNA, 981 bp, Populus balsamifera subsp. trichocarpa
  misc_feature (1)..(981): useful for making plants with increased cold tolerance as described in USSN 12/514,991
  misc_feature (1)..(981): Ceres ANNOT ID no.1470922
atgagaaagataagaggtttcaagattggcaaacggttagtccggatctccacatggatcttccgtcggacccggatccacccaccgggttacaaccttttaggccaatcagaatcaacatgcaggtccaagccaaagtccatatcgaaaataatcaactggggtcgtcgtttaacaaaaggagctaaatcactttgcggtgcaaaaccagggtcgggttacatacccatgggtcatgaactggtttgcgataaaccggttactgtaccaaaagggcacttggctgtttacgttggtcaaaaagacggcgactttcatagagttttggtgcctgtgatttattttaatcatcctttgtttggtgagttattaagagaagccgaagaggaatatgggtttaatcaacaaggtgggattaccattccttgccgattctcggagtttgagagtgtccaaacccgtattaaagctgggtctggagggaagccgacgtggaaactttgggaggctaaagaatacaagggattcttctgttatgcagagttttcaaaggttcttttcggtagtggagaatcttatgaccggaatcaaaatattacgcataccaaccacaacttgatgggcaaataccagtcctttgattgtgtcaaggtctatggatcaaatggtgtattgctgtatattgaagcttggtggatggatgtgagcgacccttccgggaaaaattatcaattggcaaggtactgtatcatgtttccactttccaggatgatagcaatcttgcggaatctggaaaaggaagccggtgtagctatcagtcgaagtgtggatggttcaataaggtcaagaaagtcaacatcaaggctcataattgtcaaggaattggtcaatttgtccattccaatgaagtttctgccaaaaattaagcaagtggctgatgcgagggcgaccaacgtaaaggccacttggtcaagtagctga

SEQ ID NO: 1886 - protein, 250 aa, Populus balsamifera subsp. trichocarpa
  misc_feature (1)..(250): useful for making plants with increased cold tolerance as described in USSN 12/514,991
  misc_feature (1)..(250): Ceres ANNOT ID no.1470922
  misc_feature (1)..(250): Score of 122.4 for HMM of FIGURE 1 of USSN 12/514,991.
  misc_feature (12)..(80): Pfam Name: Auxin_inducible Pfam Description: Auxin responsive protein
  misc_feature (1)..(250): Functional Homolog Of Ceres SEEDLINE ID no. ME12469
MGHELVCDKPVTVPKGHLAVYVGQKDGDFHRVLVPVIYFNHPLFGELLREAEEEYGFNQQGGITIPCRFSEFESVQTRIKAGSGGKPTWKLWEAKEYKGFFCYAEFSKVLFGSGESYDRNQNITHTNHNLMGKYQSFDCVKVYGSNGVLLYIEAWWMDVSDPSGKNYQLARYCIMFPLSRMIAILRNLEKEAGVAISRSVDGSIRSRKSTSRLIIVKELVNLSIPMKFLPKIKQVADARATNVKATWSSS

SEQ ID NO: 1887 - DNA, 838 bp, Arabidopsis thaliana
  misc_feature (1)..(838): useful for making plants with increased cold tolerance as described in USSN 12/514,991
  misc_feature (1)..(838): Ceres CLONE ID no.1341316
tctttagcgtttacacagccacaaattcctcaatactctatatttctcttcccgtttgaaactccaaagcttgtttgatgaaaacagagtaaacggttctgttcaaaacatttttcaagctctgttactttgttttttcaacgatgaggaagttaagaggaatcaaaattagaagaccgattaaacaaatctcaagatggatcctccggagaattaagattcgtcgttcaagatacacccggttaagcccaaaccgcccggtttgcaagccgagagccatcacaaaactcataagttggggtcgaagtctcacatcccacagcgccaggtttattgggtctaaatgctccaattcagggtacataccaattggtcaagaacccattcgagaaaaactcgacccggttccgaaaggtcactcggcggtttatatcggtaaaaaagacggcgactttcagagagttttggtgcctatcgtttactttaaccatcctctgtttggtgagcttcttagagaggctgaagaagaatttgggttttctcaagaaggtggaatcactatcccttgtccttactcagatttcaaacgggtccaaacccgaattgaatccgggtcgggtttctgtaaatttccctggagccggcggcggcaataacgacggtggaagaagatgatgatgatgaaaaagttctttaactcttttttactattttctaccttttcacttttgttactatttttacccttttgttagatatgtacatattctgtatgtgaaaagtgaggtttgaatttaggcgataatgtaaataatataaagattttttatttttcatg

SEQ ID NO: 1888 - protein, 170 aa, Arabidopsis thaliana
  misc_feature (1)..(170): useful for making plants with increased cold tolerance as described in USSN 12/514,991
  misc_feature (1)..(170): Ceres CLONE ID no.1341316
  misc_feature (1)..(170): Score of 160.6 for HMM of FIGURE 1 of USSN 12/514,991.
  misc_feature (86)..(155): Pfam Name: Auxin_inducible Pfam Description: Auxin responsive protein
  misc_feature (1)..(170): Functional Homolog Of Ceres SEEDLINE ID no. ME12469
MRKLRGIKIRRPIKQISRWILRRIKIRRSRYTRLSPNRPVCKPRAITKLISWGRSLTSHSARFIGSKCSNSGYIPIGQEPIREKLDPVPKGHSAVYIGKKDGDFQRVLVPIVYFNHPLFGELLREAEEEFGFSQEGGITIPCPYSDFKRVQTRIESGSGFCKFPWSRRRQ

SEQ ID NO: 1889 - DNA, 906 bp, Brassica napus
  misc_feature (1)..(906): useful for making plants with increased cold tolerance as described in USSN 12/514,991
  misc_feature (1)..(906): Ceres CLONE ID no.971645
ctgtagcgtttagacagccacataatcctcaaagcacatcttcttcttcccattctcaaatctccaccgttgatcatctaaaccgatcaatcaagtttgtttctttgctccgaaacagaggttctgttccttgttctgtcttttttttcaacgatgagaaagttaagagggatcaagattagaagaccgattcaacgaatctcaagatggattcttcggagaatccgactccgacgatccagatacatccggttaggcccgactcaaccggtttgcaaaccaaaagccatcacaaagctcataagctggggacgcagcctcacatcacacagcgccaggtttctcgggtctaagatatcaaactccggatacgcaccgatcggtaatgacccgattcaaagtaaacccgacccggttccgaaaggtcactcggcggtttacgtcggtaagaaagacggcgactttcatagagttttggtgcctattgtgtactttaaccatcctctgttcggtgagcttctgagagaggcagaggaagagtttgggttttgtcaagaaggtgggatcactatcccttgtccttattcggattttaaacgggttcagacccgtattgaatccgggtcgggttttggtaaactgttctggtgccggcgccggcaataacaacgacgggagaagactgttgactaaagataatgatgaagaaagttttaaactcttttttactatttactttcttttgtgaccttttcacctttttcactgcttttagttttttttatcctttttgttagatatgtgtatatgtgatcatgtggaagtgagatttttcttagtttataaactaagacgatactgtaaataattcagagatttttccttttccgaaaaaaaaaaaaaaaa

SEQ ID NO: 1890 - protein, 170 aa, Brassica napus
  misc_feature (1)..(170): useful for making plants with increased cold tolerance as described in USSN 12/514,991
  misc_feature (1)..(170): Ceres CLONE ID no.971645
  misc_feature (1)..(170): Score of 160.1 for HMM of FIGURE 1 of USSN 12/514,991.
  misc_feature (50)..(155): Pfam Name: Auxin_inducible Pfam Description: Auxin responsive protein
  misc_feature (1)..(170): Functional Homolog Of Ceres SEEDLINE ID no. ME12469
MRKLRGIKIRRPIQRISRWILRRIRLRRSRYIRLGPTQPVCKPKAITKLISWGRSLTSHSARFLGSKISNSGYAPIGNDPIQSKPDPVPKGHSAVYVGKKDGDFHRVLVPIVYFNHPLFGELLREAEEEFGFCQEGGITIPCPYSDFKRVQTRIESGSGFGKLFWCRRRQ

SEQ ID NO: 1891 - DNA, 297 bp, Populus balsamifera subsp. trichocarpa
  misc_feature (1)..(297): useful for making plants with increased cold tolerance as described in USSN 12/514,991
  misc_feature (1)..(297): Ceres ANNOT ID no.1460713
atggctattcgtttgcctggtctggctaaacaaagtctccgtaggtctttctcgacagcaaataaagcttcatcaaagtatttggatgtaccgaaaggtttcctagctgtttatgtgggagaaaccgagaagaagagatttgtggttccagtttcctatttgaaccagccttcatttcaagatttgctaagtaaggctgaggatgaattcggctttgatcatccaatgggtggtttaaccattccttgtgccgaagagactttccttcatgtcacctctagcttgagtagattctaa

SEQ ID NO: 1892 - protein, 98 aa, Populus balsamifera subsp. trichocarpa
  misc_feature (1)..(98): useful for making plants with increased cold tolerance as described in USSN 12/514,991
  misc_feature (1)..(98): Ceres ANNOT ID no.1460713
  misc_feature (1)..(98): Score of 140.1 for HMM of FIGURE 1 of USSN 12/514,991.
  misc_feature (1)..(96): Pfam Name: Auxin_inducible Pfam Description: Auxin responsive protein
  misc_feature (1)..(98): Functional Homolog Of Ceres SEEDLINE ID no. ME12469
MAIRLPGLAKQSLRRSFSTANKASSKYLDVPKGFLAVYVGETEKKRFVVPVSYLNQPSFQDLLSKAEDEFGFDHPMGGLTIPCAEETFLHVTSSLSRF

SEQ ID NO: 1893 - DNA, 510 bp, Populus balsamifera subsp. trichocarpa
  misc_feature (1)..(510): useful for making plants with increased cold tolerance as described in USSN 12/514,991
  misc_feature (1)..(510): Ceres ANNOT ID no.1480942
atggattccaagaagtctaacaagattagagacattgttaggcttcaacagatcctgaagaagtggaggaagcttgcaagttcatcaagaaccactgcagcttctaccaccaccagcagtaagagcatgaagtttctcaagagaacactctctataccagagaactctgccaaggaaacctccagcaatgccgtcccaaagggctacctggccgtcggcgttggagaagagcaaaagagattcataattccaacagagtatttgagccaccctgcattcctcatcttattgagagaagcagaagaggaatttgggtttcaacaggcaggtgtcttaaggattccttgtgaagtcgccgtctttgagagtatcctgaaactggtggaggaaaagaaagacctgttcttcatgcaagaatgcaggcttgacgttgataatatcgcggtgtattgctcatcgaaaagccagcaaactccatctcaccatcctcaaagtccaatgtgcagatag

SEQ ID NO: 1894 - protein, 169 aa, Populus balsamifera subsp. trichocarpa
  misc_feature (1)..(169): useful for making plants with increased cold tolerance as described in USSN 12/514,991
  misc_feature (1)..(169): Ceres ANNOT ID no.1480942
  misc_feature (1)..(169): Score of 156.5 for HMM of FIGURE 1 of USSN 12/514,991.
  misc_feature (33)..(129): Pfam Name: Auxin_inducible Pfam Description: Auxin responsive protein
  misc_feature (1)..(169): Functional Homolog Of Ceres SEEDLINE ID no. ME12469
MDSKKSNKIRDIVRLQQILKKWRKLASSSRTTAASTTTSSKSMKFLKRTLSIPENSAKETSSNAVPKGYLAVGVGEEQKRFIIPTEYLSHPAFLILLREAEEEFGFQQAGVLRIPCEVAVFESILKLVEEKKDLFFMQECRLDVDNIAVYCSSKSQQTPSHHPQSPMCR

SEQ ID NO: 1895 - DNA, 522 bp, Glycine max
  misc_feature (1)..(522): useful for making plants with increased cold tolerance as described in USSN 12/514,991
  misc_feature (1)..(522): Ceres CLONE ID no.650094
aacaaaaatcatttacatcctaaagaatttggagctcaaaaacttccatcttctttacaagtcttatttgacactctcttcataagtttgaacacatacaacaatgggttttcgcttacctggaatcaggaagacatcgttttctgcaaacaaatttgcatcttcaaaagtcatggatgtgccgaagggctaccttgcagtctatgttggagagaaaatgaggcggtttgtgattccagtatcatacttgaaccaaccattattccaggacttgttaagtcaagctgaggaagattttggatatcatcatccaatgggcggcctcacaattccttgcagtgaagatgtattccaacatataacttcttgcttgaattgacaacaaagctcacactaggagactgacatagattaattaagacattttgtacacaatagggtgttgtcaacttgtaaagatattcctttctcgagaaagagggaaaagaaacattatagaatgacaaaagttacagtatttcc

SEQ ID NO: 1896 - protein, 91 aa, Glycine max
  misc_feature (1)..(91): useful for making plants with increased cold tolerance as described in USSN 12/514,991
  misc_feature (1)..(91): Ceres CLONE ID no.650094
  misc_feature (1)..(91): Score of 129.4 for HMM of FIGURE 1 of USSN 12/514,991.
  misc_feature (1)..(91): Pfam Name: Auxin_inducible Pfam Description: Auxin responsive protein
  misc_feature (1)..(91): Functional Homolog Of Ceres SEEDLINE ID no. ME12469
MGFRLPGIRKTSFSANKFASSKVMDVPKGYLAVYVGEKMRRFVIPVSYLNQPLFQDLLSQAEEDFGYHHPMGGLTIPCSEDVFQHITSCLN

SEQ ID NO: 1897 - DNA, 563 bp, Glycine max
  misc_feature (1)..(563): useful for making plants with increased cold tolerance as described in USSN 12/514,991
  misc_feature (1)..(563): Ceres CLONE ID no.599091
atgtctcttaaaatttggtttcctcattatcttgaaaattataaatacacttcctcttgccttcacaaacaacacaaatcactggcatcatcaagcatcaatatttagattcattcttcttagatctgagatttttgccttgttcttgttcctacaaataagcacacaaaatgggtttccgtttacctgctattcgacgggcatcattcaacgctaaccaatcagcatcgaaatcagctgaacttccaaagggctatttggcggtgtatgttggagacaaacagaaacggtttgtgattcccatatcatacttgaaccaaccttcatttcaagacttattgagtcaagctgagaaagagtatggatatgatcatcccatgggtggcctcacaattccttgtagtgaagatgtcttccaacatataacttcccgcttgaatggacaataaatctcacactttaggagactgacatagattaggagagacattttgtactgtaggcatcttctttaacttgtaacatgttaccaatttctgagtaatgccaacgaattcaattgc

SEQ ID NO: 1898 - protein, 92 aa, Glycine max
  misc_feature (1)..(92): useful for making plants with increased cold tolerance as described in USSN 12/514,991
  misc_feature (1)..(92): Ceres CLONE ID no.599091
  misc_feature (1)..(92): Score of 122 for HMM of FIGURE 1 of USSN 12/514,991.
  misc_feature (1)..(90): Pfam Name: Auxin_inducible Pfam Description: Auxin responsive protein
  misc_feature (1)..(92): Functional Homolog Of Ceres SEEDLINE ID no. ME12469
MGFRLPAIRRASFNANQSASKSAELPKGYLAVYVGDKQKRFVIPISYLNQPSFQDLLSQAEKEYGYDHPMGGLTIPCSEDVFQHITSRLNGQ

SEQ ID NO: 1899 - DNA, 483 bp, Populus balsamifera subsp. trichocarpa
  misc_feature (1)..(483): useful for making plants with increased cold tolerance as described in USSN 12/514,991
  misc_feature (1)..(483): Ceres ANNOT ID no.1484804
atggatgacaatagtagcagcaagttgactggaattcggcagattgttaggctaaaggaaattctccataagtggcaatctgtaacaattggctcaaaggaaaccagccctccctctggtcatccctccaatggcattccaccagctgttaataagaggctgaacagtgttaagtgttgcgattcagacgaggacagttgccacagcccagaaccgccagctgacgtacccaaagggtatctggcggtttacgttggaccagagcttcggaggtttatcatcccgactagctaccttagccactccctgttcaaggttttgctggaaaaggttgaagaggagtttgggtttgatcatactggtgcgcttacaatcccatgtgagattgagaccttcaaatttctcctaaagtgcatggagagccatccaaaagaccacgatgatgaagggtcagctgaaggtgctttagctattgaagagtaa

SEQ ID NO: 1900 - protein, 160 aa, Populus balsamifera subsp. trichocarpa
  misc_feature (1)..(160): useful for making plants with increased cold tolerance as described in USSN 12/514,991
  misc_feature (1)..(160): Ceres ANNOT ID no.1484804
  misc_feature (1)..(160): Score of 131.5 for HMM of FIGURE 1 of USSN 12/514,991.
  misc_feature (74)..(140): Pfam Name: Auxin_inducible Pfam Description: Auxin responsive protein
  misc_feature (1)..(160): Functional Homolog Of Ceres SEEDLINE ID no. ME12469
MDDNSSSKLTGIRQIVRLKEILHKWQSVTIGSKETSPPSGHPSNGIPPAVNKRLNSVKCCDSDEDSCHSPEPPADVPKGYLAVYVGPELRRFIIPTSYLSHSLFKVLLEKVEEEFGFDHTGALTIPCEIETFKFLLKCMESHPKDHDDEGSAEGALAIEE

SEQ ID NO: 1901 - DNA, 455 bp, Glycine max
  misc_feature (1)..(455): useful for making plants with increased cold tolerance as described in USSN 12/514,991
  misc_feature (1)..(455): Ceres CLONE ID no.589828
aaaatcattcacatccaaaagcattcaaaatccagaagcatattttcaaggacttttctcaaaccattatcttcgcaagtctctaagacagccattacagcaatgggtttccgtttacctggtatcagaaagggaatatttgcagccaaccaagcatcatcaaaaacggtggatgcaccaaagggctaccttgcagtttatgttggagagaaaatgaagcgatttgtgatccctgtgtcatacttgaaccaaccttcatttcaagacttgttgagtcgagctgaggaagagtttggatatgatcatcccatgggcggcctcacaattccttgcagcgaagatgtcttccaacatataacttcttgtttgaatggacaataaatctcacactttaggagactgacatagattagtagtgacattttgtacaataggcatcttctcaatttgtaaag

SEQ ID NO: 1902 - protein, 126 aa, Glycine max
  misc_feature (1)..(126): useful for making plants with increased cold tolerance as described in USSN 12/514,991
  misc_feature (1)..(126): Ceres CLONE ID no.589828
  misc_feature (1)..(126): Score of 126.5 for HMM of FIGURE 1 of USSN 12/514,991.
  misc_feature (35)..(124): Pfam Name: Auxin_inducible Pfam Description: Auxin responsive protein
  misc_feature (1)..(126): Functional Homolog Of Ceres SEEDLINE ID no. ME12469
KIIHIQKHSKSRSIFSRTFLKPLSSQVSKTAITAMGFRLPGIRKGIFAANQASSKTVDAPKGYLAVYVGEKMKRFVIPVSYLNQPSFQDLLSRAEEEFGYDHPMGGLTIPCSEDVFQHITSCLNGQ

SEQ ID NO: 1903 - DNA, 492 bp, Populus balsamifera subsp. trichocarpa
  misc_feature (1)..(492): useful for making plants with increased cold tolerance as described in USSN 12/514,991
  misc_feature (1)..(492): Ceres ANNOT ID no.1477016
atggatgactatagtggcagcaagttgactggaattcgccagattgttaggctaaaggaaattctccaaaagtggcaatctttaacggtcggctcaaaagaaaccagcctacccagccctccctcggatcaatccccctgtggcattccaccagcaataaataagaggctgaacagtgttacgtgttgtgattctgatgaggagagttgccacagtccagaaccgccagctgatgtacccaaagggtatctggcggtttatgttggaccagagcttcggaggtttatcatcccaactagctaccttagccactccctgttcaaggttttgctggtaaaggttgaagaggagtttgggtttgatcatactggtgcgcttactatcccttgtgaaattgagacctttaagtttctcctacagtgcatggagaaccgtccaaatgaccatgaagatgaaggccctgctgaagatgcttttactgttgaagagtaa

SEQ ID NO: 1904 - protein, 163 aa, Populus balsamifera subsp. trichocarpa
  misc_feature (1)..(163): useful for making plants with increased cold tolerance as described in USSN 12/514,991
  misc_feature (1)..(163): Ceres ANNOT ID no.1477016
  misc_feature (1)..(163): Score of 136.4 for HMM of FIGURE 1 of USSN 12/514,991.
  misc_feature (77)..(143): Pfam Name: Auxin_inducible Pfam Description: Auxin responsive protein
  misc_feature (1)..(163): Functional Homolog Of Ceres SEEDLINE ID no. ME12469
MDDYSGSKLTGIRQIVRLKEILQKWQSLTVGSKETSLPSPPSDQSPCGIPPAINKRLNSVTCCDSDEESCHSPEPPADVPKGYLAVYVGPELRRFIIPTSYLSHSLFKVLLVKVEEEFGFDHTGALTIPCEIETFKFLLQCMENRPNDHEDEGPAEDAFTVEE

SEQ ID NO: 1905 - DNA, 300 bp, Populus balsamifera subsp. trichocarpa
  misc_feature (1)..(300): useful for making plants with increased cold tolerance as described in USSN 12/514,991
  misc_feature (1)..(300): Ceres ANNOT ID no.1450467
atggccagacattttcatgctattcttgccaaacaaattctatgccgatctgtgtggattacaaataaatcagcttcaagatcttcagatgtaccaaaaggtttcttagctgtatacgttggcgaaatggataagaaacgatttgtagttccagtatcctatctgaatgagccttcatttcaagatttgctaagtaaagctgaagaggagttcggttttaatcatccaatgggtggtttgacaattccctgcagagaagatactttcattgacattctttctagcttgagtagatcataa

SEQ ID NO: 1906 - protein, 99 aa, Populus balsamifera subsp. trichocarpa
  misc_feature (1)..(99): useful for making plants with increased cold tolerance as described in USSN 12/514,991
  misc_feature (1)..(99): Ceres ANNOT ID no.1450467
  misc_feature (1)..(99): Score of 135 for HMM of FIGURE 1 of USSN 12/514,991.
  misc_feature (1)..(97): Pfam Name: Auxin_inducible Pfam Description: Auxin responsive protein
  misc_feature (1)..(99): Functional Homolog Of Ceres SEEDLINE ID no. ME12469
MARHFHAILAKQILCRSVWITNKSASRSSDVPKGFLAVYVGEMDKKRFVVPVSYLNEPSFQDLLSKAEEEFGFNHPMGGLTIPCREDTFIDILSSLSRS

SEQ ID NO: 1907 - protein, 107 aa, Arabidopsis thaliana
  misc_feature (1)..(107): useful for making plants with increased cold tolerance as described in USSN 12/514,991
  misc_feature (1)..(107): Ceres SEEDLINE ID no.ME13131
  misc_feature (6)..(107): Pfam Name: Auxin_inducible Pfam Description: Auxin responsive protein
  misc_feature (1)..(107): Score of 188.8 for HMM of FIGURE 1 of USSN 12/514,991.
  misc_feature (1)..(107): Functional Homolog Of Ceres SEEDLINE ID no. ME12469
MAIMKKTSKLTQTAMLKQILKRCSSLGKKNGGGYDEDCLPLDVPKGHFPVYVGENRSRYIVPISFLTHPEFQSLLQRAEEEFGFDHDMGLTIPCDELVFQTLTSMIR

SEQ ID NO: 1908 - protein, 122 aa, Arabidopsis thaliana
  misc_feature (1)..(122): useful for making plants with increased cold tolerance as described in USSN 12/514,991
  misc_feature (1)..(122): Ceres SEEDLINE ID no.ME06393
  misc_feature (1)..(94): Pfam Name: Auxin_inducible Pfam Description: Auxin responsive protein
  misc_feature (1)..(122): Score of 131 for HMM of FIGURE 1 of USSN 12/514,991.
  misc_feature (1)..(122): Functional Homolog Of Ceres SEEDLINE ID no. ME12469
MGNGDKVMSHWSFHIPRLHHHEHDHEKVPKGCLAVKVGQGEEQERFVIPVMYFNHPLFGQLLKEAEEEFGFAQKGTITIPCHVEEFRYVQGLIDRENTRFLGNNLLDHHHHHHNHLIRCFRV

SEQ ID NO: 1909 - protein, 112 aa, Arabidopsis thaliana
  misc_feature (1)..(112): useful for making plants with increased cold tolerance as described in USSN 12/514,991
  misc_feature (1)..(112): Ceres SEEDLINE ID no.ME25218
  misc_feature (7)..(112): Pfam Name: Auxin_inducible Pfam Description: Auxin responsive protein
  misc_feature (1)..(112): Score of 152.7 for HMM of FIGURE 1 of USSN 12/514,991.
  misc_feature (1)..(112): Functional Homolog Of Ceres SEEDLINE ID no. ME12469
MAIKRSSKATSSQAASIKQIVKRCSSLRKMKNVNGCYYNQEDDLPQDVPKGHFPVYVGPNRSRYIVPISWLHHSEFQTLLRLAEEEFGFDHDMGLTIPCDEVFFRSLISMFR

SEQ ID NO: 1910 - protein, 98 aa, Arabidopsis thaliana
  misc_feature (1)..(98): useful for making plants with increased cold tolerance as described in USSN 12/514,991
  misc_feature (1)..(98): Ceres SEEDLINE ID no.ME25233
  misc_feature (1)..(95): Pfam Name: Auxin_inducible Pfam Description: Auxin responsive protein
  misc_feature (1)..(98): Score of 131.8 for HMM of FIGURE 1 of USSN 12/514,991.
  misc_feature (1)..(98): Functional Homolog Of Ceres SEEDLINE ID no. ME12469
MAIRISRVLQSSKQLLKSLSHSSNNVAIPKGHLAVYVGEMMQKRRFVVPVTYLSHPCFQKLLRKAEEEFGFDHPMGGLTIPCTEQIFIDLASRLSTSS

SEQ ID NO: 1911 - protein, 153 aa, Arabidopsis thaliana
  misc_feature (1)..(153): useful for making plants with increased cold tolerance as described in USSN 12/514,991
  misc_feature (1)..(153): Ceres SEEDLINE ID no.ME25267
  misc_feature (7)..(105): Pfam Name: Auxin_inducible Pfam Description: Auxin responsive protein
  misc_feature (1)..(153): Score of 218 for HMM of FIGURE 1 of USSN 12/514,991.
  misc_feature (1)..(153): Functional Homolog Of Ceres SEEDLINE ID no. ME12469
MAGSLVKCSKIRHIVRLRQMLRRWRNKARLSSVSRCVPSDVPSGHVAVCVGSGCRRFVVRASYLNHPIISNLLVQAEEEFGFANQGPLVIPCEESVFEEAIRFISRSDSSRSSRFTCPDDLQKCNGGIKIKSKLDLMIESRPLLHGVAEKAIW

SEQ ID NO: 1912 - protein, 189 aa, Arabidopsis thaliana
  misc_feature (1)..(189): useful for making plants with increased cold tolerance as described in USSN 12/514,991
  misc_feature (1)..(189): Ceres SEEDLINE ID no.ME14834
  misc_feature (37)..(144): Pfam Name: Auxin_inducible Pfam Description: Auxin responsive protein
  misc_feature (1)..(189): Score of 177.4 for HMM of FIGURE 1 of USSN 12/514,991.
  misc_feature (1)..(189): Functional Homolog Of Ceres SEEDLINE ID no. ME12469
MEAKKSNKIREIVKLQQILKKWRKVAHASKQANNNKIDNVDDSNNNISININNNGSGSGSGSKSIKFLKRTLSFTDTTAIPKGYLAVSVGKEEKRYKIPTEYLSHQAFHVLLREAEEEFGFEQAGILRIPCEVAVFESILKIMEDNKSDAYLTTQECRFNATSEEVMSYRHPSDCPRTPSHQPHSPMCR

SEQ ID NO: 1913 - protein, 160 aa, Arabidopsis thaliana
  misc_feature (1)..(160): useful for making plants with increased cold tolerance as described in USSN 12/514,991
  misc_feature (1)..(160): Ceres SEEDLINE ID no.ME09103
  misc_feature (78)..(143): Pfam Name: Auxin_inducible Pfam Description: Auxin responsive protein
  misc_feature (1)..(160): Score of 132 for HMM of FIGURE 1 of USSN 12/514,991.
  misc_feature (1)..(160): Functional Homolog Of Ceres SEEDLINE ID no. ME12469
MDENNAAKLTGIKQIVRLKEILQKWQTVTIGSKSDDGELGARKHTAIISPVINKRLLDLKTCDSDEETTCQSPEPPPDVPKGYLAVYVGPELRRFIIPTNFLSHSLFKVLLEKAEEEYGFDHSGALTIPCEVETFKYLLKCIENHPKDDTSAEDPVETEE

SEQ ID NO: 1914 - protein, 165 aa, Arabidopsis thaliana
  misc_feature (1)..(165): useful for making plants with increased cold tolerance as described in USSN 12/514,991
  misc_feature (1)..(165): Ceres SEEDLINE ID no.ME17021
  misc_feature (39)..(143): Pfam Name: Auxin_inducible Pfam Description: Auxin responsive protein
  misc_feature (1)..(165): Score of 130.8 for HMM of FIGURE 1 of USSN 12/514,991.
  misc_feature (1)..(165): Functional Homolog Of Ceres SEEDLINE ID no. ME12469
MDENNAAKLTGIRQIVRLKEILQKWQTVTIGPKSEVPPLAAGKQAVAMISPAINKRLLDVKNGDSDEETCQSPEPPHDVPKGNLAVYVGPELRRFIIPTSYLSHSLFKVLLEKAEEEFGFDQSGALTIPCEVETFKYLLKCMENNLKDLHPDDNSDGEAVAAKEE

SEQ ID NO: 1915 - DNA, 327 bp, Arabidopsis thaliana
  misc_feature (1)..(327): useful for making plants with increased cold tolerance as described in USSN 12/514,991
  misc_feature (1)..(327): Ceres CDNA ID no. 23531653
  misc_feature (1)..(327): Also Known As Ceres ME LINE ME12469
  misc_feature (1)..(327): Encodes the peptide sequence given in  SEQ ID NO. 80
atgggtttaatgaggtcgatgcttccaaatgcaaagcaaatcttcaaatcacaatctatgaggaacaagaacggatcatcctcaccatcaacaacaacaacaacttcagggcttgttccgaaaggtcacgtagcggtttacgttggagaacaaatggagaagaagaggtttgtggttccaatatcatacttgaaccatcctttgttcagagaatttcttaatcgcgctgaggaagaatgcggatttcatcactctatgggtggcttgacgataccttgtcgagaagagtcgtttctttatctcattacttctcatcagttgcattga

SEQ ID NO: 1916 - protein, 108 aa, Arabidopsis thaliana
  misc_feature (1)..(108): useful for making plants with increased cold tolerance as described in USSN 12/514,991
  misc_feature (1)..(108): Ceres CDNA ID no. 23531653
  misc_feature (1)..(108): Also Known As Ceres ME LINE ME12469
  misc_feature (1)..(106): Pfam Name: Auxin_inducible Pfam Description: Auxin responsive protein
  misc_feature (1)..(108): Score of 168.1 for HMM of FIGURE 1 of USSN 12/514,991.
MGLMRSMLPNAKQIFKSQSMRNKNGSSSPSTTTTTSGLVPKGHVAVYVGEQMEKKRFVVPISYLNHPLFREFLNRAEEECGFHHSMGGLTIPCREESFLYLITSHQLH

SEQ ID NO: 1917 - protein, 92 aa, Brassica napus
  misc_feature (1)..(92): useful for making plants with increased cold tolerance as described in USSN 12/514,991
  misc_feature (1)..(92): Ceres CLONE ID no. 1085198
  misc_feature (1)..(81): Pfam Name: Auxin_inducible Pfam Description: Auxin responsive protein
  misc_feature (1)..(92): Score of 111 for HMM of FIGURE 1 of USSN 12/514,991.
  misc_feature (1)..(92): Functional Homolog Of Ceres SEEDLINE ID no. ME12469
  misc_feature (32)..(32): Xaa is any aa, unknown or other
  misc_feature (33)..(33): Xaa is any aa, unknown or other
  misc_feature (62)..(62): Xaa is any aa, unknown or other
  misc_feature (77)..(77): Xaa is any aa, unknown or other
  misc_feature (79)..(79): Xaa is any aa, unknown or other
MAIRLSRVINSKQSQKQQPRVPKGHVAVYVGXXMENKKRFVVPISYLNHPSFQGLLSRAEEXFGFNHPIGGLTIPCXEXIFVGLLNSYGCIL

SEQ ID NO: 1918 - protein, 92 aa, Vigna radiata
  misc_feature (1)..(92): useful for making plants with increased cold tolerance as described in USSN 12/514,991
  misc_feature (1)..(92): Public GI no. 287570
  misc_feature (1)..(92): Functional Homolog Of Ceres SEEDLINE ID no. ME12469
  misc_feature (1)..(90): Pfam Name: Auxin_inducible Pfam Description: Auxin responsive protein
  misc_feature (1)..(92): Score of 130.2 for HMM of FIGURE 1 of USSN 12/514,991.
MGFRLPGIRKTLSARNEASSKVLDAPKGYLAVYVGENMKRFVIPVSHLNQPLFQDLLSQAEEEFGYDHPMGGLTIPCSEDLFQHITSCLSAQ

SEQ ID NO: 1919 - protein, 85 aa, Capsicum annuum
  misc_feature (1)..(85): useful for making plants with increased cold tolerance as described in USSN 12/514,991
  misc_feature (1)..(85): Public GI no. 20149046
  misc_feature (10)..(84): Pfam Name: Auxin_inducible Pfam Description: Auxin responsive protein
  misc_feature (1)..(85): Score of 116.5 for HMM of FIGURE 1 of USSN 12/514,991.
  misc_feature (1)..(85): Functional Homolog Of Ceres SEEDLINE ID no. ME12469
MAIRVPRIIKKSSTSLDVPKGHFAVYVGEKQKNRFVIPISYLSQPSFQDLLSRAEEEFGFDHPMGGVTIPCSEDIFIGITSKFRI

SEQ ID NO: 1920 - DNA, 276 bp, Populus balsamifera subsp. trichocarpa
  misc_feature (1)..(276): useful for making plants with increased cold tolerance as described in USSN 12/514,991
  misc_feature (1)..(276): Ceres ANNOT ID no.1503532
  misc_feature (1)..(276): Encodes the peptide sequence given in  SEQ ID NO. 85
atgattcacaatgtcaagcatataatcaaaggcaaatctcttcactgtagaaatcaaccagatgtaccaaaaggacatgtagcgatatatgttggagaaatgcaaaggaagaggtttgtggtaccaatatcgtacttgagccatccttcatttcaagacttgcttaatcgagccgaggaagagtttggcttcaatcctccaatgggttgtcttacaattccttgcagagaagaagccttcattaatcttgcctctacattgcaggcctcatcatga

SEQ ID NO: 1921 - protein, 91 aa, Populus balsamifera subsp. trichocarpa
  misc_feature (1)..(91): useful for making plants with increased cold tolerance as described in USSN 12/514,991
  misc_feature (1)..(91): Ceres ANNOT ID no.1503532
  misc_feature (1)..(88): Pfam Name: Auxin_inducible Pfam Description: Auxin responsive protein
  misc_feature (1)..(91): Score of 109.6 for HMM of FIGURE 1 of USSN 12/514,991.
  misc_feature (1)..(91): Functional Homolog Of Ceres SEEDLINE ID no. ME12469
MIHNVKHIIKGKSLHCRNQPDVPKGHVAIYVGEMQRKRFVVPISYLSHPSFQDLLNRAEEEFGFNPPMGCLTIPCREEAFINLASTLQASS

SEQ ID NO: 1922 - DNA, 297 bp, Populus balsamifera subsp. trichocarpa
  misc_feature (1)..(297): useful for making plants with increased cold tolerance as described in USSN 12/514,991
  misc_feature (1)..(297): Ceres ANNOT ID no.1450478
  misc_feature (1)..(297): Encodes the peptide sequence given in  SEQ ID NO. 87
atgggcattcgtttaccatccatgattcacaatgtcaagcatataatcaaaggcaaatctcttcactgtagaaatcaaccagatgtaccaaaaggacatgtagcgatatatgttggagaaatgcaaaggaagaggtttgtggtaccaatatcgtacttgagccatccttcatttcaagacttgcttaatcgagccgaggaagagtttggcttcaatcctccaatgggttgtcttacaattccttgcagagaagaagccttcattaatcttgcctctacattgcaggcctcatcatga

SEQ ID NO: 1923 - protein, 98 aa, Populus balsamifera subsp. trichocarpa
  misc_feature (1)..(98): useful for making plants with increased cold tolerance as described in USSN 12/514,991
  misc_feature (1)..(98): Ceres ANNOT ID no.1450478
  misc_feature (1)..(95): Pfam Name: Auxin_inducible Pfam Description: Auxin responsive protein
  misc_feature (1)..(98): Score of 114.3 for HMM of FIGURE 1 of USSN 12/514,991.
  misc_feature (1)..(98): Functional Homolog Of Ceres SEEDLINE ID no. ME12469
MGIRLPSMIHNVKHIIKGKSLHCRNQPDVPKGHVAIYVGEMQRKRFVVPISYLSHPSFQDLLNRAEEEFGFNPPMGCLTIPCREEAFINLASTLQASS

SEQ ID NO: 1924 - protein, 99 aa, Triticum aestivum
  misc_feature (1)..(99): useful for making plants with increased cold tolerance as described in USSN 12/514,991
  misc_feature (1)..(99): Ceres CLONE ID no. 557191
  misc_feature (21)..(89): Pfam Name: Auxin_inducible Pfam Description: Auxin responsive protein
  misc_feature (1)..(99): Score of 108.1 for HMM of FIGURE 1 of USSN 12/514,991.
  misc_feature (1)..(99): Functional Homolog Of Ceres SEEDLINE ID no. ME12469
MAGKLYQLMARLHLAKGRASADVPKGHFAVYVGEQRKRFVIPTAYLRHPSFLVLLKRVEDEFGFDHRTGGGLTIPCSEGDFADIVGGCSSSSSPAVDYH

SEQ ID NO: 1925 - DNA, 297 bp, Populus balsamifera subsp. trichocarpa; identical to SEQ ID NO: 1843
  misc_feature (1)..(297): useful for making plants with increased cold tolerance as described in USSN 12/514,991
  misc_feature (1)..(297): Ceres ANNOT ID no.1460705
  misc_feature (1)..(297): Encodes the peptide sequence given in  SEQ ID NO. 8

SEQ ID NO: 1926 - DNA, 300 bp, Populus balsamifera subsp. trichocarpa
  misc_feature (1)..(300): useful for making plants with increased cold tolerance as described in USSN 12/514,991
  misc_feature (1)..(300): Ceres ANNOT ID no.1460715
atggctattcgtttgcttggttttctggctaaacaaagcctccgtcggcctgtttcatgcgcccataaagcagcttcaaagtcttcagatgttccaaaaggtttcctagcagtttacgttggggaaactgagaagaagcgatttgtggttccagtatcatatttgaaccaggcttcatttcaagatttgctaagtaaagctgaagaggagtttggttttgatcatccaatgggtggattgactattccctgtgcggaagatactttccttgatgtaacttctagcttgagtagattataa

SEQ ID NO: 1927 - protein, 98 aa, Triticum aestivum
  misc_feature (1)..(98): useful for making plants with increased cold tolerance as described in USSN 12/514,991
  misc_feature (1)..(98): Ceres CLONE ID no. 1052127
  misc_feature (21)..(89): Pfam Name: Auxin_inducible Pfam Description: Auxin responsive protein
  misc_feature (1)..(98): Score of 105.9 for HMM of FIGURE 1 of USSN 12/514,991.
  misc_feature (1)..(98): Functional Homolog Of Ceres SEEDLINE ID no. ME12469
MAGKLYQLMARLHLAKGRASADVPKGHFAVYVGKQRKRFVIPTAYLRHPSFLVLLKRVEDEFGFDHRAGGGLTIPCSEGDFADIVGGCSSSSPPVDYH

SEQ ID NO: 1928 - protein, 99 aa, Malus x domestica
  misc_feature (1)..(99): useful for making plants with increased cold tolerance as described in USSN 12/514,991
  misc_feature (1)..(99): Public GI no. 2924327
  misc_feature (1)..(98): Pfam Name: Auxin_inducible Pfam Description: Auxin responsive protein
  misc_feature (1)..(99): Score of 122.6 for HMM of FIGURE 1 of USSN 12/514,991.
  misc_feature (1)..(99): Functional Homolog Of Ceres SEEDLINE ID no. ME12469
MGFRLPGIVSAKRSLIRSLSNSKQTASKTLDIPKGYFAVYAGERQKKRFVIPISYLNDPLFQDLLSQAEEEFGYDHPMGGITIPCSEYTFLHLTSRLSV

SEQ ID NO: 1929 - protein, 98 aa, Glycine max
  misc_feature (1)..(98): useful for making plants with increased cold tolerance as described in USSN 12/514,991
  misc_feature (1)..(98): Ceres CLONE ID no. 566016
  misc_feature (12)..(95): Pfam Name: Auxin_inducible Pfam Description: Auxin responsive protein
  misc_feature (1)..(98): Score of 113.9 for HMM of FIGURE 1 of USSN 12/514,991.
  misc_feature (1)..(98): Functional Homolog Of Ceres SEEDLINE ID no. ME12469
MMGILRLPFMVHANAKQTSSSSFKSNVPKGHVAVYVVGELQKNKRFVVPISYLNHPLFLDLLNRAEEEFGFNHPLGGLTIPCKEDAFINLTSQLVKTI

SEQ ID NO: 1930 - protein, 95 aa, Raphanus sativus
  misc_feature (1)..(95): useful for making plants with increased cold tolerance as described in USSN 12/514,991
  misc_feature (1)..(95): Public GI no. 3043536
  misc_feature (31)..(95): Pfam Name: Auxin_inducible Pfam Description: Auxin responsive protein
  misc_feature (1)..(95): Score of 120.5 for HMM of FIGURE 1 of USSN 12/514,991.
  misc_feature (1)..(95): Functional Homolog Of Ceres SEEDLINE ID no. ME12469
MALVRSLLGAKKILGQATASTSKRATMAAPPKGFLAVYVGESQKKRYVVPISYLSQPSFQALLSKSEEEFGFDHPMGGLTIPCPEDTFINVTSRL

SEQ ID NO: 1931 - protein, 92 aa, Medicago truncatula
  misc_feature (1)..(92): useful for making plants with increased cold tolerance as described in USSN 12/514,991
  misc_feature (1)..(92): Public GI no. 92889203
  misc_feature (1)..(90): Pfam Name: Auxin_inducible Pfam Description: Auxin responsive protein
  misc_feature (1)..(92): Score of 121.2 for HMM of FIGURE 1 of USSN 12/514,991.
  misc_feature (1)..(92): Functional Homolog Of Ceres SEEDLINE ID no. ME12469
MGFRLPGIRRSSFSASQSSSKQVEVPKGHLAVYVGEKMRRFMIPISFLNEPLFQELLSQAEEEFGYCHPMGGLTIPCKEDMFLHTASVLNRI

SEQ ID NO: 1932 - protein, 99 aa, Medicago truncatula
  misc_feature (1)..(99): useful for making plants with increased cold tolerance as described in USSN 12/514,991
  misc_feature (1)..(99): Public GI no. 92889205
  misc_feature (1)..(99): Functional Homolog Of Ceres SEEDLINE ID no. ME12469
  misc_feature (1)..(80): Pfam Name: Auxin_inducible Pfam Description: Auxin responsive protein
  misc_feature (1)..(99): Score of 113.8 for HMM of FIGURE 1 of USSN 12/514,991.
MGFRLPAIRRSSFSASQSSNKQVEVPKGHLAVYVGEKMRRFMIPISFLNEPLFQELLSQAEEEFGYCHPMGGLTIPCKEDNVVKITITRTFRALQMDLS

SEQ ID NO: 1933 - protein, 109 aa, Oryza sativa subsp. japonica
  misc_feature (1)..(109): useful for making plants with increased cold tolerance as described in USSN 12/514,991
  misc_feature (1)..(109): Public GI no. 50940561
  misc_feature (1)..(87): Pfam Name: Auxin_inducible Pfam Description: Auxin responsive protein
  misc_feature (1)..(109): Score of 92 for HMM of FIGURE 1 of USSN 12/514,991.
  misc_feature (1)..(109): Functional Homolog Of Ceres SEEDLINE ID no. ME12469
MAGKLYQLMSRMHLARSRSSSSSAATAAAAAADVPRGHFAVYVGERRKRFVIPTAYLKHPSFVLLLKRVEEEFGFDCHRCGGLTIPCATEGDFASFVAEAIASDDHHHH

SEQ ID NO: 1934 - DNA, 315 bp, Arabidopsis thaliana
  misc_feature (1)..(315): useful for making plants with increased cold tolerance as described in USSN 12/514,991
  misc_feature (1)..(315): Ceres CDNA ID no. 23507179
  misc_feature (1)..(315): Also Known As Ceres ME LINE ME10609
atgggtatccaattgatcggactctctcaggcaaagcaaaagcttcaaagaagcttatcagcgagaatcgcaagcctcttggctacgtcgggtactaataatgtcccaaagggtcatgtggccgtctatgtgggagagacttatcacaggaagagatttgtgatacctatatcgtatttaaaccacccattgttccaaggtttgttgaacctcgcggaagaagagttcgggttcgaccatcccatgggaggtctcaccatcccttgcactgaagattacttcaccgctctagcttctattctaagtggttcatga

SEQ ID NO: 1935 - protein, 104 aa, Arabidopsis thaliana
  misc_feature (1)..(104): useful for making plants with increased cold tolerance as described in USSN 12/514,991
  misc_feature (1)..(104): Ceres CDNA ID no. 23507179
  misc_feature (1)..(104): Also Known As Ceres ME LINE ME10609
  misc_feature (1)..(102): Pfam Name: Auxin_inducible Pfam Description: Auxin responsive protein
  misc_feature (1)..(104): Score of 163 for HMM of FIGURE 1 of USSN 12/514,991.
  misc_feature (1)..(104): Functional Homolog Of Ceres SEEDLINE ID no. ME12469
MGIQLIGLSQAKQKLQRSLSARIASLLATSGTNNVPKGHVAVYVGETYHRKRFVIPISYLNHPLFQGLLNLAEEEFGFDHPMGGLTIPCTEDYFTALASILSGS

SEQ ID NO: 1936 - DNA, 306 bp, Populus balsamifera subsp. trichocarpa
  misc_feature (1)..(306): useful for making plants with increased cold tolerance as described in USSN 12/514,991
  misc_feature (1)..(306): Ceres ANNOT ID no.1450474
  misc_feature (1)..(306): Encodes the peptide sequence given in  SEQ ID NO. 101
atgggaattcaattgatggggattactcatgccaaacaaaaactccaaagaagtctttcagcaaaaatcgctggggttttggccacttctaatgttccaagaggccacattgctgtctatgttggagaaggctacagaaagagatgtgttattccaatagcatacttgaaccatcctttattccaaggcttgctaaatcgagctgaggaggaatttggattcgatcatccaatgggtggtctcacaataccttgcagtgaagagtgcttcgctagcctcacttcgtttctaagtagcacttcataa

SEQ ID NO: 1937 - protein, 101 aa, Populus balsamifera subsp. trichocarpa
  misc_feature (1)..(101): useful for making plants with increased cold tolerance as described in USSN 12/514,991
  misc_feature (1)..(101): Ceres ANNOT ID no.1450474
  misc_feature (1)..(101): Also Known As Ceres ME LINE ME25691
  misc_feature (1)..(98): Pfam Name: Auxin_inducible Pfam Description: Auxin responsive protein
  misc_feature (1)..(101): Score of 161 for HMM of FIGURE 1 of USSN 12/514,991.
  misc_feature (1)..(101): Functional Homolog Of Ceres SEEDLINE ID no. ME12469
MGIQLMGITHAKQKLQRSLSAKIAGVLATSNVPRGHIAVYVGEGYRKRCVIPIAYLNHPLFQGLLNRAEEEFGFDHPMGGLTIPCSEECFASLTSFLSSTS

SEQ ID NO: 1938 - protein, 83 aa, Capsicum annuum
  misc_feature (1)..(83): useful for making plants with increased cold tolerance as described in USSN 12/514,991
  misc_feature (1)..(83): Public GI no. 20149044
  misc_feature (15)..(82): Pfam Name: Auxin_inducible Pfam Description: Auxin responsive protein
  misc_feature (1)..(83): Score of 121.1 for HMM of FIGURE 1 of USSN 12/514,991.
  misc_feature (1)..(83): Functional Homolog Of Ceres SEEDLINE ID no. ME12469
MAILRMIKKSSTTRDVPKGHFAVYVGETQKRRFVVPISFLSEPLFQDLLSQAEEEFGFDHPMGGVTIPCSEDLFTDLTFRLRK

SEQ ID NO: 1939 - protein, 92 aa, Medicago truncatula
  misc_feature (1)..(92): useful for making plants with increased cold tolerance as described in USSN 12/514,991
  misc_feature (1)..(92): Public GI no. 92870691
  misc_feature (1)..(90): Pfam Name: Auxin_inducible Pfam Description: Auxin responsive protein
  misc_feature (1)..(92): Score of 125.4 for HMM of FIGURE 1 of USSN 12/514,991.
  misc_feature (1)..(92): Functional Homolog Of Ceres SEEDLINE ID no. ME12469
MGFRVPSIIRKSSFSASRVISKVVDVPKGYLAVYVGKQKRFVIPISYLNQPSFQDLLSQAEEEFGYDHSMGGLTIPCTEDVFQHITSRLNGI

SEQ ID NO: 1940 - protein, 91 aa, Medicago truncatula
  misc_feature (1)..(91): useful for making plants with increased cold tolerance as described in USSN 12/514,991
  misc_feature (1)..(91): Public GI no. 92870689
  misc_feature (1)..(89): Pfam Name: Auxin_inducible Pfam Description: Auxin responsive protein
  misc_feature (1)..(91): Score of 119.4 for HMM of FIGURE 1 of USSN 12/514,991.
  misc_feature (1)..(91): Functional Homolog Of Ceres SEEDLINE ID no. ME12469
MGFRFSGIIRRASFSANRAVSKAVDMPKGYIAVYVGEKRFVIPISYLNQPLFQDLLSQAEEEFGYDHPMGGLTIPCTEDVFQHITSRSNGL

SEQ ID NO: 1941 - protein, 93 aa, Medicago truncatula
  misc_feature (1)..(93): useful for making plants with increased cold tolerance as described in USSN 12/514,991
  misc_feature (1)..(93): Public GI no. 92870696
  misc_feature (1)..(91): Pfam Name: Auxin_inducible Pfam Description: Auxin responsive protein
  misc_feature (1)..(93): Score of 118.9 for HMM of FIGURE 1 of USSN 12/514,991.
  misc_feature (1)..(93): Functional Homolog Of Ceres SEEDLINE ID no. ME12469
MGFRFAGIIRKASFSANRSASKAVDVPKGYLAVYVGEKQKRYVIPISYLNQPSFQDLLSQFEEEFGYDHPMGGLTIPCTEDVFQHMTSRLNGL

SEQ ID NO: 1942 - DNA, 279 bp, Populus balsamifera subsp. trichocarpa
  misc_feature (1)..(279): useful for making plants with increased cold tolerance as described in USSN 12/514,991
  misc_feature (1)..(279): Ceres ANNOT ID no.1450472
  misc_feature (1)..(279): Encodes the peptide sequence given in  SEQ ID NO. 107
atgggtatccgcttgcctggaattgtcaatgctaaacaaattctgaagcgaattctcttgtcagaggatacttctaatgtgcctaaaggccacttagcagtttatgttggagaagctcaaaaaaagcgatttaccgttccgatttcatatttgaagcatccttcattccagaacttgttaagtcaagctgaagaagagttcggatttgatcattctatgggtggtctcacaattccatgcagtgaagaagtcttcacaggtctcattttaagcatgtag

SEQ ID NO: 1943 - protein, 92 aa, Populus balsamifera subsp. trichocarpa
  misc_feature (1)..(92): useful for making plants with increased cold tolerance as described in USSN 12/514,991
  misc_feature (1)..(92): Ceres ANNOT ID no.1450472
  misc_feature (1)..(85): Pfam Name: Auxin_inducible Pfam Description: Auxin responsive protein
  misc_feature (1)..(92): Score of 129.6 for HMM of FIGURE 1 of USSN 12/514,991.
  misc_feature (1)..(92): Functional Homolog Of Ceres SEEDLINE ID no. ME12469
MGIRLPGIVNAKQILKRILLSEDTSNVPKGHLAVYVGEAQKKRFTVPISYLKHPSFQNLLSQAEEEFGFDHSMGGLTIPCSEEVFTGLILSM

SEQ ID NO: 1944 - DNA, 294 bp, Populus balsamifera subsp. trichocarpa
  misc_feature (1)..(294): useful for making plants with increased cold tolerance as described in USSN 12/514,991
  misc_feature (1)..(294): Ceres ANNOT ID no.1513976
  misc_feature (1)..(294): Encodes the peptide sequence given in  SEQ ID NO. 109
atgggtttccattcgtctgctattatacgtgctaagcaaattcttcagctatctccatctgcagcaagccaactagcttcaaatgtgccaaagggttgccttgcagtctatgttggagaaatccaaaagaagagattcataattccaatatcatacttgaaccaaccactatttcaatacttgctaagtcaagctgaagaagaattcggatatcatcatcccatgggcggtctcacaatcccatgcagagaagacatttttcatcttgtcatttcttccttaaatcagtcatga

SEQ ID NO: 1945 - protein, 97 aa, Populus balsamifera subsp. trichocarpa
  misc_feature (1)..(97): useful for making plants with increased cold tolerance as described in USSN 12/514,991
  misc_feature (1)..(97): Ceres ANNOT ID no.1513976
  misc_feature (1)..(95): Pfam Name: Auxin_inducible Pfam Description: Auxin responsive protein
  misc_feature (1)..(97): Score of 128.4 for HMM of FIGURE 1 of USSN 12/514,991.
  misc_feature (1)..(97): Functional Homolog Of Ceres SEEDLINE ID no. ME12469
MGFHSSAIIRAKQILQLSPSAASQLASNVPKGCLAVYVGEIQKKRFIIPISYLNQPLFQYLLSQAEEEFGYHHPMGGLTIPCREDIFHLVISSLNQS

SEQ ID NO: 1946 - protein, 107 aa, Tulipa gesneriana
  misc_feature (1)..(107): useful for making plants with increased cold tolerance as described in USSN 12/514,991
  misc_feature (1)..(107): Public GI no. 10185818
  misc_feature (5)..(107): Pfam Name: Auxin_inducible Pfam Description: Auxin responsive protein
  misc_feature (1)..(107): Score of 147.9 for HMM of FIGURE 1 of USSN 12/514,991.
  misc_feature (1)..(107): Functional Homolog Of Ceres SEEDLINE ID no. ME12469
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 1947 - DNA, 294 bp, Populus balsamifera subsp. trichocarpa
  misc_feature (1)..(294): useful for making plants with increased cold tolerance as described in USSN 12/514,991
  misc_feature (1)..(294): Ceres ANNOT ID no.1503523
  misc_feature (1)..(294): Encodes the peptide sequence given in  SEQ ID NO. 112
atgggtttccgtttgtcagcaattgtgcgtgctaagcaagtccttcagctttctccatccgcaacaagccaagcagcttctaatgtcccaaagggctgcctagcagtttatgttggagaaatccaaaagaagagatttgtcattccaatatcatacttgaaccagcctaattttcaagagttgctaagtcaagctgaagaagaattcggatatgttcatcctatgggtggtctaacaattccttgcagagaagacattttccttgctgtcatttcttgcttaagtcagtcgtga

SEQ ID NO: 1948 - protein, 97 aa, Populus balsamifera subsp. trichocarpa
  misc_feature (1)..(97): useful for making plants with increased cold tolerance as described in USSN 12/514,991
  misc_feature (1)..(97): Ceres ANNOT ID no.1503523
  misc_feature (1)..(95): Pfam Name: Auxin_inducible Pfam Description: Auxin responsive protein
  misc_feature (1)..(97): Score of 137.2 for HMM of FIGURE 1 of USSN 12/514,991.
  misc_feature (1)..(97): Functional Homolog Of Ceres SEEDLINE ID no. ME12469
MGFRLSAIVRAKQVLQLSPSATSQAASNVPKGCLAVYVGEIQKKRFVIPISYLNQPNFQELLSQAEEEFGYVHPMGGLTIPCREDIFLAVISCLSQS

SEQ ID NO: 1949 - DNA, 324 bp, Populus balsamifera subsp. trichocarpa
  misc_feature (1)..(324): useful for making plants with increased cold tolerance as described in USSN 12/514,991
  misc_feature (1)..(324): Ceres ANNOT ID no.1460706
  misc_feature (1)..(324): Encodes the peptide sequence given in  SEQ ID NO. 114
atgagcaccagtcgattgaaggagatgttccttcacgttaaaaataaaattcgaagaacgtctacactgaatcatcatcaactctcacataagagatcaacaaggctagacgtgccgaaaggccattttgcaatttatgtcggggaggaagagaaggaaaggaagcgatttgtgatcccagtttcttacttgaagcatccattgtttcaaatcttgttaagtcaagctgaagaagagtttggttttgatcatcaaatgggtggtcttaccattccatgcgccgaagatgagttcactgttctcacttcgcacttgaatggttga

SEQ ID NO: 1950 - protein, 99 aa, Populus balsamifera subsp. trichocarpa
  misc_feature (1)..(99): useful for making plants with increased cold tolerance as described in USSN 12/514,991
  misc_feature (1)..(99): Ceres ANNOT ID no.1460706
  misc_feature (7)..(98): Pfam Name: Auxin_inducible Pfam Description: Auxin responsive protein
  misc_feature (1)..(99): Score of 123.1 for HMM of FIGURE 1 of USSN 12/514,991.
  misc_feature (1)..(99): Functional Homolog Of Ceres SEEDLINE ID no. ME12469
MFLHVKNKIRRTSTLNHHQLSHKRSTRLDVPKGHFAIYVGEEEKERKRFVIPVSYLKHPLFQILLSQAEEEFGFDHQMGGLTIPCAEDEFTVLTSHLNG

SEQ ID NO: 1951 - protein, 93 aa, Medicago truncatula
  misc_feature (1)..(93): useful for making plants with increased cold tolerance as described in USSN 12/514,991
  misc_feature (1)..(93): Public GI no. 92870693
  misc_feature (1)..(91): Pfam Name: Auxin_inducible Pfam Description: Auxin responsive protein
  misc_feature (1)..(93): Score of 116.3 for HMM of FIGURE 1 of USSN 12/514,991.
  misc_feature (1)..(93): Functional Homolog Of Ceres SEEDLINE ID no. ME12469
MGFRFPGIIRKASFSANRSASKSVDVPKGYLAVYVGEKQTRYLIPVSYLSQPSFQGLLSQVEEEFGYDHPMGGLTIPCTEDVFQHITSCFNGL

SEQ ID NO: 1952 - protein, 99 aa, Zea mays
  misc_feature (1)..(99): useful for making plants with increased cold tolerance as described in USSN 12/514,991
  misc_feature (1)..(99): Ceres CLONE ID no. 1064543
  misc_feature (1)..(99): Also Known As Ceres ME LINE ME24962
  misc_feature (1)..(99): Pfam Name: Auxin_inducible Pfam Description: Auxin responsive protein
  misc_feature (1)..(99): Score of 129.9 for HMM of FIGURE 1 of USSN 12/514,991.
  misc_feature (1)..(99): Functional Homolog Of Ceres SEEDLINE ID no. ME12469
MALVRSLLGAKKILGRSLTAAASSTSKTTASAAPKGFLAVYVGESQKKRYVVPISYLSQPSFQALLSKSEEEFGFDHPMGGLTIPCPEDIFINLTSRLQ

SEQ ID NO: 1953 - protein, 98 aa, Brassica napus
  misc_feature (1)..(98): useful for making plants with increased cold tolerance as described in USSN 12/514,991
  misc_feature (1)..(98): Ceres CLONE ID no. 964002
  misc_feature (1)..(98): Pfam Name: Auxin_inducible Pfam Description: Auxin responsive protein
  misc_feature (1)..(98): Score of 123.8 for HMM of FIGURE 1 of USSN 12/514,991.
  misc_feature (1)..(98): Functional Homolog Of Ceres SEEDLINE ID no. ME12469
MAYVRSLLGAKKILGRSVTAAAPTSNRAASAAPKGFLAVYVGEMQKKRYVVPISYLSQPSFQALLSKSEEEFGFDHPMGGLTIPCPEDTFIAVTSRLQ

SEQ ID NO: 1954 - DNA, 531 bp, Arabidopsis thaliana
  misc_feature (1)..(531): useful for making plants with increased cold tolerance as described in USSN 12/514,991
  misc_feature (1)..(531): Ceres ANNOT ID 576111
  misc_feature (1)..(531): Also Known As Ceres ME LINE ME09090
  misc_feature (1)..(531): spliced sequence of genomic sequence Ceres Annot ID 576111
  misc_feature (1)..(531): Encodes the peptide sequence given in SEQ ID NO. 119
atggagaagcttcttaatccgtacgataagcagtgcatgaaaatggctatgcttaaacatgaagaaactttcaagcaacaggtatatgaacttcatagattatatcaagttcagaagatattgatgaagaacatggagatcaacaaatttactaccaagaacaatcatgtaaattcaggtctaggaacattcatcagaagagttgacaacgagattgaccggccggcgaatttctccggtggtaataataatatagagattatggatgagagtgagatcgagttaacccttggtccctcgtgttacggtggtgatgaaatgatgaggatgaacaagaagaagaaaaagaactctttgccggagatgatggacgggagtttaaattccggtcgccggagtttttcttcgtcttcgacaggatcaagtaataacaataacaacaatcttgaagaacaagtgaggcaagaaagaatgatgaaacatcagaagcagcagccatggcttcaagcattgaccttgaatgttatttga

SEQ ID NO: 1955 - protein, 176 aa, Arabidopsis thaliana
  misc_feature (1)..(176): useful for making plants with increased cold tolerance as described in USSN 12/514,991
  misc_feature (1)..(176): Ceres ANNOT ID 576111
  misc_feature (1)..(176): Also Known As Ceres ME LINE ME09090
  misc_feature (1)..(176): Score of 409.7 for HMM of FIGURE 2 of USSN 12/514,991.
MEKLLNPYDKQCMKMAMLKHEETFKQQVYELHRLYQVQKILMKNMEINKFTTKNNHVNSGLGTFIRRVDNEIDRPANFSGGNNNIEIMDESEIELTLGPSCYGGDEMMRMNKKKKKNSLPEMMDGSLNSGRRSFSSSSTGSSNNNNNNLEEQVRQERMMKHQKQQPWLQALTLNVI

SEQ ID NO: 1956 - DNA, 651 bp, Populus balsamifera subsp. trichocarpa
  misc_feature (1)..(651): useful for making plants with increased cold tolerance as described in USSN 12/514,991
  misc_feature (1)..(651): Ceres ANNOT ID no.1446889
  misc_feature (1)..(651): Encodes the peptide sequence given in  SEQ ID NO. 121
atggagaaattcctcaagccctacgacaaggaatacatgagaatggccatgttaaaacatgaagaaacattcaaagagcaggtatgtgaacttcatcgtctatatcgaacccaaaaaaatatgatgagaaacattgaaagcaacaggcctagtgcgaggagtcgagaattatggagctcaaaaaatggctttagctttaatcagactaatcatgcacgcgatatgcagcagaagtcgatagcgaaacttgacttggagaggcctgctgaactttatgttgtagaatcaaatgcagatacagtattagagctaatagatgagagtgagattcagctaacactgggaccttcgagctataacagaaggaggaaacgtgaaacaccactaacttcagattcaggaccaagcctctcttcgacttccactggatccagtcatttaaacaggacaagttccttgacaaatcaaaagatcaacaccagaagagaagagttaagtggccctggattggggcttttccaggttcctgacattaccttggggtaccaaaatggaagtaaaaacagtattggcgttgaagaacaagtagggcaggatagactaaaacaacctccttggctttgtcaagttttgcgtctgaacatcgcttga

SEQ ID NO: 1957 - protein, 216 aa, Populus balsamifera subsp. trichocarpa
  misc_feature (1)..(216): useful for making plants with increased cold tolerance as described in USSN 12/514,991
  misc_feature (1)..(216): Ceres ANNOT ID no.1446889
  misc_feature (1)..(216): Score of 523.2 for HMM of FIGURE 2 of USSN 12/514,991.
  misc_feature (1)..(216): Functional Homolog Of Ceres SEEDLINE ID no. ME09090
MEKFLKPYDKEYMRMAMLKHEETFKEQVCELHRLYRTQKNMMRNIESNRPSARSRELWSSKNGFSFNQTNHARDMQQKSIAKLDLERPAELYVVESNADTVLELIDESEIQLTLGPSSYNRRRKRETPLTSDSGPSLSSTSTGSSHLNRTSSLTNQKINTRREELSGPGLGLFQVPDITLGYQNGSKNSIGVEEQVGQDRLKQPPWLCQVLRLNIA

SEQ ID NO: 1958 - protein, 202 aa, Medicago truncatula
  misc_feature (1)..(202): useful for making plants with increased cold tolerance as described in USSN 12/514,991
  misc_feature (1)..(202): Public GI no. 92883700
  misc_feature (1)..(202): Score of 482.9 for HMM of FIGURE 2 of USSN 12/514,991.
  misc_feature (1)..(202): Functional Homolog Of Ceres SEEDLINE ID no. ME09090
MEKLVRSCDKEYMRMAMLKHEETFKQQVYELHRLYRIQKILMQNMEARRGVEVKEQEWYFKNAISLTQNANHHHKGGQEKTQIKFDLERPAEEHTAESDDEGLEIIDETEIELTLGPSSYNRSKKIETPLTSESGHSLSSSSTGSSDINKTRRWRTHHSNGMKREEPSGIIRNSSFGIEEQLRQERLKQSPWFFQVMNLNMT

SEQ ID NO: 1959 - protein, 203 aa, Solanum tuberosum
  misc_feature (1)..(203): useful for making plants with increased cold tolerance as described in USSN 12/514,991
  misc_feature (1)..(203): Public GI no. 82623371
  misc_feature (1)..(203): Score of 475 for HMM of FIGURE 2 of USSN 12/514,991.
  misc_feature (1)..(203): Functional Homolog Of Ceres SEEDLINE ID no. ME09090
MEKLINPYDKEYMKMAMLKHEEIFREQVYELHRLYQTQKLLMKNMSNSTNRPQQDHHHQVVVNHLDSNKKITGRQCIDLEIKPNTDEEHIAESDELELTLGLSSYNVRRRRKTAHFDSSSPSFSSSNSTGSASSPIKHITTNLVRNIEGSKWGLDEKLPVSNNFQIGGRTSQSNQNVDQEQYRSQDSLNNPPWLFQVLSLNMT

SEQ ID NO: 1960 - protein, 186 aa, Triticum aestivum
  misc_feature (1)..(186): useful for making plants with increased cold tolerance as described in USSN 12/514,991
  misc_feature (1)..(186): Ceres CLONE ID no. 918760
  misc_feature (1)..(186): Score of 421.9 for HMM of FIGURE 2 of USSN 12/514,991.
  misc_feature (1)..(186): Functional Homolog Of Ceres SEEDLINE ID no. ME09090
MEELVHQCDMEVMKMAMLKHEQTFRQQVHDLHRLYRVQKQLMGDQSGRPSVPPCHQVQRRREHPRRPELSLQLPVDDDEYAVVSGGTGRLATPPSMESEDELELTLAVGGGGGNGGSSRSQRRRRESATDCSGRRSPQTPSSSTDSDDALRTVPHHQRATACDLRGGVMVSKQPQWLVRCLSLRMA

SEQ ID NO: 1961 - DNA, 806 bp, Panicum virgatum
  misc_feature (1)..(806): useful for making plants with increased cold tolerance as described in USSN 12/514,991
  misc_feature (1)..(806): Ceres CLONE ID no.1775586
  misc_feature (1)..(806): Encodes the peptide sequence given in  SEQ ID NO. 126
agcagggccagaagctttgcctttggcctagcagtagctaccaggagatcttcctgcgagaggtgcctaacagcttcagaggaatcagcacttgagcagtgggagctctgaggcagaggtgcactgttgaggtcagcgagcggcaatttttgtgggttgggaaggaatggagaagcaacacatcaagatggccatgctgaagcaagaacaaacattcagacagcaggttcatgagctgcaccgtgtatatcgggttcagaagcagctgatgatgcagatgcatgttacggagaagaaagactacggcaacatagctgcagagggacaaactgaatctacaggaaagctcagtcaccaacaatggtacggtagctcagtcaaggaggaggctgcactggcagaagacttcaacctggagctgacgctgggaacaggtactgccatgacgaagcaagagaagccgtccgactcagactccgaagcaacaatatcatcatcaacatctgcagaatcagagtcagggcggagatttgcgcctgactccaatgtagcaaccctgaggtttcagaatgagagcaataggcatgatgataaggttatgcagtctccatggctataccagtgttttaagtctcaagatggcatgaaggcatagctagggttggcatgagggtgcctcaagatttgaaaagccaaaacaaaagcaaatgcattgctgtatgtatagtacaagcgaattcaatgcaactttaggagtgagatcaaaagaatcaagcatttctctcgaaaaaaaaaaaaaaaaaaaa

SEQ ID NO: 1962 - protein, 162 aa, Panicum virgatum
  misc_feature (1)..(162): useful for making plants with increased cold tolerance as described in USSN 12/514,991
  misc_feature (1)..(162): Ceres CLONE ID no. 1775586
  misc_feature (1)..(162): Score of 323.6 for HMM of FIGURE 2 of USSN 12/514,991.
  misc_feature (1)..(162): Functional Homolog Of Ceres SEEDLINE ID no. ME09090
MEKQHIKMAMLKQEQTFRQQVHELHRVYRVQKQLMMQMHVTEKKDYGNIAAEGQTESTGKLSHQQWYGSSVKEEAALAEDFNLELTLGTGTAMTKQEKPSDSDSEATISSSTSAESESGRRFAPDSNVATLRFQNESNRHDDKVMQSPWLYQCFKSQDGMKA

SEQ ID NO: 1963 - DNA, 510 bp, Arabidopsis thaliana
  misc_feature (1)..(510): useful for making plants with increased cold tolerance as described in USSN 12/514,991
  misc_feature (1)..(510): Ceres ME LINE ME00339
  misc_feature (1)..(510): Encodes the peptide sequence given in  SEQ ID NO. 128
ataaaccaaactcaaagcttctcttatcatcaaacaagatcaagatatcttaactttagccattaattcaaagttttttttttctttctaatactcgaaatggctttcttaaggagttttttcgctaccaagcatatcattcgccggtcttttactacggaatcattatcaacgcctaaagggttctttgctgtgtatgttggagaaaatctgaagaagaagagatatcttgttccggtttgttacttgaacaagccatctttccaagctttgcttaggaaagcagaagaagagttcggttttaatcatccaaccggtggtttgagtctaccatgcgacgaagctttcttcttcactgtcacttctcagattcgttaatcccatacaataattaaagtcttttttacattctcttatttatagaagaaaatacacattgtacatactatacttttatatacatactgatgagaagaataattcaacgaacatcttttgctttcgttttct

SEQ ID NO: 1964 - protein, 92 aa, Arabidopsis thaliana
  misc_feature (1)..(92): useful for making plants with increased cold tolerance as described in USSN 12/514,991
  misc_feature (1)..(92): Ceres ME LINE ME00339
  misc_feature (1)..(92): Pfam Name: Auxin_inducible Pfam Description: Auxin responsive protein
  misc_feature (1)..(92): Score of 134.1 for HMM of FIGURE 1 of USSN 12/514,991.
  misc_feature (1)..(92): Functional Homolog Of Ceres SEEDLINE ID no. ME12469
MAFLRSFFATKHIIRRSFTTESLSTPKGFFAVYVGENLKKKRYLVPVCYLNKPSFQALLRKAEEEFGFNHPTGGLSLPCDEAFFFTVTSQIR

SEQ ID NO: 1965 - protein, 98 aa, Glycine max
  misc_feature (1)..(98): useful for making plants with increased cold tolerance as described in USSN 12/514,991
  misc_feature (1)..(98): Ceres CLONE ID no. 1044069
  misc_feature (1)..(98): Pfam Name: Auxin_inducible Pfam Description: Auxin responsive protein
  misc_feature (1)..(98): Score of 133.3 for HMM of FIGURE 1 of USSN 12/514,991.
  misc_feature (1)..(98): Functional Homolog Of Ceres SEEDLINE ID no. ME12469
MALVRSLLGAKKILGRSVTAAASTSKRATSAAPKGFLAVYVGESQKKRYVVPISYLSQPSFQALLNKSEEEFGFDHPMGGLTIPCSEDIFITVTSRFQ

SEQ ID NO: 1966 - protein, 93 aa, Medicago truncatula
  misc_feature (1)..(93): useful for making plants with increased cold tolerance as described in USSN 12/514,991
  misc_feature (1)..(93): Public GI no. 92870688
  misc_feature (1)..(91): Pfam Name: Auxin_inducible Pfam Description: Auxin responsive protein
  misc_feature (1)..(93): Score of 128.6 for HMM of FIGURE 1 of USSN 12/514,991.
  misc_feature (1)..(93): Functional Homolog Of Ceres SEEDLINE ID no. ME12469
MGFRIAKLIRMPSFSKTQESTKGLEVPKGYLAVYVGDRMRRFVIPVSYLNQPSFQELLNQAEEEFGYDHPMGGLTIPCSEDEFQNLTSRLSEL

SEQ ID NO: 1967 - DNA, 381 bp, Populus balsamifera subsp. trichocarpa
  misc_feature (1)..(381): useful for making plants with increased cold tolerance as described in USSN 12/514,991
  misc_feature (1)..(381): Ceres ANNOT ID no.1446695
  misc_feature (1)..(381): Encodes the peptide sequence given in  SEQ ID NO. 132
atggcaaagacttccaagttgacaaagctcaagtctgccataaagaggttgccatctttcaccaagatagtccgcacaaatagctccattgctgctgctgacaacgatcacatcgatggcaagatttcaaaggaacttcatgcagtctatgttggaaagtcaaggaggagatatctcttgagctccgatgtcatttgtcatcctctttttcaagggctaatagacaggtcaggcgctggttttggtgatgaggataatcaagcagttgttgttgcttgtgaggttgtcttgtttgagcacttgctgtggatgattgagagtggtggctctgatcagttggggtccatggaggagcttgctgaattctattacacttgctga

SEQ ID NO: 1968 - protein, 126 aa, Populus balsamifera subsp. trichocarpa
  misc_feature (1)..(126): useful for making plants with increased cold tolerance as described in USSN 12/514,991
  misc_feature (1)..(126): Ceres ANNOT ID no.1446695
  misc_feature (1)..(106): Pfam Name: Auxin_inducible Pfam Description: Auxin responsive protein
  misc_feature (1)..(126): Score of 73.4 for HMM of FIGURE 1 of USSN 12/514,991.
  misc_feature (1)..(126): Functional Homolog Of Ceres SEEDLINE ID no. ME12469
MAKTSKLTKLKSAIKRLPSFTKIVRTNSSIAAADNDHIDGKISKELHAVYVGKSRRRYLLSSDVICHPLFQGLIDRSGAGFGDEDNQAVVVACEVVLFEHLLWMIESGGSDQLGSMEELAEFYYTC

SEQ ID NO: 1969 - DNA, 397 bp, Arabidopsis thaliana
  misc_feature (1)..(397): useful for making plants with increased cold tolerance as described in USSN 12/514,991
  misc_feature (1)..(397): Ceres ME LINE ME06788
  misc_feature (1)..(397): Encodes the peptide sequence given in  SEQ ID NO. 134
atctacacctcaacttcttcttcttctcctctcaagaaacaataactagcaatggcggttaagagatcttcaaagctaacacaaaccgcaatgctgaagcaaatcctcaagagatgctcgagcttggccaagaatcaatgctatgatgaggatggtctgcctgtagacgtaccaaagggtcatttcccggtctatgtaggcgaaaagaggagccggtacatcgtacccatatccttcttgactcatcctaagttcaagagcttgcttcaacaggcagaagaagagttcgggttcaatcatgacatgggactcactattccttgtgaagaagttgttttccgctctttaacatccatgatcggatgagggagtgggagagaaagagaaagagagagag

SEQ ID NO: 1970 - protein, 104 aa, Arabidopsis thaliana
  misc_feature (1)..(104): useful for making plants with increased cold tolerance as described in USSN 12/514,991
  misc_feature (1)..(104): Ceres ME LINE ME06788
  misc_feature (5)..(104): Pfam Name: Auxin_inducible Pfam Description: Auxin responsive protein
  misc_feature (1)..(104): Score of 194.1 for HMM of FIGURE 1 of USSN 12/514,991.
  misc_feature (1)..(104): Functional Homolog Of Ceres SEEDLINE ID no. ME12469
MAVKRSSKLTQTAMLKQILKRCSSLAKNQCYDEDGLPVDVPKGHFPVYVGEKRSRYIVPISFLTHPKFKSLLQQAEEEFGFNHDMGLTIPCEEVVFRSLTSMIG

SEQ ID NO: 1971 - protein, 100 aa, Medicago truncatula
  misc_feature (1)..(100): useful for making plants with increased cold tolerance as described in USSN 12/514,991
  misc_feature (1)..(100): Public GI no. 92870685
  misc_feature (7)..(100): Pfam Name: Auxin_inducible Pfam Description: Auxin responsive protein
  misc_feature (1)..(100): Score of 167.3 for HMM of FIGURE 1 of USSN 12/514,991.
  misc_feature (1)..(100): Functional Homolog Of Ceres SEEDLINE ID no. ME12469
MAIIKKYSNKLPQNAVLKQILKRCSSLGKNEQPMDVPKGHFPVYVGENRSRYIVPISFLTHPEFQSLLRQAEEEFGFDHDMGLTIPCQEVVFQSLTSMIR

SEQ ID NO: 1972 - DNA, 315 bp, Populus balsamifera subsp. trichocarpa
  misc_feature (1)..(315): useful for making plants with increased cold tolerance as described in USSN 12/514,991
  misc_feature (1)..(315): Ceres ANNOT ID no.1450460
  misc_feature (1)..(315): Encodes the peptide sequence given in  SEQ ID NO. 137
atggctattagaaaatcacacaaactacctcaaacagcagtcctcaagcaaatcctcaagagatgctccagtttaggcaagaaacatggctatgatgatgatggcctccctcttgacgtgccaaaagggcactttgctgtgtatgttggtgaaaacagaagtagatacattgttccaatctcatttttgagccaccctgagtttcaatccttgcttcaaagagcagaagaggaatttggctttgatcatgatatgggccttactatcccttgtgaagaagtagtttttcgatctctaacatcaatgctcagatga

SEQ ID NO: 1973 - protein, 104 aa, Populus balsamifera subsp. trichocarpa
  misc_feature (1)..(104): useful for making plants with increased cold tolerance as described in USSN 12/514,991
  misc_feature (1)..(104): Ceres ANNOT ID no.1450460
  misc_feature (5)..(104): Pfam Name: Auxin_inducible Pfam Description: Auxin responsive protein
  misc_feature (1)..(104): Score of 184.5 for HMM of FIGURE 1 of USSN 12/514,991.
  misc_feature (1)..(104): Functional Homolog Of Ceres SEEDLINE ID no. ME12469
MAIRKSHKLPQTAVLKQILKRCSSLGKKHGYDDDGLPLDVPKGHFAVYVGENRSRYIVPISFLSHPEFQSLLQRAEEEFGFDHDMGLTIPCEEVVFRSLTSMLR

SEQ ID NO: 1974 - protein, 107 aa, Zea mays
  misc_feature (1)..(107): useful for making plants with increased cold tolerance as described in USSN 12/514,991
  misc_feature (1)..(107): Ceres CLONE ID no. 1444736
  misc_feature (6)..(107): Pfam Name: Auxin_inducible Pfam Description: Auxin responsive protein
  misc_feature (1)..(107): Score of 179.6 for HMM of FIGURE 1 of USSN 12/514,991.
  misc_feature (1)..(107): Functional Homolog Of Ceres SEEDLINE ID no. ME12469
MAIMKKSLKLTQTAMLKQILKRCSSLGKKNGGGYDDDYLPLDVPKGHFPVYVGENRSRYIVPVSFLTHPEFQFLLRRAEEEFGFDHDMGLTIPCDEVVFQSLTSMIR

SEQ ID NO: 1975 - DNA, 693 bp, Gossypium hirsutum
  misc_feature (1)..(693): useful for making plants with increased cold tolerance as described in USSN 12/514,991
  misc_feature (1)..(693): Ceres CLONE ID no.1898293
  misc_feature (1)..(693): Encodes the peptide sequence given in  SEQ ID NO. 140
accgcactccacaaccactaagccttcatttttatttttattttctccttctttcaccaaacaaaaacaacaatggcgatcagaaaatcatccaagctaccacaaaccgccgtcctcaaacaaatcctcaaacgatgttcgagtttaggcaagaaacaacacggcggtggctacgacgacgttggtctcacccctcccttagacgtacccaaaggtcacttcgccgtttacgtcggcgaaaacaggagcaggtacattgtacccatctcgttcttgactcaccccgagttccaatgcttactccgacgagccgaagaagagttcgggttcgatcacgatatgggactcactatcccttgtgaagaagtcgtttttcgatcacttacctccacgctccgatgaagttgaaaagtatagcacggcggcatcgtcattgtacggcgctaagcttttttttttaacatcgatttttctgttttttttaatgatattctgaacccattaatttgggttttttttaatgtttgtttagtgattagggaatctaactttgagcccatgaaactatgaaatttttttctgggttttaaataatttgtacaaacctttgtttcctcacggtttgcattactgtgagagatgttgaaatgttaaggaaagcaatgttgttgtctaaaaaaaaaaaaaaaaaaa

SEQ ID NO: 1976 - protein, 109 aa, Gossypium hirsutum
  misc_feature (1)..(109): useful for making plants with increased cold tolerance as described in USSN 12/514,991
  misc_feature (1)..(109): Ceres CLONE ID no. 1898293
  misc_feature (5)..(109): Pfam Name: Auxin_inducible Pfam Description: Auxin responsive protein
  misc_feature (1)..(109): Score of 179.5 for HMM of FIGURE 1 of USSN 12/514,991.
  misc_feature (1)..(109): Functional Homolog Of Ceres SEEDLINE ID no. ME12469
MAIRKSSKLPQTAVLKQILKRCSSLGKKQHGGGYDDVGLTPPLDVPKGHFAVYVGENRSRYIVPISFLTHPEFQCLLRRAEEEFGFDHDMGLTIPCEEVVFRSLTSTLR

SEQ ID NO: 1977 - protein, 101 aa, Capsicum annuum
  misc_feature (1)..(101): useful for making plants with increased cold tolerance as described in USSN 12/514,991
  misc_feature (1)..(101): Public GI no. 20149050
  misc_feature (6)..(101): Pfam Name: Auxin_inducible Pfam Description: Auxin responsive protein
  misc_feature (1)..(101): Score of 176.1 for HMM of FIGURE 1 of USSN 12/514,991.
  misc_feature (1)..(101): Functional Homolog Of Ceres SEEDLINE ID no. ME12469
MGLKKSNKHITQSVALKQILKRCSSFGKNENGLPHDVPKGHFVVYVGENRSRYIIPISWLTHPEFQSLLQRAEEEFGFNHDMGLTIPCDEEDFCSLMSIFR

SEQ ID NO: 1978 - protein, 106 aa, Glycine max
  misc_feature (1)..(106): useful for making plants with increased cold tolerance as described in USSN 12/514,991
  misc_feature (1)..(106): Ceres CLONE ID no. 545679
  misc_feature (5)..(106): Pfam Name: Auxin_inducible Pfam Description: Auxin responsive protein
  misc_feature (1)..(106): Score of 166.6 for HMM of FIGURE 1 of USSN 12/514,991.
  misc_feature (1)..(106): Functional Homolog Of Ceres SEEDLINE ID no. ME12469
MAIKKSNKLPQADVIKQIVRRCSSFGKKQQGYNEEGGLPEDVPKGHFAVYVGENRTRYIVPISWLAHPQFQSLLQRAEEEFGFNHDMGLTIPCDEVVFEFLTSMIR

SEQ ID NO: 1979 - DNA, 537 bp, Arabidopsis thaliana
  misc_feature (1)..(537): useful for making plants with increased cold tolerance as described in USSN 12/514,991
  misc_feature (1)..(537): Ceres ME LINE ME10877
  misc_feature (1)..(537): Encodes the peptide sequence given in  SEQ ID NO. 144
atggaagccaagaagtcaaacaagatcagagagatcgttaagcttcaacagcttctcaagaaatggcgaaaacaagcaattgcatcaaaagcagccaacaacaacaacgaagacaacaatagcagtggcgggggaagcaagagcatcaagtttctgaagaggacactgtcatttacagatgtaacagctgtgcctaaagggtatctagctgtttcggtcgggttagagaagaagaggtacacaataccaaccgagtacctcagccatcaagctttctatgttcttctgcgtgaggcagaagaagagttcgggtttcaacaagccggtgtcttgaggattccttgtgaagtttctgtttttgagagcatattgaagataatggaggagaagaacgaagggtacctggtgacgccaataacagctaagcaggaatgtaagttcaatgcagcagcagatgataagacgagttaccagcatccatcagactgtcctaagactccttcacaccaacctcacaacagcccaatgtgcagatag

SEQ ID NO: 1980 - protein, 178 aa, Arabidopsis thaliana
  misc_feature (1)..(178): useful for making plants with increased cold tolerance as described in USSN 12/514,991
  misc_feature (1)..(178): Ceres ME LINE ME10877
  misc_feature (20)..(128): Pfam Name: Auxin_inducible Pfam Description: Auxin responsive protein
  misc_feature (1)..(178): Score of 243.4 for HMM of FIGURE 1 of USSN 12/514,991.
  misc_feature (1)..(178): Functional Homolog Of Ceres SEEDLINE ID no. ME12469
MEAKKSNKIREIVKLQQLLKKWRKQAIASKAANNNNEDNNSSGGGSKSIKFLKRTLSFTDVTAVPKGYLAVSVGLEKKRYTIPTEYLSHQAFYVLLREAEEEFGFQQAGVLRIPCEVSVFESILKIMEEKNEGYLVTPITAKQECKFNAAADDKTSYQHPSDCPKTPSHQPHNSPMCR

SEQ ID NO: 1981 - DNA, 558 bp, Populus balsamifera subsp. trichocarpa
  misc_feature (1)..(558): useful for making plants with increased cold tolerance as described in USSN 12/514,991
  misc_feature (1)..(558): Ceres ANNOT ID no.1465253
  misc_feature (1)..(558): Encodes the peptide sequence given in  SEQ ID NO. 146
atggatcatccaaagaagtctaacaagatcagcgacattgttcggcttcagcagatccttaagaagtggagaaaggcagcaaatgcacccaaaaacatcagcagcagcagcaacaacaacagcagcagcagcagcagcaatgccagcaagagtatcaagttcttaaagagaacactctccttcacagatttgtcatcgtcagcagcagcgtcctcaaatgatgctgttcccaaagggtaccttgctgtttgtgttggcaaggagttgaagaggtatatcatccctacagagtacttgggtcaccaagcctttggaattctattgcgagaggccgaagaggagtttgggtttcaacaagagggagtgttaaagataccatgtgaagttcctgtgtttgagaagatcttgaaggtagttgaagagaagaaagatgtttacttgttgcatgagttagggcctgttaatgcagagtcgacggccaaggagatgattggttgttactcacaatcaccagattgtgagctaacaccttctcatcatccacaaatgtgtagatga

SEQ ID NO: 1982 - protein, 185 aa, Populus balsamifera subsp. trichocarpa
  misc_feature (1)..(185): useful for making plants with increased cold tolerance as described in USSN 12/514,991
  misc_feature (1)..(185): Ceres ANNOT ID no.1465253
  misc_feature (26)..(140): Pfam Name: Auxin_inducible Pfam Description: Auxin responsive protein
  misc_feature (1)..(185): Score of 136.1 for HMM of FIGURE 1 of USSN 12/514,991.
  misc_feature (1)..(185): Functional Homolog Of Ceres SEEDLINE ID no. ME12469
MDHPKKSNKISDIVRLQQILKKWRKAANAPKNISSSSNNNSSSSSSNASKSIKFLKRTLSFTDLSSSAAASSNDAVPKGYLAVCVGKELKRYIIPTEYLGHQAFGILLREAEEEFGFQQEGVLKIPCEVPVFEKILKVVEEKKDVYLLHELGPVNAESTAKEMIGCYSQSPDCELTPSHHPQMCR

SEQ ID NO: 1983 - protein, 176 aa, Oryza sativa subsp. japonica
  misc_feature (1)..(176): useful for making plants with increased cold tolerance as described in USSN 12/514,991
  misc_feature (1)..(176): Public GI no. 50928599
  misc_feature (47)..(143): Pfam Name: Auxin_inducible Pfam Description: Auxin responsive protein
  misc_feature (1)..(176): Score of 124.7 for HMM of FIGURE 1 of USSN 12/514,991.
  misc_feature (1)..(176): Functional Homolog Of Ceres SEEDLINE ID no. ME12469
MEEQQHLHPGGGGGKKSNKITEIVRLQQMLKKWRKLSVAPKDAAATAGNGGGGESKAKKFLKRTLSFTDGGASPGGTPPPRGHLAVCVGPTAQRFVIPTDYLKHRAFAALLREAEEEFGFQQEGVLRIPCEVPAFEAILKAVEKNKKDNAAAFCYCSYEYAADEVALGAPNNPLCR

SEQ ID NO: 1984 - protein, 136 aa, Triticum aestivum
  misc_feature (1)..(136): useful for making plants with increased cold tolerance as described in USSN 12/514,991
  misc_feature (1)..(136): Ceres CLONE ID no. 757937
  misc_feature (46)..(111): Pfam Name: Auxin_inducible Pfam Description: Auxin responsive protein
  misc_feature (1)..(136): Score of 127.8 for HMM of FIGURE 1 of USSN 12/514,991.
  misc_feature (1)..(136): Functional Homolog Of Ceres SEEDLINE ID no. ME12469
MEERGRGGSNKIRDIVRLQQLLKRWKRMAVAPGGGGRGKNGGGGGAVPKGSFAVYVGEEMRRFVIPTEYLGHWAFEELLREAEEEFGFRHEGALRIPCDVEAFEGILRLVAAGKKDSAGADMCDRSCSSETEILCR

SEQ ID NO: 1985 - protein, 166 aa, Zea mays
  misc_feature (1)..(166): useful for making plants with increased cold tolerance as described in USSN 12/514,991
  misc_feature (1)..(166): Ceres CLONE ID no. 235352
  misc_feature (49)..(134): Pfam Name: Auxin_inducible Pfam Description: Auxin responsive protein
  misc_feature (1)..(166): Score of 123.5 for HMM of FIGURE 1 of USSN 12/514,991.
  misc_feature (1)..(166): Functional Homolog Of Ceres SEEDLINE ID no. ME12469
MEQSGAKKSNKITEIVRMQRMLKKWRKLSVTPKEPSSPTGGGGNAVGESKAKKFLKRTLSFTDAPPSGSPPKGHLAVCVGPAAQRFVIPTEYLKHRAFAALLREAEEEFGFQQEGVLRIPCEVPVFESTLRAVEKNKKDAAASCYCSAEYAADEVGRGTPNNPLCR

SEQ ID NO: 1986 - DNA, 366 bp, Arabidopsis thaliana
  misc_feature (1)..(366): useful for making plants with increased cold tolerance as described in USSN 12/514,991
  misc_feature (1)..(366): Ceres ME LINE ME12470
  misc_feature (1)..(366): Encodes the peptide sequence given in  SEQ ID NO. 151
atgggcaccggagaaaaaaccctgaagagcttccagttacatcgcaaacaatcagtcaaagtcaaagatgttccaaaagggtgtttagcgatcaaagtgggatcgcaaggagaagagcaacagagatttatcgttcctgttttgtattttaaccatccattgttcatgcagctcctgaaagaagcagaagacgagtatggattcgatcaaaagggcaccatcacaattccttgtcacgtggaggagtttcgttacgttcaagctttgatagatggagagagatcagtttacaatggtaacaaccatcatcatagacatggtggccgtgaccagtatcatcatcttgttggatgcttcagagcttga

SEQ ID NO: 1987 - protein, 121 aa, Arabidopsis thaliana
  misc_feature (1)..(121): useful for making plants with increased cold tolerance as described in USSN 12/514,991
  misc_feature (1)..(121): Ceres ME LINE ME12470
  misc_feature (1)..(91): Pfam Name: Auxin_inducible Pfam Description: Auxin responsive protein
  misc_feature (1)..(121): Score of 157.7 for HMM of FIGURE 1 of USSN 12/514,991.
  misc_feature (1)..(121): Functional Homolog Of Ceres SEEDLINE ID no. ME12469
MGTGEKTLKSFQLHRKQSVKVKDVPKGCLAIKVGSQGEEQQRFIVPVLYFNHPLFMQLLKEAEDEYGFDQKGTITIPCHVEEFRYVQALIDGERSVYNGNNHHHRHGGRDQYHHLVGCFRA

SEQ ID NO: 1988 - DNA, 435 bp, Populus balsamifera subsp. trichocarpa
  misc_feature (1)..(435): useful for making plants with increased cold tolerance as described in USSN 12/514,991
  misc_feature (1)..(435): Ceres ANNOT ID no.1471378
  misc_feature (1)..(435): Encodes the peptide sequence given in  SEQ ID NO. 153
atggcaaacgtaccaaggtccctcacatactcttctccagccctcttcaaccaagccgtgacagcagatccttggccatcttcctttgttttagatattattatgggtagtggagaaaagagtctgaggaactttcacctacacctgcctcatcttcaccatcacaagaagcaagcgagagatgttccgaaagggtgtttggcaatcaaggtgggtcagggagaggagcaacagagatttgtagtgcctgtcatatacttcaatcacccgctcttcatacagttattgaaggaagcagaagaagaatatggctttgatcaaaaaggcaccatcagtatcccttgtcatgtggaggagtttaggaacgttcaaggcatgattgacagggaaaagtccattcaccatcaccatcttgttggatgttttagggcttga

SEQ ID NO: 1989 - protein, 110 aa, Populus balsamifera subsp. trichocarpa
  misc_feature (1)..(110): useful for making plants with increased cold tolerance as described in USSN 12/514,991
  misc_feature (1)..(110): Ceres ANNOT ID no.1471378
  misc_feature (1)..(94): Pfam Name: Auxin_inducible Pfam Description: Auxin responsive protein
  misc_feature (1)..(110): Score of 127.7 for HMM of FIGURE 1 of USSN 12/514,991.
  misc_feature (1)..(110): Functional Homolog Of Ceres SEEDLINE ID no. ME12469
MGSGEKSLRNFHLHLPHLHHHKKQARDVPKGCLAIKVGQGEEQQRFVVPVIYFNHPLFIQLLKEAEEEYGFDQKGTISIPCHVEEFRNVQGMIDREKSIHHHHLVGCFRA

SEQ ID NO: 1990 - protein, 105 aa, Medicago truncatula
  misc_feature (1)..(105): useful for making plants with increased cold tolerance as described in USSN 12/514,991
  misc_feature (1)..(105): Public GI no. 92897061
  misc_feature (23)..(89): Pfam Name: Auxin_inducible Pfam Description: Auxin responsive protein
  misc_feature (1)..(105): Score of 116.8 for HMM of FIGURE 1 of USSN 12/514,991.
  misc_feature (1)..(105): Functional Homolog Of Ceres SEEDLINE ID no. ME12469
MGSGERSFKGFLLHGKKQEFRGVPKGCLAIKVGQGEDQQRFVVPVIYFNHPLFMQLLKEAEEEYGFDHKGAITIPCRVEEFRNIRGLIDREKSLHHNHHVGCFGF

SEQ ID NO: 1991 - protein, 131 aa, Glycine max
  misc_feature (1)..(131): useful for making plants with increased cold tolerance as described in USSN 12/514,991
  misc_feature (1)..(131): Ceres CLONE ID no. 622274
  misc_feature (32)..(113): Pfam Name: Auxin_inducible Pfam Description: Auxin responsive protein
  misc_feature (1)..(131): Score of 100.8 for HMM of FIGURE 1 of USSN 12/514,991.
  misc_feature (1)..(131): Functional Homolog Of Ceres SEEDLINE ID no. ME12469
  misc_feature (44)..(44): Xaa is any aa, unknown or other
  misc_feature (90)..(90): Xaa is any aa, unknown or other
MGILSDHHNQKHHHHHHHLMSFHLHIPHLQYFHHHQQQEKKEDXKDIPKGCLAILVGQGEEQQRFVIPVMYMNHPLFMQLLKKAEEEYGXDQKGPITIPCHVEHFRSVQGLIDKDKSLHHGHHHHAWCFKV

SEQ ID NO: 1992 - DNA, 1037 bp, Panicum virgatum
  misc_feature (1)..(1037): useful for making plants with increased cold tolerance as described in USSN 12/514,991
  misc_feature (1)..(1037): Ceres CLONE ID no.1802445
  misc_feature (1)..(1037): Encodes the peptide sequence given in  SEQ ID NO. 157
ccccgcagagacccctcgatcgagccaaacaaaagccaagaagaatccagccggccgtgtcgcgccgagccaacaagcacacgcgcctcgccctccccagcgcacaccaaccacagcctcctcctcgccgccatgcagcagcagccgcgccgccgcgcctccccggccgcgtcgctctgacgtgcggcgccgtcgtccgtcctctcgaccgtgctgccatctgtccgatcgatcgatccatgggggttcacctgcagctgctgaagaagcagccctcgtcggcgtcgctggagggctcgaggagcggggggtcgtcgccgccgatgccgcccaaggggtgcatggcggtgcgcgtggtggggcctggcggcggggaggaggaagaggaggagcgtttcgtggtgccggtggggtacctgaagcacccgctgttcgtggcgctgctcaaggcggcggaggacgagtacggcttcgagcagaagggcgccatcaccatcccctgcggcgtcgaccacttccgccacgtccagggcatcatccaacaccagaagcaccaccaccacatctcatccggcttcgtctccggcgacggcggccaccatggccaccacaacaacaaccaccacttccacatcgctgggtgcttccgcgcctgatgcgatgcgggttcgagatctccagcggatgcatggatccaaaaacaataatacatagtacctattttatttaggttttttgtcttgattattagtactttttagatgcaggcaagccgcggatcgtatgatcgaaggatcgtggatcgtggttggttgcttgagttattagcgtaatcgtggatctgcaggtttggatggatgggtcgatcgatcattagagttagtttttctctaggtttcttatgatgatgatgaaaaggaaatcaaagaatcgtcgatcattagagttagtttttctctaggtttcttatgatgatgatgaaaaggaaatcaaagaatcgttcatgtttcagtgttcaaaaaaaaaaaaaaaaaaaa

SEQ ID NO: 1993 - protein, 138 aa, Panicum virgatum
  misc_feature (1)..(138): useful for making plants with increased cold tolerance as described in USSN 12/514,991
  misc_feature (1)..(138): Ceres CLONE ID no. 1802445
  misc_feature (31)..(101): Pfam Name: Auxin_inducible Pfam Description: Auxin responsive protein
  misc_feature (1)..(138): Score of 100.5 for HMM of FIGURE 1 of USSN 12/514,991.
  misc_feature (1)..(138): Functional Homolog Of Ceres SEEDLINE ID no. ME12469
MGVHLQLLKKQPSSASLEGSRSGGSSPPMPPKGCMAVRVVGPGGGEEEEEERFVVPVGYLKHPLFVALLKAAEDEYGFEQKGAITIPCGVDHFRHVQGIIQHQKHHHHISSGFVSGDGGHHGHHNNNHHFHIAGCFRA

SEQ ID NO: 1994 - DNA, 788 bp, Arabidopsis thaliana
  misc_feature (1)..(788): useful for making plants with increased cold tolerance as described in USSN 12/514,991
  misc_feature (1)..(788): Ceres ME LINE ME14040
  misc_feature (1)..(788): Encodes the peptide sequence given in  SEQ ID NO. 159
accaagaaagttagtttctcaattcctgataaaacatacacaaaacaataatcttaatttcaagaaactactactattgctaaaaatcagagactttcgctaatggctatattcggtaaactgacaaagctcaagtctgccataaagaaatggccttccttgaccaagaaccaccattcaaccatgtgtaccgcctctaccgccgtatctgaggtctcaaagtgcgaggatctccatgtggtttacgtcggaaagtcacgaagaccttacatgcttagttcccacgtcatcgctcatccgcttttccaagaactacttgaccggtcgtctagatttatcgaagaacgtcacgaccaagagaccgtcttagtagcttgcgaagtcgtattgttcgagcacttgttatggatgctcaaaaacagttcctctgatcacggcgatgaggatgatcgcgaaagaggatccgtcgaggagttggctgagttctatacttattgacggcgcgatacatatccatatatacttttatttcgttaattttggaatttgattcgacatgatccaataatgcggtcatgcacagaccattttctttgcttttgtttttctcccgagcaaatttttagagttaactagtaatctttaactaatattataattatgtcggtcgaaagagggtagtagtatcttgccccaaatgatgataaattgtaacatatgctaaaattgttttttatgattagctccatttgatatacatgtactctacagtagtacgtagttatgag

SEQ ID NO: 1995 - protein, 131 aa, Arabidopsis thaliana
  misc_feature (1)..(131): useful for making plants with increased cold tolerance as described in USSN 12/514,991
  misc_feature (1)..(131): Ceres ME LINE ME14040
  misc_feature (7)..(105): Pfam Name: Auxin_inducible Pfam Description: Auxin responsive protein
  misc_feature (1)..(131): Score of 145.8 for HMM of FIGURE 1 of USSN 12/514,991.
  misc_feature (1)..(131): Functional Homolog Of Ceres SEEDLINE ID no. ME12469
MAIFGKLTKLKSAIKKWPSLTKNHHSTMCTASTAVSEVSKCEDLHVVYVGKSRRPYMLSSHVIAHPLFQELLDRSSRFIEERHDQETVLVACEVVLFEHLLWMLKNSSSDHGDEDDRERGSVEELAEFYTY

SEQ ID NO: 1996 - DNA, 961 bp, Panicum virgatum
  misc_feature (1)..(961): useful for making plants with increased cold tolerance as described in USSN 12/514,991
  misc_feature (1)..(961): Ceres CLONE ID no.1767463
  misc_feature (1)..(961): Encodes the peptide sequence given in  SEQ ID NO. 161
gcctgcgttcccaatcatcgccaccgtctccctcaatcccctctccccaaaacctctccgcttcattcgtgaactgcgcgtgcgcgtgtcgctggccgccgccgccgctccccgtgcatgcgtccgagctctaggaaggaggaggccgaggggagtcgaccggccgatcgatcgattcatcgatggcgaagggcgggctgagtaagctgcggtgcatgatccggaggtggcactcgtccagccgcatcgcgcgcgcgccgtcgcccggcgaggacggccacgccggcggcggcggcggcgacgcccggggcgcgtcgttccacggcgcggacgaggtgcccaagggcctgcacccggtctacgtcggcaagtcgcgccgccggtacctcatcgccgaggagctcgtgggccacccgctgttccagtccctcgtccaccgcgccggcggcggcggcgccgaggccggctgcaccgtcgtcggctgcgaggtcgtcctcttcgagcacctcctgtggatgctcgagaacgcggacccgcagccggagtccctcgacgagctcgtcgagtactacgcgtgctgaccggccagagccgccgcgcccggtcccggacgccggggttggaagcttctggaaacagcacatggctgcggcggatcgtcctgcgatccgcgtggtttgagcagtagcggtagagtgtcgtcgtggcaagctccgaacgccggcgggacggcaaggcgtaagcccaagaaccctgctcctccggcgccgtcgatccggttccattcttctttaatcgcttcgtgtaattgacttccctttcattttgcttctcgattcttttctttccccttccttctgtcagtaagggtctagctggcagagcgcgtccatgtacattgcaaatcgcgacagaaatcgcccatttcgttcctctgaattaaaaaaaaaaaaaaaaaaaa

SEQ ID NO: 1997 - protein, 132 aa, Panicum virgatum
  misc_feature (1)..(132): useful for making plants with increased cold tolerance as described in USSN 12/514,991
  misc_feature (1)..(132): Ceres CLONE ID no. 1767463
  misc_feature (12)..(114): Pfam Name: Auxin_inducible Pfam Description: Auxin responsive protein
  misc_feature (1)..(132): Score of 58.1 for HMM of FIGURE 1 of USSN 12/514,991.
  misc_feature (1)..(132): Functional Homolog Of Ceres SEEDLINE ID no. ME12469
MAKGGLSKLRCMIRRWHSSSRIARAPSPGEDGHAGGGGGDARGASFHGADEVPKGLHPVYVGKSRRRYLIAEELVGHPLFQSLVHRAGGGGAEAGCTVVGCEVVLFEHLLWMLENADPQPESLDELVEYYAC

SEQ ID NO: 1998 - DNA, 829 bp, Arabidopsis thaliana
  misc_feature (1)..(829): useful for making plants with increased cold tolerance as described in USSN 12/514,991
  misc_feature (1)..(829): Ceres ME LINE ME16427
  misc_feature (1)..(829): Encodes the peptide sequence given in  SEQ ID NO. 163
tttagcgtttacacagccacaaattcctcaatactctatatttctcttcccgtttgaaactccaaagcttgtttgatgaaaacagagtaaacggttctgttcaaaacatttttcaagctctgttactttgttttttcaacgatgaggaagttaagaggaatcaaaattagaagaccgattaaacaaatctcaagatggatcctccggagaattaagattcgtcgttcaagatacacccggttaagcccaaaccgcccggtttgcaagccgagagccatcacaaaactcataagttggggtcgaagtctcacatcccacagcgccaggtttattgggtctaaatgctccaattcagggtacataccaattggtcaagaacccattcgagaaaagcccgacccggttccgaaaggtcactcggcggtttacatcggtaaaaaagacggcgactttcagagagttttggtgcctatcgtttactttaaccatcctctgtttggtgagcttcttagagaggctgaagaagaatttgggttttctcaagaaggtggaatcactatcccttgtccttactcagatttcaaacgggtccaaacccgaattgaatccgggtcgggtttctgtaaatttccctggagccggcggtggcaataacgacggtggaagaagatgatgatgatgaaaaagttctttaactcttttttactattttctaccttttcacttttgttactatttttacccttttgttagatatgtacatattctgtatgtgaaaagtgaggtttgaatttaggcgataatgtaaataatatagagattttttatt

SEQ ID NO: 1999 - protein, 170 aa, Arabidopsis thaliana
  misc_feature (1)..(170): useful for making plants with increased cold tolerance as described in USSN 12/514,991
  misc_feature (1)..(170): Ceres ME LINE ME16427
  misc_feature (86)..(155): Pfam Name: Auxin_inducible Pfam Description: Auxin responsive protein
  misc_feature (1)..(170): Score of 167.1 for HMM of FIGURE 1 of USSN 12/514,991.
  misc_feature (1)..(170): Functional Homolog Of Ceres SEEDLINE ID no. ME12469
MRKLRGIKIRRPIKQISRWILRRIKIRRSRYTRLSPNRPVCKPRAITKLISWGRSLTSHSARFIGSKCSNSGYIPIGQEPIREKPDPVPKGHSAVYIGKKDGDFQRVLVPIVYFNHPLFGELLREAEEEFGFSQEGGITIPCPYSDFKRVQTRIESGSGFCKFPWSRRWQ

SEQ ID NO: 2000 - DNA, 516 bp, Populus balsamifera subsp. trichocarpa
  misc_feature (1)..(516): useful for making plants with increased cold tolerance as described in USSN 12/514,991
  misc_feature (1)..(516): Ceres ANNOT ID no.1497025
  misc_feature (1)..(516): Encodes the peptide sequence given in  SEQ ID NO. 165
atgagaaagaatagaggtttcaagatcggcaaacggtttgtccggatctcaacttggatcttcagtcggacgcggatccacccaccgggttgcaactccataggcccatcagaatcaacatgcagttcgaagtcaaagtccttatcgaaaatcatcaattggggccgtcgtttaacaaaaggagctaaatcaatttgcagtgcaaaaccccggtcgggttatatacccgtgggtcatgaaccggtttgtgataaacctgttccagtaccaaaagggcatttggctgtttatgtgggtcaaaaagatggtgagtttcatagagttttggtgcctttgatttattttaatcaccctttgtttggtgaattattaagagaagcagaagaggaatatggttttaatcaacaaggtgggattaccattccttgccggttttcggagtttgagagggtccaaacccggattaaatcggggtcatgtggaaggaagctgacgtggaaacgtaaccaccattga

SEQ ID NO: 2001 - protein, 171 aa, Populus balsamifera subsp. trichocarpa
  misc_feature (1)..(171): useful for making plants with increased cold tolerance as described in USSN 12/514,991
  misc_feature (1)..(171): Ceres ANNOT ID no.1497025
  misc_feature (54)..(156): Pfam Name: Auxin_inducible Pfam Description: Auxin responsive protein
  misc_feature (1)..(171): Score of 141 for HMM of FIGURE 1 of USSN 12/514,991.
  misc_feature (1)..(171): Functional Homolog Of Ceres SEEDLINE ID no. ME12469
MRKNRGFKIGKRFVRISTWIFSRTRIHPPGCNSIGPSESTCSSKSKSLSKIINWGRRLTKGAKSICSAKPRSGYIPVGHEPVCDKPVPVPKGHLAVYVGQKDGEFHRVLVPLIYFNHPLFGELLREAEEEYGFNQQGGITIPCRFSEFERVQTRIKSGSCGRKLTWKRNHH

SEQ ID NO: 2002 - protein, 162 aa, Glycine max
  misc_feature (1)..(162): useful for making plants with increased cold tolerance as described in USSN 12/514,991
  misc_feature (1)..(162): Ceres CLONE ID no. 1120595
  misc_feature (36)..(147): Pfam Name: Auxin_inducible Pfam Description: Auxin responsive protein
  misc_feature (1)..(162): Score of 124.3 for HMM of FIGURE 1 of USSN 12/514,991.
  misc_feature (1)..(162): Functional Homolog Of Ceres SEEDLINE ID no. ME12469
MSKNRGFNLRRRLIRVSKWIFRKIRTRAPREYHCLGDSPPSPMVKLLTWGRKLTAGAKSRLKVASGSGYAQLGTDPDPSVPKGHLAVYVGQKDGELHRVLVPVIYFNHPLFGELLKQAEEEFGFHHEGGITIPCRFTEFERVKTRIASGSRRGTRPKRLAWR

SEQ ID NO: 2003 - DNA, 489 bp, Arabidopsis thaliana
  misc_feature (1)..(489): useful for making plants with increased cold tolerance as described in USSN 12/514,991
  misc_feature (1)..(489): Ceres ME LINE ME10853
  misc_feature (1)..(489): Encodes the peptide sequence given in  SEQ ID NO. 168
atgaggaagatcatagggtttagaatcgggagacgagtctcaagatggatctttcgcaaaacccggatccaacgttcaggatacaaccggatacactcgacccagcaagcttgcatgctgatgagaccattagccaaactcaaaagttggggccaacgtctcaagcaaagtttcagacgcaggtctacgagaagatccgcatacatacccgttgatcataagaaagccgacccggttccaaggggacacttagctatctacgtgggtcaaaaagacggcgactgtcatagagttttggtacccatcgtttactttaaccatcctttgttcggtgagctgcttcgagaagccgaaaaagagtacggattttgccacgaaggaggtatcactattccttgtctgtattcagatttcgaacgggtcaagacccggatcgcatcggggtcaagttctcgggtatttccatggggccgtcattgccgcaattga

SEQ ID NO: 2004 - protein, 162 aa, Arabidopsis thaliana
  misc_feature (1)..(162): useful for making plants with increased cold tolerance as described in USSN 12/514,991
  misc_feature (1)..(162): Ceres ME LINE ME10853
  misc_feature (37)..(146): Pfam Name: Auxin_inducible Pfam Description: Auxin responsive protein
  misc_feature (1)..(162): Score of 168.7 for HMM of FIGURE 1 of USSN 12/514,991.
  misc_feature (1)..(162): Functional Homolog Of Ceres SEEDLINE ID no. ME12469
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 2005 - protein, 168 aa, Glycine max
  misc_feature (1)..(168): useful for making plants with increased cold tolerance as described in USSN 12/514,991
  misc_feature (1)..(168): Ceres CLONE ID no. 1659056
  misc_feature (39)..(150): Pfam Name: Auxin_inducible Pfam Description: Auxin responsive protein
  misc_feature (1)..(168): Score of 112.5 for HMM of FIGURE 1 of USSN 12/514,991.
  misc_feature (1)..(168): Functional Homolog Of Ceres SEEDLINE ID no. ME12469
MQFRLGRRVVRVAKWVFGRVRIKTRPGYHHRLGSGSSHLRNPIIKLLTWGQKLKRGAKTLCGKKGSGYLPIGSDPACDRAPAVPKGHLAVYVGEEDGEFRRVLIPVIYFNHPLFSDLLREAEKKFGFEHPGGITIPCRLTEFERVKTRIASGSGQRGRTRRLGWRLHY

SEQ ID NO: 2006 - DNA, 502 bp, Arabidopsis thaliana
  misc_feature (1)..(502): useful for making plants with increased cold tolerance as described in USSN 12/514,991
  misc_feature (1)..(502): Ceres ME LINE ME02978
  misc_feature (1)..(502): Encodes the peptide sequence given in  SEQ ID NO. 171
atatacttttcaaacagacaaaaaaaaacctcaaaaaaaggaaaatatcactttatcttttagcatgacgaggcaaagaatgattacaattgagtcgccgaagaagaaaatgggtggaattgtgaagctcaagaatgttgtagagaggctggtgcaaatcaaaggcttttcctcggccaagaaaccgtgtcctgaagaatacggccgagattgtgtcccaaaagacgtaaaggaaggtcacttcgcggtgatagctgttgatgggtatcatgagcctacacaaagatttgttgtcccattgatgtttctagaacaccctatgttccgtaagcttctagaacaagcagaggaggaatacgggttctatcacgatggagcgctaatggtaccttgccggccaagccacctacggatgatattgaccgagcaatggtgttagaatttatgctgtagttaattactgatcaacgtcatattacataataataccgaattattcacc

SEQ ID NO: 2007 - protein, 124 aa, Arabidopsis thaliana
  misc_feature (1)..(124): useful for making plants with increased cold tolerance as described in USSN 12/514,991
  misc_feature (1)..(124): Ceres ME LINE ME02978
  misc_feature (22)..(111): Pfam Name: Auxin_inducible Pfam Description: Auxin responsive protein
  misc_feature (1)..(124): Score of 146.7 for HMM of FIGURE 1 of USSN 12/514,991.
  misc_feature (1)..(124): Functional Homolog Of Ceres SEEDLINE ID no. ME12469
MTRQRMITIESPKKKMGGIVKLKNVVERLVQIKGFSSAKKPCPEEYGRDCVPKDVKEGHFAVIAVDGYHEPTQRFVVPLMFLEHPMFRKLLEQAEEEYGFYHDGALMVPCRPSHLRMILTEQWC

SEQ ID NO: 2008 - DNA, 873 bp, Arabidopsis thaliana
  misc_feature (1)..(873): useful for making plants with increased cold tolerance as described in USSN 12/514,991
  misc_feature (1)..(873): Ceres ME LINE ME05746
  misc_feature (1)..(873): Encodes the peptide sequence given in  SEQ ID NO. 173
cccctgacattttctttctctcacaaagaaaaccaaatcactaaaccggaaaaaatggctggaggtctcgggaaatgcagcaagatccgtcacattgtgaggctaaggcaaatgcttcgacggtggcgcgatcaagcgaggatgtcttcttctttcagccgttgtgtaccgtcggatttaccgtcaggacacgtggcggtctacgtaggaagcagttgtaggagatttgtggtgcgcgcgacgtatctgaaccatcctgtcctaaggaaccttcttgttcaagctgaggaagagtttggtttcgttaaccaaggtccgttggttatcccttgtgaagaatcggttttcgaggaatcgattcggtttatatcccggtctgattcgacccggtcaagacggtttacttgtcccgatgattttcagaagaattgccacgtggtgggaatcagaagcaagcctgatctatggatcgaatctcgaccgttacttcacggcgttactgaaaaagccgtttggtgatgtcacttgacggcgttcgtacgtatagagtaaatagacaataaaatgagagagccgattctgactcggtttgactcggaacgagtttacgagccgaaaatgttattggagacaattttgcggctgagtttgactcggattctttttttctctatttctttattggtgaggcggcgagttttattggtggtggctcggagatggccgtgaaaggtgggtgagtcattctaccgagtcgtcccgggttcgaatattcgttcaaggacgtagtatggaagtaaatgttattcaaattggttgtaaatttccattaaattggagaaatcattattgttggataaattataatattct

SEQ ID NO: 2009 - protein, 154 aa, Arabidopsis thaliana
  misc_feature (1)..(154): useful for making plants with increased cold tolerance as described in USSN 12/514,991
  misc_feature (1)..(154): Ceres ME LINE ME05746
  misc_feature (7)..(106): Pfam Name: Auxin_inducible Pfam Description: Auxin responsive protein
  misc_feature (1)..(154): Score of 243.4 for HMM of FIGURE 1 of USSN 12/514,991.
  misc_feature (1)..(154): Functional Homolog Of Ceres SEEDLINE ID no. ME12469
MAGGLGKCSKIRHIVRLRQMLRRWRDQARMSSSFSRCVPSDLPSGHVAVYVGSSCRRFVVRATYLNHPVLRNLLVQAEEEFGFVNQGPLVIPCEESVFEESIRFISRSDSTRSRRFTCPDDFQKNCHVVGIRSKPDLWIESRPLLHGVTEKAVW

SEQ ID NO: 2010 - DNA, 450 bp, Populus balsamifera subsp. trichocarpa
  misc_feature (1)..(450): useful for making plants with increased cold tolerance as described in USSN 12/514,991
  misc_feature (1)..(450): Ceres ANNOT ID no.1452837
  misc_feature (1)..(450): Encodes the peptide sequence given in  SEQ ID NO. 175
atggcagctgggcaagcaaaatgcaccaaaatccgccacatagtgaggcttcgccaaatgctaagacgttggcgcaacaaggcacgcatgtcagccaatcgcataccatcagacgttccagcaggacatgtggcagtctgtgtagggactagttgccggagatttgtggtgcgagcgacgtacttgaaccaccccatctttaaaaagctcctggtacaagccgaggaagagtttggcttttctaaccaaggcccattagtgatcccgtgcgatgaggccgtttttgaggaagtgattcgatacatttcacggtctgagaatggaaagtccggccggtttgtgaaccttgaggatttgcagagatactgccacgttggtgttaaaaatgctaagcttgatttttggaccgattcaagacctttgcttcatgctgacaagacattctggtaa

SEQ ID NO: 2011 - protein, 149 aa, Populus balsamifera subsp. trichocarpa
  misc_feature (1)..(149): useful for making plants with increased cold tolerance as described in USSN 12/514,991
  misc_feature (1)..(149): Ceres ANNOT ID no.1452837
  misc_feature (11)..(103): Pfam Name: Auxin_inducible Pfam Description: Auxin responsive protein
  misc_feature (1)..(149): Score of 174.1 for HMM of FIGURE 1 of USSN 12/514,991.
  misc_feature (1)..(149): Functional Homolog Of Ceres SEEDLINE ID no. ME12469
MAAGQAKCTKIRHIVRLRQMLRRWRNKARMSANRIPSDVPAGHVAVCVGTSCRRFVVRATYLNHPIFKKLLVQAEEEFGFSNQGPLVIPCDEAVFEEVIRYISRSENGKSGRFVNLEDLQRYCHVGVKNAKLDFWTDSRPLLHADKTFW

SEQ ID NO: 2012 - DNA, 619 bp, Arabidopsis thaliana
  misc_feature (1)..(619): useful for making plants with increased cold tolerance as described in USSN 12/514,991
  misc_feature (1)..(619): Ceres ME LINE ME06899
  misc_feature (1)..(619): Encodes the peptide sequence given in  SEQ ID NO. 177
agacagtaacatactaaccgtatacacaacggtattatattggtaaacatatcaaagctctctatatgtctctgaagaaaagatcttgctcgaggcttagactcaccgatttgatggagaagtggaggaagtgtaagaaaggacacttcgctgtgtataccagagaaggcaggaggtttgttttacccttggattatctcaaacatccaatctttcaggtcttattggagatggcagaggaagagtttggctccactatttgtggccctttacaggttccttgcgacggaggtttgatggatcacatcctcatgttgttgaggaacaagagtttgtctgaccatgatgatgatggtggtgatgatggtgtgaagaagacgatgaaccaggatgtgtcccccatgagcacgtcgtgcaagggagcttcatcggtttcatatttcttccctctctttcgttgcaacgcagcccatgatcagagcaagctccagtctctagttttttaacagtttatggttgtggagagcgctttttatacacaaaaatcttttctgtttgtatataaatagaaacagagattctctataaaccttcagtttgtatatcattattcattttt

SEQ ID NO: 2013 - protein, 146 aa, Arabidopsis thaliana
  misc_feature (1)..(146): useful for making plants with increased cold tolerance as described in USSN 12/514,991
  misc_feature (1)..(146): Ceres ME LINE ME06899
  misc_feature (25)..(86): Pfam Name: Auxin_inducible Pfam Description: Auxin responsive protein
  misc_feature (1)..(146): Score of 180.3 for HMM of FIGURE 1 of USSN 12/514,991.
  misc_feature (1)..(146): Functional Homolog Of Ceres SEEDLINE ID no. ME12469
MSLKKRSCSRLRLTDLMEKWRKCKKGHFAVYTREGRRFVLPLDYLKHPIFQVLLEMAEEEFGSTICGPLQVPCDGGLMDHILMLLRNKSLSDHDDDGGDDGVKKTMNQDVSPMSTSCKGASSVSYFFPLFRCNAAHDQSKLQSLVF

SEQ ID NO: 2014 - protein, 117 aa, Zea mays
  misc_feature (1)..(117): useful for making plants with increased cold tolerance as described in USSN 12/514,991
  misc_feature (1)..(117): Ceres CLONE ID no. 363017
  misc_feature (1)..(95): Pfam Name: Auxin_inducible Pfam Description: Auxin responsive protein
  misc_feature (1)..(117): Score of 48.8 for HMM of FIGURE 1 of USSN 12/514,991.
  misc_feature (1)..(117): Functional Homolog Of Ceres SEEDLINE ID no. ME12469
MMSSLKLTEVVSKRWGGGGSSSKVTSPSAAACPRGHFAAYTREGRRFFVPIAYLASDTFRELLSMAEEEFGEPGARPIVLPCSASHLEQILDAFRSGGGAKKKKKEKESAGRISKIW

SEQ ID NO: 2015 - protein, 125 aa, Medicago truncatula
  misc_feature (1)..(125): useful for making plants with increased cold tolerance as described in USSN 12/514,991
  misc_feature (1)..(125): Public GI no. 92870927
  misc_feature (18)..(83): Pfam Name: Auxin_inducible Pfam Description: Auxin responsive protein
  misc_feature (1)..(125): Score of 92.3 for HMM of FIGURE 1 of USSN 12/514,991.
  misc_feature (1)..(125): Functional Homolog Of Ceres SEEDLINE ID no. ME12469
MACMWRKNACSGKKLPSDVPRGHLAVTVGETNRRFVIRADYLNHPVLQELLDQAYEGYGFNKSGPLSIPCDEFLFEDILLSLGGGTVARRSSSPVLTKKLDLSFLKDAVPLLEAFDSKRSNNYKN

SEQ ID NO: 2016 - protein, 140 aa, Oryza sativa subsp. japonica
  misc_feature (1)..(140): useful for making plants with increased cold tolerance as described in USSN 12/514,991
  misc_feature (1)..(140): Public GI no. 52076006
  misc_feature (1)..(102): Pfam Name: Auxin_inducible Pfam Description: Auxin responsive protein
  misc_feature (1)..(140): Score of 46.4 for HMM of FIGURE 1 of USSN 12/514,991.
  misc_feature (1)..(140): Functional Homolog Of Ceres SEEDLINE ID no. ME12469
MISAKRLVQLAKWQRMAALGRKRIMGKAQETEECSTSVAVKGHCVMYTADGRRFEVPLAYLGTVVFSELLRMSQEEFGFTSDGRIVLPCDAAEMEYAMCLLKRNPSVEVVDALLSSMLIRCHCTGSMVPTVGVNQQISCL

SEQ ID NO: 2017 - DNA, 447 bp, Populus balsamifera subsp. trichocarpa
  misc_feature (1)..(447): useful for making plants with increased cold tolerance as described in USSN 12/514,991
  misc_feature (1)..(447): Ceres ANNOT ID no.1513814
  misc_feature (1)..(447): Encodes the peptide sequence given in  SEQ ID NO. 182
atgatcagtgccaagaagctcgtcaaattggcaagaaaatggcagaaactggctgccattagtagaaaaaggctaacgtttccgcaaacaattagcagtcttgattcggatgactgcagcacatcatcaacagcagagaagggtcactttgtggtgtacaccactgacaaaaaacgttttgtgcttcccttggattaccttaacaatgaaattgttaaagagctattcaatctagcagaagaagagtttggattgacaagcaatggacccctcgccttgccatgtgatgctgccttcatggaatatgcaatcaccatgatcaagaagaatgtggctaaagatgtagagaaagcattgctgattaccttagctagcaatcgatgctcatcatctttgaattttcatcgagatgtaacaaatcaacagttgtcaattcttagcttttga

SEQ ID NO: 2018 - protein, 148 aa, Populus balsamifera subsp. trichocarpa
  misc_feature (1)..(148): useful for making plants with increased cold tolerance as described in USSN 12/514,991
  misc_feature (1)..(148): Ceres ANNOT ID no.1513814
  misc_feature (43)..(108): Pfam Name: Auxin_inducible Pfam Description: Auxin responsive protein
  misc_feature (1)..(148): Score of 63 for HMM of FIGURE 1 of USSN 12/514,991.
  misc_feature (1)..(148): Functional Homolog Of Ceres SEEDLINE ID no. ME12469
MISAKKLVKLARKWQKLAAISRKRLTFPQTISSLDSDDCSTSSTAEKGHFVVYTTDKKRFVLPLDYLNNEIVKELFNLAEEEFGLTSNGPLALPCDAAFMEYAITMIKKNVAKDVEKALLITLASNRCSSSLNFHRDVTNQQLSILSF

SEQ ID NO: 2019 - protein, 144 aa, Musa acuminata
  misc_feature (1)..(144): useful for making plants with increased cold tolerance as described in USSN 12/514,991
  misc_feature (1)..(144): Ceres CLONE ID no. 1712560
  misc_feature (10)..(107): Pfam Name: Auxin_inducible Pfam Description: Auxin responsive protein
  misc_feature (1)..(144): Score of 73.9 for HMM of FIGURE 1 of USSN 12/514,991.
  misc_feature (1)..(144): Functional Homolog Of Ceres SEEDLINE ID no. ME12469
MLSPRRLLEIARKWRKMAALGQKRISWPRKDASRESNTKNTSIANRGHFVVYTSEGRRFTVPLAFLSARMFQELLRLSEEEFGFSGDGPISLPCDAVFLEYVLSLLKKRGPKDAEREMLIFGFMRQCSRSSLDKVGNSQQLAVF

SEQ ID NO: 2020 - protein, 146 aa, Capsicum annuum
  misc_feature (1)..(146): useful for making plants with increased cold tolerance as described in USSN 12/514,991
  misc_feature (1)..(146): Public GI no. 20149052
  misc_feature (15)..(108): Pfam Name: Auxin_inducible Pfam Description: Auxin responsive protein
  misc_feature (1)..(146): Score of 63.4 for HMM of FIGURE 1 of USSN 12/514,991.
  misc_feature (1)..(146): Functional Homolog Of Ceres SEEDLINE ID no. ME12469
MLSAKKLIKMARRWQKFAAKQRKRISFPRNNSNADGCSTPSSSIVEKGHFVVYTIDQTRYVFPLTYLENEVVMQLLNMSEEEFGLPSGGPITLPCDSSFMDYIISLIKKGVAAEDLHNAILLSIPSCCCSTSSCHQESGNQQIFVC

SEQ ID NO: 2021 - protein, 139 aa, Triticum aestivum
  misc_feature (1)..(139): useful for making plants with increased cold tolerance as described in USSN 12/514,991
  misc_feature (1)..(139): Ceres CLONE ID no. 699585
  misc_feature (9)..(99): Pfam Name: Auxin_inducible Pfam Description: Auxin responsive protein
  misc_feature (1)..(139): Score of 46.4 for HMM of FIGURE 1 of USSN 12/514,991.
  misc_feature (1)..(139): Functional Homolog Of Ceres SEEDLINE ID no. ME12469
MTMIHPKRLAQLVRKWQRVKSVARDDEACCTTSPVADKGHCAMYTVDGRRFEVPLAYLGTTVFGELLRMSQEEFGFTCDSRITLPFDAVVMEYVMCLLRRNASEEVERAFLSSVVMPCQYPSCTVPHVVLHQQLAVCSS

SEQ ID NO: 2022 - protein, 141 aa, Oryza sativa subsp. japonica
  misc_feature (1)..(141): useful for making plants with increased cold tolerance as described in USSN 12/514,991
  misc_feature (1)..(141): Public GI no. 52076007
  misc_feature (1)..(103): Pfam Name: Auxin_inducible Pfam Description: Auxin responsive protein
  misc_feature (1)..(141): Score of 50.8 for HMM of FIGURE 1 of USSN 12/514,991.
  misc_feature (1)..(141): Functional Homolog Of Ceres SEEDLINE ID no. ME12469
MISAKRLVQLAKKWQRMAALGRKRVMAAAQETEECSTSVAVKGHCVMYTADGRRFEVPLVYLGMRVFIELLRMSQEEFGFTSDGRIMLPCDAAEMEYAMCLLKRNASADVVNALLSSMLTSCRYTGSMIPTVGASQHICCL

SEQ ID NO: 2023 - protein, 149 aa, Glycine max
  misc_feature (1)..(149): useful for making plants with increased cold tolerance as described in USSN 12/514,991
  misc_feature (1)..(149): Ceres CLONE ID no. 593450
  misc_feature (46)..(107): Pfam Name: Auxin_inducible Pfam Description: Auxin responsive protein
  misc_feature (1)..(149): Score of 55.6 for HMM of FIGURE 1 of USSN 12/514,991.
  misc_feature (1)..(149): Functional Homolog Of Ceres SEEDLINE ID no. ME12469
MISANRLIEMARKWQKMAVGNRKRISYPPRNHNNIVHMHYSSTANKGHFVVYSVDHKRFEVPLKYLSTNVFRELLDWSEEEFGLPSNGPITLPCDSVFLDYVISLIRERVPEEVEKALITSMVACHHEASSSSSRGLRQSNEPMIIYGF

SEQ ID NO: 2024 - DNA, 697 bp, Panicum virgatum
  misc_feature (1)..(697): useful for making plants with increased cold tolerance as described in USSN 12/514,991
  misc_feature (1)..(697): Ceres CLONE ID no.1759951
  misc_feature (1)..(697): Encodes the peptide sequence given in  SEQ ID NO. 189
acacacgaatcgaattgtttctaaccatttcatctcaaagacaagagtccatttgcttgaaagccaaaggcaggtagctacaatgatcagctccaagaagctagctcagctgtccaagaagtggcagggaatgggcgtaattgggctaaaaaggatcacaagtgtagacaaagagttcaacccatcttgcagcagcatggttgcagggaagggcaactgcattgtctattcttccgatgggaagcggtttgagatccccctcacgtacctccgcacgacagtctttgtggagctcctgaagttgtcacaggaagaatttgggttcacaagtgatgggagaatcacactgccttgcgatacagcagtgatggagtatgtgatgtgtttactgaggagagaggcctctgaagatgttgtgaaggcactcctcagttccatagtgatgccttgccaccaccaaagcagattatccagtggattgaaccagcaattcgctgtctgcagcacctgaagatgaagatatcatggatttgagcttgttttctctcttttcccccttccatctttttttcccagctgtaccttggagcacagttttgtgcaacgtttttacaatggtacactgtggttgtacagatggatgagtgtaaaaataatcatattgtgattagaaaagaaggaatcaagcttgccattg

SEQ ID NO: 2025 - protein, 142 aa, Panicum virgatum
  misc_feature (1)..(142): useful for making plants with increased cold tolerance as described in USSN 12/514,991
  misc_feature (1)..(142): Ceres CLONE ID no. 1759951
  misc_feature (52)..(104): Pfam Name: Auxin_inducible Pfam Description: Auxin responsive protein
  misc_feature (1)..(142): Score of 49.4 for HMM of FIGURE 1 of USSN 12/514,991.
  misc_feature (1)..(142): Functional Homolog Of Ceres SEEDLINE ID no. ME12469
MISSKKLAQLSKKWQGMGVIGLKRITSVDKEFNPSCSSMVAGKGNCIVYSSDGKRFEIPLTYLRTTVFVELLKLSQEEFGFTSDGRITLPCDTAVMEYVMCLLRREASEDVVKALLSSIVMPCHHQSRLSSGLNQQFAVCST

SEQ ID NO: 2026 - DNA, 765 bp, Arabidopsis thaliana
  misc_feature (1)..(765): useful for making plants with increased cold tolerance as described in USSN 12/514,991
  misc_feature (1)..(765): Ceres ME LINE ME14045
  misc_feature (1)..(765): Ceres ANNOT ID 861093
  misc_feature (72)..(476): Encodes the peptide sequence given in  SEQ ID NO. 191
tcttcataatctcatttcctctacgagtttctagcgtaaaaaaactaaatacttgtctttaaagaagaaaaatgctaggaaaaagaatagcttccttcaagaacttagcaaagaaaatgaagagcatcaacacgacgacgagaagcggaggagaaggcggctcggagtcaacttataacgagtctcttctgatgaatgaggcggacgaggcggcgatgatggcgtcaaagacgccgacggggacgtttgcggtgtacgtaggggaagagcgcgtgaagcgcgtggtaccaacaagctacttgaatcatcctctcttcaggatgctcctcgacaagtctcacgacgagtttctctgtttcgagcagaaggttatgttggtggtcccttgcagcctctccgttttccaagacgttgttaacgccgtcgagtcttgtaatggcaacttcgatttcggcgagtttgtcgaggagtttctataaatttaattccgacttcttcttcataattatgatttgtcctcaagacattgtcttaggtctttttttaggaaactatatattcgtaggattgatcgattgattgtgaaatttgtgatacattgtaacacccctttgttgcgtggtgtggaatttgtaaatttttccataattatgatacatattattttactttaaaacatatattagttcaaaaaatcaaatacataaagttttatctatttgtgtttcccattatcgagaaaaaataaaatctatttgtgtttcc

SEQ ID NO: 2027 - protein, 135 aa, Arabidopsis thaliana
  misc_feature (1)..(135): useful for making plants with increased cold tolerance as described in USSN 12/514,991
  misc_feature (1)..(135): Ceres ME LINE ME14045
  misc_feature (1)..(135): Ceres ANNOT ID 861093
  misc_feature (51)..(119): Pfam Name: Auxin_inducible Pfam Description: Auxin responsive protein
  misc_feature (1)..(135): Score of 134 for HMM of FIGURE 1 of USSN 12/514,991.
  misc_feature (1)..(135): Functional Homolog Of Ceres SEEDLINE ID no. ME12469
MLGKRIASFKNLAKKMKSINTTTRSGGEGGSESTYNESLLMNEADEAAMMASKTPTGTFAVYVGEERVKRVVPTSYLNHPLFRMLLDKSHDEFLCFEQKVMLVVPCSLSVFQDVVNAVESCNGNFDFGEFVEEFL

SEQ ID NO: 2028 - protein, 130 aa, Medicago truncatula
  misc_feature (1)..(130): useful for making plants with increased cold tolerance as described in USSN 12/514,991
  misc_feature (1)..(130): Public GI no. 87240820
  misc_feature (55)..(114): Pfam Name: Auxin_inducible Pfam Description: Auxin responsive protein
  misc_feature (1)..(130): Score of 90.4 for HMM of FIGURE 1 of USSN 12/514,991.
  misc_feature (1)..(130): Functional Homolog Of Ceres SEEDLINE ID no. ME12469
MLGKKIVSIKKLAKKVKVVGRVDSDPAHFKLLKECEEEEKKPITKQTGSKKCGVFALYVGEERQKYVVPTRYLSHPLFKMLLEKAYNEFGFEQKNGLVVPCSVSAFQEVVKAIECNNCKFDMGNIFDELI

SEQ ID NO: 2029 - DNA, 953 bp, Panicum virgatum
  misc_feature (1)..(953): useful for making plants with increased cold tolerance as described in USSN 12/514,991
  misc_feature (1)..(953): Ceres CLONE ID no.1817452
  misc_feature (268)..(675): Encodes the peptide sequence given in  SEQ ID NO. 194
cctccgaatcatccacgaacaagaggagaggagaggagaccacgtcctgcgcttgcgcagtggttgcccgccaccaactccaagaagagctcgcgcgcggctcgccagaggcggcagctagctagcagcaatggcggccaccaacccatgaccaggcgccacggctacctatactaaaccctcctccagccgccgccgcaccgtcggtcaagaaacgcaagtagctaggcgcggagatcctgcgcccaccgtctccggcgatcgacgatgatggtgatgggctacttccggtccaccaaggcctccaccgcgacgtcgccgccgacggccaggaagaaggcgaagaaggacggtcgccgggcggcggcgcaagaggacgcgggccttcgggagtcgctgctggagcagccggccgcggccgcggcggagggcggcgtgcccaaggggtacttcgcagtgtacgccggggaggagtcccggcggttcgtcgtgcccacggggtacctccgggagccggcgttccgggaactcatggagcgcgccgccgacgagttcggcttcgcgcaggccggcggcctgcgcgtgccgtgcgccgaggaggacttcgaggacctcctgcgccgcctccagcgcaagaacgccgccgccggcaaggggaagaaggccatcctgtaggcgagtggagaattgcttgacgtgtagatgagatcagctctgctcagctgagggtgcagctctcctgtacagacaatacagagtgcgagcaagcagccacatgcatgcaggcgtagcatagcataggtgaatgcatggtgtgttgattcactgttcgttccgtgaaacatggagtatgtagaaaattcttggggggaattgagttatttagtcttcaaaacttgtaagatttgaatttgagtcaaatttctagtgttgaaaaaaaaaaaaaaaaaaaa

SEQ ID NO: 2030 - protein, 135 aa, Panicum virgatum
  misc_feature (1)..(135): useful for making plants with increased cold tolerance as described in USSN 12/514,991
  misc_feature (1)..(135): Ceres CLONE ID no. 1817452
  misc_feature (57)..(121): Pfam Name: Auxin_inducible Pfam Description: Auxin responsive protein
  misc_feature (1)..(135): Score of 97.6 for HMM of FIGURE 1 of USSN 12/514,991.
  misc_feature (1)..(135): Functional Homolog Of Ceres SEEDLINE ID no. ME12469
MMVMGYFRSTKASTATSPPTARKKAKKDGRRAAAQEDAGLRESLLEQPAAAAAEGGVPKGYFAVYAGEESRRFVVPTGYLREPAFRELMERAADEFGFAQAGGLRVPCAEEDFEDLLRRLQRKNAAAGKGKKAIL

SEQ ID NO: 2031 - protein, 117 aa, Brassica napus
  misc_feature (1)..(117): useful for making plants with increased cold tolerance as described in USSN 12/514,991
  misc_feature (1)..(117): Ceres CLONE ID no. 971416
  misc_feature (10)..(111): Pfam Name: Auxin_inducible Pfam Description: Auxin responsive protein
  misc_feature (1)..(117): Score of 86.6 for HMM of FIGURE 1 of USSN 12/514,991.
  misc_feature (1)..(117): Functional Homolog Of Ceres SEEDLINE ID no. ME12469
MISLDFIVRLKNQEKRRNRRSETNIKASLLSGELSDGRRRARDQNGVPRGHLAVYVGDEMQRFVIPTKYLQYPEFKVLMEEVADEFGYEHEGGIHIPCEESVFEEILIRYMSCDKKK

SEQ ID NO: 2032 - DNA, 375 bp, Populus balsamifera subsp. trichocarpa
  misc_feature (1)..(375): useful for making plants with increased cold tolerance as described in USSN 12/514,991
  misc_feature (1)..(375): Ceres  ANNOT ID no. 1772690
  misc_feature (1)..(375): Encodes the peptide sequence given in  SEQ ID NO. 197
atgttgggcaaaaagatcgtttctttcaagaaacttgccaagaaggtgaaggatatcagtagaaatgagtgcaagcaatcacagcatgaatgcttactaagggatcataattttgatgatggggtcacaaccccaacagggttttttgctatatatgtaggggaagacagggaaaggtttgtggtgccaacaagctgtctctcccatccgctcttcaaaatgttgttggagaagtcatataacgtgtttggtttcgatcaaaggaataggcttgtggttccatgcaacgtctccacatttcaagaggttctcaatgctgttgaatgttgtaacggaaggtttgactttggaaatttggttgaggagtttctatag

SEQ ID NO: 2033 - protein, 124 aa, Populus balsamifera subsp. trichocarpa
  misc_feature (1)..(124): useful for making plants with increased cold tolerance as described in USSN 12/514,991
  misc_feature (1)..(124): Ceres  ANNOT ID no. 1772690
  misc_feature (1)..(108): Pfam Name: Auxin_inducible Pfam Description: Auxin responsive protein
  misc_feature (1)..(124): Score of 104.7 for HMM of FIGURE 1 of USSN 12/514,991.
  misc_feature (1)..(124): Functional Homolog Of Ceres SEEDLINE ID no. ME12469
MLGKKIVSFKKLAKKVKDISRNECKQSQHECLLRDHNFDDGVTTPTGFFAIYVGEDRERFVVPTSCLSHPLFKMLLEKSYNVFGFDQRNRLVVPCNVSTFQEVLNAVECCNGRFDFGNLVEEFL

SEQ ID NO: 2034 - DNA, 630 bp, Arabidopsis thaliana
  misc_feature (1)..(630): useful for making plants with increased cold tolerance as described in USSN 12/514,991
  misc_feature (1)..(630): Ceres ME LINE ME09090
  misc_feature (1)..(630): genomic sequence of Ceres ANNOT ID 576111
  misc_feature (1)..(81): exon
  misc_feature (82)..(180): intron
  misc_feature (181)..(630): exon
atggagaagcttcttaatccgtacgataagcagtgcatgaaaatggctatgcttaaacatgaagaaactttcaagcaacaggtaataattaaagagaatccttatccatatattacatcttaagtcatacatatgtacacatgttaaaaaaattaatatatgattattatgcattttcaggtatatgaacttcatagattatatcaagttcagaagatattgatgaagaacatggagatcaacaaatttactaccaagaacaatcatgtaaattcaggtctaggaacattcatcagaagagttgacaacgagattgaccggccggcgaatttctccggtggtaataataatatagagattatggatgagagtgagatcgagttaacccttggtccctcgtgttacggtggtgatgaaatgatgaggatgaacaagaagaagaaaaagaactctttgccggagatgatggacgggagtttaaattccggtcgccggagtttttcttcgtcttcgacaggatcaagtaataacaataacaacaatcttgaagaacaagtgaggcaagaaagaatgatgaaacatcagaagcagcagccatggcttcaagcattgaccttgaatgttatttga

SEQ ID NO: 2035 - DNA, 685 bp, Gossypium hirsutum
  misc_feature (1)..(685): useful for making plants with increased cold tolerance as described in USSN 12/514,991
  misc_feature (1)..(685): Ceres CLONE ID no.1840844
tggggaatgtgaagacaacatcatcttcaccttgagttctgtctctctctctctatatataagctttccattgcctttttctctttaacagtttcccttttcttcttcatctcaaagctttgatcttcttccatagctaaagctcttcaagaatcttttacaggtggaaaaatagtgaaaaggtgattgagcatctattcatctatatctcttgggattttgaacagaaacaaactccaatggagaagcttcttcgaccgtacgataaggaatttatgaggatggcaatgttaaaacatgaagaaactttcaaagaacaggtatatgagcttcatcgtctatatagaatccaaaagacattgatgaaaagcattggaaccagtagagccgccattaatggaagctttcaccatgggaatatcaattcaagaaccagatttgatttagaacatccagctgatgctgatgctgatgatgatgatgatgatgcagagtttatagatgaaagtgagattgaactgactttaggaccgacaaagtacatgtcgaggaagaagcatgggactacttcggattcaggaccgaacagcttctcatcttcttcaactgaatcagcttctcatatgaacaacaacaatagcaggccatgtaattcttccatggcgaaaagccaacgagatgaatt

SEQ ID NO: 2036 - protein, 148 aa, Gossypium hirsutum
  misc_feature (1)..(148): useful for making plants with increased cold tolerance as described in USSN 12/514,991
  misc_feature (1)..(148): Ceres CLONE ID no.1840844
  misc_feature (1)..(148): Score of 140.3 for HMM of FIGURE 2 of USSN 12/514,991.
  misc_feature (1)..(148): Functional Homolog Of Ceres SEEDLINE ID no. ME09090
MEKLLRPYDKEFMRMAMLKHEETFKEQVYELHRLYRIQKTLMKSIGTSRAAINGSFHHGNINSRTRFDLEHPADADADDDDDDAEFIDESEIELTLGPTKYMSRKKHGTTSDSGPNSFSSSSTESASHMNNNNSRPCNSSMAKSQRDE

SEQ ID NO: 2037 - DNA, 1370 bp, Gossypium hirsutum
  misc_feature (1)..(1370): useful for making plants with increased cold tolerance as described in USSN 12/514,991
  misc_feature (1)..(1370): Ceres CLONE ID no.1853364
attgctggagctgtgtgaggcatctttttcataaagcttgaatggtattggttaagggactgagatttgtttggcatgcctcaaaccccagaagcacccaacgcccttggtttctgtgtaaaagcaaaggaatcttaaattcttctacttcaatacacatacacatatatacatatatatatccatgttctttgcagcatatactaatggggaatgtgaagacaacatcatcttcaccttgagttctgtctctctctctctatatataagctttccattgcctttttctctttaacagtttcccttttcttcttcatctcaaagctttgatcttcttccatagctaaagctcttcaagaatcttttacaggtggaaaaatagtgaaaaggtgattgagcatctattcatctatatctcttgggattttgaacagaaacaaactccaatggagaagcttcttcgaccgtacgataaggaatttatgaggatggcaatgttaaaacatgaagaaactttcaaagaacaggtatatgagcttcatcgtctatatagaatccaaaagacattgatgaaaagcattggaaccagtagagccgccattaatggaagctttcaccatgggaatatcaattcaagaaccagatttgatttagaacatccagctgatgctgatgctgatgatgatgatgatgatgcagagtttatagatgaaagtgagattgaactgactttaggaccgacaaggtacatgtcgaggaagaagcatgggactacttcggattcaggaccgaacagcttctcatcttcttcaactgaatcagcttctcatatgaacaacaacaatagcaggccatgtaattcttccatggcgaaaagccaacgagatgaattcattggtcgtgaactgagactcttacaggttactgatacaacaatggggtatcaaaatagaagtaaaaacaatgttgttgaacttgaagaacaatttagacaggagagattaaaacatccttggttttttcaagttgcaagtatgaatatgacttgaaaaaaaatagaaaaaagaagaagaaaatcccaagtttatatgattagatttttagattagtgtttgtgaggaagtttaggttcagagtttcttttttggggcaaaaatgggtgatggagtttcttttttttttctctgtacagatcactttttttttcttgactagtaaaaacccattacaatgcatattgactcttttccttttggtgcttagctttttaattagtcaatcctttttaagtcccactttggaagacttttttcttttattattattctaagtataagataaaaacaccttaaaaaaaaaaaaaaaaaaaa

SEQ ID NO: 2038 - protein, 200 aa, Gossypium hirsutum
  misc_feature (1)..(200): useful for making plants with increased cold tolerance as described in USSN 12/514,991
  misc_feature (1)..(200): Ceres CLONE ID no.1853364
  misc_feature (1)..(200): Score of 220.9 for HMM of FIGURE 2 of USSN 12/514,991.
  misc_feature (1)..(200): Functional Homolog Of Ceres SEEDLINE ID no. ME09090
MEKLLRPYDKEFMRMAMLKHEETFKEQVYELHRLYRIQKTLMKSIGTSRAAINGSFHHGNINSRTRFDLEHPADADADDDDDDAEFIDESEIELTLGPTRYMSRKKHGTTSDSGPNSFSSSSTESASHMNNNNSRPCNSSMAKSQRDEFIGRELRLLQVTDTTMGYQNRSKNNVVELEEQFRQERLKHPWFFQVASMNMT

SEQ ID NO: 2039 - DNA, 645 bp, Populus balsamifera subsp. trichocarpa
  misc_feature (1)..(645): useful for making plants with increased cold tolerance as described in USSN 12/514,991
  misc_feature (1)..(645): Ceres ANNOT ID no.1451488
atggggaaatttctcaagccctgcgacaaggaagacatgagaatggccatgttaaaacacgaagagacattcaaagagcagatatgtgaacttcatcgtctatatcgaatccaaaagataatgatgagaaacattgaaagcagcaggccagatgagcggagtcgagagttatggagctacaagaatggctttagttttaatcagcctaatcatgctcgcgatatgcagcagaagtcgatagggagacttgacttggagtggccttccgaagattgtgttgcagaatcaaatgcagatagagtattagagctaatagaagagagtgagattcagctaacattgggaccttcgagttatgacagaaggaagaaacctgaaacaccactaacttcagattcaggaacaagcctctcttcgtcttccactggatccagccatataaacaggacaagttccttgaaacatcaaaagacaagcaccaaaagagaagaatgctgcgaattggggattttccaagttcctgacatgaccttggggtaccaaaatgaaagtaaaaagggtatgggggttgaagaacaactgagacaggagagacaaaaacaacccccttggctttgccaggttttgagtctgaacatggcttga

SEQ ID NO: 2040 - protein, 214 aa, Populus balsamifera subsp. trichocarpa
  misc_feature (1)..(214): useful for making plants with increased cold tolerance as described in USSN 12/514,991
  misc_feature (1)..(214): Ceres ANNOT ID no.1451488
  misc_feature (1)..(214): Score of 415.1 for HMM of FIGURE 2 of USSN 12/514,991.
  misc_feature (1)..(214): Functional Homolog Of Ceres SEEDLINE ID no. ME09090
MGKFLKPCDKEDMRMAMLKHEETFKEQICELHRLYRIQKIMMRNIESSRPDERSRELWSYKNGFSFNQPNHARDMQQKSIGRLDLEWPSEDCVAESNADRVLELIEESEIQLTLGPSSYDRRKKPETPLTSDSGTSLSSSSTGSSHINRTSSLKHQKTSTKREECCELGIFQVPDMTLGYQNESKKGMGVEEQLRQERQKQPPWLCQVLSLNMA

SEQ ID NO: 2041 - DNA, 874 bp, Glycine max
  misc_feature (1)..(874): useful for making plants with increased cold tolerance as described in USSN 12/514,991
  misc_feature (1)..(874): Ceres CLONE ID no.523448
attagtgtctcaatgtcattgtaaccatgctttcattgaaccaccttattttctatataaaagcttttcagttttcaatttttcatcctatcctgtctgaattttctctcttaatatatataacttacatatgaaggtagagtgatatcatgaagaagcaagtctgagtacaagtttcataaaaagaggagttacctttgtatcactagttcaaagttcaccttctcagaagctacatagatacactgatggagaagcttgtaaggtcctgtgacaaagaatatatgaggatggccatgttaaaacacgaagaaactttcaaagagcaggtatatgagcttcatcgtttgtaccaaattcagaagatactgatgcaaaacatggatgccagaagaggaattgaagtgaccaaagaagaatggtacttcaagaatgcgatcggtttaacttgcaaaggggcacaagaaaagcctcaaatgaaaatcgacctcgaaaggcctgcagaggagcacattgcagaatcagaagatggggtgctagaggtcatagatgagactgagattgagctgacattagccccctcaagttacaaccgtaggaagaaagtcgagacaccgctaacttcagattcaggacacagcttgtcttcttcttctagtggatccagccatgtaaacaagacaagatgtcatggcactcacacaacaagagaaaactcaagtggaagcataattcgcctcgtcgaggtgccgggttctaccccagcataccaaagtggaattagaaacagttttgatattgaagaacaattaagacaagagagattaaaacagtcaccttggcttttccaagtgttgaatctgaacatgacttg

SEQ ID NO: 2042 - protein, 208 aa, Glycine max
  misc_feature (1)..(208): useful for making plants with increased cold tolerance as described in USSN 12/514,991
  misc_feature (1)..(208): Ceres CLONE ID no.523448
  misc_feature (1)..(208): Score of 394.3 for HMM of FIGURE 2 of USSN 12/514,991.
  misc_feature (1)..(208): Functional Homolog Of Ceres SEEDLINE ID no. ME09090
MEKLVRSCDKEYMRMAMLKHEETFKEQVYELHRLYQIQKILMQNMDARRGIEVTKEEWYFKNAIGLTCKGAQEKPQMKIDLERPAEEHIAESEDGVLEVIDETEIELTLAPSSYNRRKKVETPLTSDSGHSLSSSSSGSSHVNKTRCHGTHTTRENSSGSIIRLVEVPGSTPAYQSGIRNSFDIEEQLRQERLKQSPWLFQVLNLNMT

SEQ ID NO: 2043 - protein, 202 aa, Medicago truncatula; identical to SEQ ID NO: 1958
  misc_feature (1)..(202): useful for making plants with increased cold tolerance as described in USSN 12/514,991
  misc_feature (1)..(202): Public GI ID no.92874228
  misc_feature (1)..(202): Score of 482.9 for HMM of FIGURE 2 of USSN 12/514,991.
  misc_feature (1)..(202): Functional Homolog Of Ceres SEEDLINE ID no. ME09090

SEQ ID NO: 2044 - DNA, 599 bp, Triticum aestivum
  misc_feature (1)..(599): useful for making plants with increased cold tolerance as described in USSN 12/514,991
  misc_feature (1)..(599): Ceres CLONE ID no.1320691
aagacaaaacgagaagaccaaaccaagaagagaagcatatgacgcagatggaggagctcgtgcaggagtgcgacatggaggtgatgaagatggccatgctcaagcacgagcagaccttcaggcagcaggtgcatgatctgcaccggctgtaccgagtccagaagcagctcatgggcgaccagagcgggcgcctgtcggtgccaccctgccgtcaggcgcagcggcgcaggcagcacccccgtcggccggagctgagcctgcagcttcctgtcgacgacgatgtgtacaccgtattcagcgccggcacaggccgcctaacgacgccaccgtccagggaaagcgaggacgggctagagctgacgctggccgtcggcggcggcggcgggaacggcggcagcagccggagccagaggaggaggcgggagagcgcgacggactgctccggcagaagcccacagacgccgtcttcgtcgacggactccgacgaggcgctccgcccggtgctggaccaccaccggagggcgacggcgtgtgatctccggggaggggtgatggtgtcgaagcagccgcaatggctggtgcgctgtctcagccttagg

SEQ ID NO: 2045 - protein, 187 aa, Triticum aestivum
  misc_feature (1)..(187): useful for making plants with increased cold tolerance as described in USSN 12/514,991
  misc_feature (1)..(187): Ceres CLONE ID no.1320691
  misc_feature (1)..(187): Score of 342.5 for HMM of FIGURE 2 of USSN 12/514,991.
  misc_feature (1)..(187): Functional Homolog Of Ceres SEEDLINE ID no. ME09090
MTQMEELVQECDMEVMKMAMLKHEQTFRQQVHDLHRLYRVQKQLMGDQSGRLSVPPCRQAQRRRQHPRRPELSLQLPVDDDVYTVFSAGTGRLTTPPSRESEDGLELTLAVGGGGGNGGSSRSQRRRRESATDCSGRSPQTPSSSTDSDEALRPVLDHHRRATACDLRGGVMVSKQPQWLVRCLSLR

SEQ ID NO: 2046 - DNA, 1140 bp, Triticum aestivum
  misc_feature (1)..(1140): useful for making plants with increased cold tolerance as described in USSN 12/514,991
  misc_feature (1)..(1140): Ceres CLONE ID no.748562
attcccagtttgagcatcaacacctgatctttagtctttcctccgttctatcttgcttgtcccttgcaagtttgagtgcagaacgagctgaagagagctagatagacaagggagaggacaagttcttggcttataattacaggtttagagcaagttttgagtttgaggagagatgggcaagcttgtgaggcaatgtgacatggaggtcatgaagatggccatgctcaagcacgaagagaccttcaggcaacaggttcacgagctacaccgcctgtaccgcatccagacacagctcatggggggcgacctgagcacgcgccggcagccgcggcggcgcggcaacaagcagccacgccgggcgctcaacctgcagctccccgccgacgagtacatagtcggagccgccgacgaggacgacgacggctgcggcaccggagcagagctggagctgacgctcgccgtgggagggaggaggaccggctccggcacttcccgcaagaacaacgttagcaagagaggacatgccaaacacgacggcgccggcggcttctcctcacccttcgcttccgactgctccggcggcacgagcctctcgtcgtcgccgccgtcgtcggccgagtactcggagagcgccttcggggtggcgctccacggcggttacccgggggtggccgcgcctccgccgccatgccagagagccatgacgttcgacctcggcgtggcggaggcgatgaagcagcaccagtcgccctggcagctggtgcagtgccagtacctcagcctcaggatgacatgaatgaatcaactccttcgaagctcgttgatcatatatatcatcatcatccaagccatggccatggcatgatcgcatcgtactacttagtaggttgtgttgcattgtagaagcagtagctatggagtattccttatcttttctttccttttttgctgttgcttagatgcgtgccattgatggagcttggggaggatcgagttctgaattccgatcctgatcccaagctgctaattgcttaatcatgacaaatgagtgcatgctgattgattagtcatcgatgttcagagctgagactggtgtgaattgatgaataatatgccatgttcatgaaaaaaaaaaaaaaa

SEQ ID NO: 2047 - protein, 207 aa, Triticum aestivum
  misc_feature (1)..(207): useful for making plants with increased cold tolerance as described in USSN 12/514,991
  misc_feature (1)..(207): Ceres CLONE ID no.748562
  misc_feature (1)..(207): Score of 131.4 for HMM of FIGURE 2 of USSN 12/514,991.
  misc_feature (1)..(207): Functional Homolog Of Ceres SEEDLINE ID no. ME09090
MGKLVRQCDMEVMKMAMLKHEETFRQQVHELHRLYRIQTQLMGGDLSTRRQPRRRGNKQPRRALNLQLPADEYIVGAADEDDDGCGTGAELELTLAVGGRRTGSGTSRKNNVSKRGHAKHDGAGGFSSPFASDCSGGTSLSSSPPSSAEYSESAFGVALHGGYPGVAAPPPPCQRAMTFDLGVAEAMKQHQSPWQLVQCQYLSLRMT

SEQ ID NO: 2048 - DNA, 974 bp, Zea mays
  misc_feature (1)..(974): useful for making plants with increased cold tolerance as described in USSN 12/514,991
  misc_feature (1)..(974): Ceres CLONE ID no.388717
acaatgatcaggaactgggagtggcaagcgccaaggagtagttagagctcagtagggatacagcagtttctgagtcacttcgtctctgacatccacgagttgaaagagataggagtgagaggcagttcccttccctactctcacaatgcccatggagcaagcatccaggcactgcgataaagacacgctgaagatggccatgctgaaacacgaagagactttcagacagcaagttcacgagctccatcgcttatacaggatccagaagctcctgatgcgagacctcacacgggagctcaagctcaagagccagaggagcctgcccaccacctcgccgaacggcagctgcgccgagtacagcagaggggctctcggcatgtgcgcctacgagcgcctctacgccgctctcggccgcggcggacacgtagcagcagcagcgacgccgacgccgacgccgcgcaccgctctcggcctcgacgtcgtggcgccagtcgtcgagtacgtgcggagcgcggaggaggaggacgacgacgacagggcggaggaaaccgacgaagacgcggagctggagctcacgctcgcggtgggcggaggcggggccaagaagcggtacgacgagtacccgtccggtggggagagtctgtcttcgtcgtccacggagtccgacgtgctcaccgtctccggccgtgagtggcgtcgggcgcgcggcacgccgtatcacaagatgaggccggcgaccgggctggacgtggtgcaggtggaggacgacgtcggggtgccgccgccgctgctgttccactggctcagcctcaagatggcatgacgcgatgcgaggaagcaagagcacattgcatgtgtgttcgttgctgcttgctgtgtcagggtgttgacttgctactgttcttcagttgaatgcttttgtgtgttaggttttagtggtggatcaagtctagaaatcaaaaaaaaaaaaaaaa

SEQ ID NO: 2049 - protein, 225 aa, Zea mays
  misc_feature (1)..(225): useful for making plants with increased cold tolerance as described in USSN 12/514,991
  misc_feature (1)..(225): Ceres CLONE ID no.388717
  misc_feature (1)..(225): Score of 80 for HMM of FIGURE 2 of USSN 12/514,991.
  misc_feature (1)..(225): Functional Homolog Of Ceres SEEDLINE ID no. ME09090
MPMEQASRHCDKDTLKMAMLKHEETFRQQVHELHRLYRIQKLLMRDLTRELKLKSQRSLPTTSPNGSCAEYSRGALGMCAYERLYAALGRGGHVAAAATPTPTPRTALGLDVVAPVVEYVRSAEEEDDDDRAEETDEDAELELTLAVGGGGAKKRYDEYPSGGESLSSSSTESDVLTVSGREWRRARGTPYHKMRPATGLDVVQVEDDVGVPPPLLFHWLSLKMA

SEQ ID NO: 2050 - DNA, 825 bp, Zea mays
  misc_feature (1)..(825): useful for making plants with increased cold tolerance as described in USSN 12/514,991
  misc_feature (1)..(825): Ceres CLONE ID no.1489975
agatttgatacacatgcaaatcctgctggctgttgcttctcagcagggccaaatccgttcctttggcctagcagtagctaccgctaccaggagatcttcttcttcccccctcccatcctgtgagaggtgcccaacagcttcgtcagaggaatcagcacttcagcggagacacacagtccaggtccaggtccaggccatcgaactgatacttgtgagatcaagatggagaaggaacacatcaagatggccatgctgaggcaagaacagacattcagacagcaggttcacgagctgcaccgcgtgtaccaggttcagaagcagctgatgatgcagatgcagattgccaagacaaacagctacggaaacgaagctgctgaaaggcaaaccaaaccgacagaaaaactcgagcaccgacagtggtgtggtagctcaggcaagacggaggccaagctggccgaagacttcagcttggagctgacactggcaactggggctggaaggaggggggaggaggagaagccatccaactcagactccgaagcaacaatgtcgtcatcgacatctgcagagtcagagccagggcaggggttcgcgcccaagtccgatgtaacaaacctaaggttccagaatgagagcagtaggcatgatgctcaggtcttgcagtctccttggcgataccaatgtttaagtctcaagatggcgtgaaggggttaggttgggttggcatggcatggcatgggtgtaccccaaggctcaaacaaaagcaagtgcattgctgcatgtatgtatgtatattacgatttcactgcaaaaaaaaaaaaaaaa

SEQ ID NO: 2051 - protein, 160 aa, Zea mays
  misc_feature (1)..(160): useful for making plants with increased cold tolerance as described in USSN 12/514,991
  misc_feature (1)..(160): Ceres CLONE ID no.1489975
  misc_feature (1)..(160): Score of 205.2 for HMM of FIGURE 2 of USSN 12/514,991.
  misc_feature (1)..(160): Functional Homolog Of Ceres SEEDLINE ID no. ME09090
MEKEHIKMAMLRQEQTFRQQVHELHRVYQVQKQLMMQMQIAKTNSYGNEAAERQTKPTEKLEHRQWCGSSGKTEAKLAEDFSLELTLATGAGRRGEEEKPSNSDSEATMSSSTSAESEPGQGFAPKSDVTNLRFQNESSRHDAQVLQSPWRYQCLSLKMA

SEQ ID NO: 2052 - DNA, 1040 bp, Zea mays
  misc_feature (1)..(1040): useful for making plants with increased cold tolerance as described in USSN 12/514,991
  misc_feature (1)..(1040): Ceres CLONE ID no.468781
agaaacccaccaccgcaacacctgcgctccgcggcctgctctctctttcaaacagcttcgtgtgtcgttgcgccgcgcatagttccagcgccagctcggcactgaagaatctggtgaccggcctggatcgagatccaagctcgagcaggaacggagagcgcgcggatatatatagctaggatgatgatgatgatggacaggcaactcgtcaggcaatgcgacatggaggtcatgaggatggccatgctcaagcacgaagagaccttccggcagcaggtccacgagctgcaccgcctgtaccgcatacagagggagccgatgagcgacctaataacgacccgatacgacgacgagccgctgctgctgacgaccgccggccggcgcagcaagcagccgcgccgggcgctggacctgcagctcccagccgacgagtacatcgtcagcgccgacgaggacgacgacggcgacgcggacgccgccggcgcggagctggagctgacgctggccgtcggcgggcgctgcgcagccggcggcggccggcgcaagagcaacaggcgccggaggcaatcagcagagcggcagcagcgcgacaacaacgccgccggcggctcctcgccgttcgggtccgactgctccggcgcgagcgccctgtcgtcgccgccgccttcgtcggccgagtactactccgacgacgggccggcggcggcggcgtgccagagggccgttgcgttcgaccttggaggagaagccgacggcgtgatgaggcagcagcacgcgccgtggctggcgcagtgccagcagtacctcagcctgaggatgacatgagtgaagctgcaggcctgcagcgcgctgctcgccgccgtccatgtcgatgtccatgtcgctagctgtaccaggttgcgtttgtgttgtagcttgtaggagcagcagtacgtactagccagtagccactagtgtttttttttttttttttttgccctttgtgtttgctatatgtcctagccgtggccaatggagtccgggaagaaggcctgcagttt

SEQ ID NO: 2053 - protein, 214 aa, Zea mays
  misc_feature (1)..(214): useful for making plants with increased cold tolerance as described in USSN 12/514,991
  misc_feature (1)..(214): Ceres CLONE ID no.468781
  misc_feature (1)..(214): Score of 124.6 for HMM of FIGURE 2 of USSN 12/514,991.
  misc_feature (1)..(214): Functional Homolog Of Ceres SEEDLINE ID no. ME09090
MMMMMDRQLVRQCDMEVMRMAMLKHEETFRQQVHELHRLYRIQREPMSDLITTRYDDEPLLLTTAGRRSKQPRRALDLQLPADEYIVSADEDDDGDADAAGAELELTLAVGGRCAAGGGRRKSNRRRRQSAERQQRDNNAAGGSSPFGSDCSGASALSSPPPSSAEYYSDDGPAAAACQRAVAFDLGGEADGVMRQQHAPWLAQCQQYLSLRMT

SEQ ID NO: 2054 - protein, 225 aa, Zea mays
  misc_feature (1)..(225): useful for making plants with increased cold tolerance as described in USSN 12/514,991
  misc_feature (1)..(225): Public GI ID no.100740767
  misc_feature (1)..(225): Score of 71.2 for HMM of FIGURE 2 of USSN 12/514,991.
  misc_feature (1)..(225): Functional Homolog Of Ceres SEEDLINE ID no. ME09090
MPMEQASRHCDKDTLKMAMLKHEETFRQQVHELHRLYRIQKLLMRDLTRELKLKSQRSLPTTSPNGSCAEYSRGALGMCAYERLYAALGRGGHVAAAATPTPTPRTALGLDVVAPVVEYVRSAEEEDDDDRAEETDEDAELELTLAVGGGGAKKRYDEYPSGGGSLFSSSTESDVLTVSGREWRRARGTPYHKMRPATGLDVVQVEDDVGVPPPLLFHWLSLKMA

SEQ ID NO: 2055 - protein, 207 aa, Zea mays
  misc_feature (1)..(207): useful for making plants with increased cold tolerance as described in USSN 12/514,991
  misc_feature (1)..(207): Public GI ID no.100741787
  misc_feature (1)..(207): Score of 86.7 for HMM of FIGURE 2 of USSN 12/514,991.
  misc_feature (1)..(207): Functional Homolog Of Ceres SEEDLINE ID no. ME09090
  misc_feature (144)..(144): Xaa is any aa, unknown or other
  misc_feature (147)..(147): Xaa is any aa, unknown or other
  misc_feature (150)..(150): Xaa is any aa, unknown or other
  misc_feature (151)..(151): Xaa is any aa, unknown or other
  misc_feature (152)..(152): Xaa is any aa, unknown or other
  misc_feature (153)..(153): Xaa is any aa, unknown or other
  misc_feature (155)..(155): Xaa is any aa, unknown or other
  misc_feature (158)..(158): Xaa is any aa, unknown or other
  misc_feature (161)..(161): Xaa is any aa, unknown or other
  misc_feature (164)..(164): Xaa is any aa, unknown or other
  misc_feature (170)..(170): Xaa is any aa, unknown or other
  misc_feature (171)..(171): Xaa is any aa, unknown or other
  misc_feature (172)..(172): Xaa is any aa, unknown or other
  misc_feature (177)..(177): Xaa is any aa, unknown or other
  misc_feature (178)..(178): Xaa is any aa, unknown or other
  misc_feature (179)..(179): Xaa is any aa, unknown or other
  misc_feature (181)..(181): Xaa is any aa, unknown or other
  misc_feature (186)..(186): Xaa is any aa, unknown or other
  misc_feature (189)..(189): Xaa is any aa, unknown or other
  misc_feature (191)..(191): Xaa is any aa, unknown or other
  misc_feature (192)..(192): Xaa is any aa, unknown or other
  misc_feature (201)..(201): Xaa is any aa, unknown or other
  misc_feature (203)..(203): Xaa is any aa, unknown or other
  misc_feature (206)..(206): Xaa is any aa, unknown or other
MMTDRQRVRQCDIEVMKMAMLKHEETFRQQVHELHRLYRIQRELMMTTSDDLTGAKPVTTPRRRSKQPRRALPLGLQLPADEYIASADEDEDAAAGTELELTLAVGGRCSPAGRRKSDRRRRRQAAEPRDDAGAVSSPFGPDCXGAXVLXXXXSXEYXSDXGPXAAFHVXXXPCQRXXXFXLEESXMMXQXXPWLLQCRQXLXLRXT

SEQ ID NO: 2056 - DNA, 1006 bp, Zea mays
  misc_feature (1)..(1006): useful for making plants with increased cold tolerance as described in USSN 12/514,991
  misc_feature (1)..(1006): Ceres CLONE ID no.1639137
aagatttgatgcacacggcatgcaaatcctgcaggctgttgcttctcagcagggccaaaagctgtgcctttggcctagcagtagctaccactagtaccaggagatcttcccgtcccaacatcttcgacagaggaatcagctgtgggagctcgtgaggcagagggcgggcagagacaagatggagaaggaacacatcaagatggccatgctgaggcaagagcaaacattcaggcagcaggttcacgagctgcaccgcgtgtaccaggttcagaagcagctgatgacgcagacgcagattacccagcaccaccagcaacggtgtggtagctcaggcaagacggaggaggaggaggacttcaacctggagctgacgctggcaacaggggctggaaggacgcggcaggagaagccatccacttcagactccgaagcgaccatgtcgtcgtcgacatctgcagaatcagagcaagctcagaggttcatgcccagttccaatgtaacaaacctaaggttccagggcgagagcaataggcatgatgatcatcaggtcatgcagtctgcttggcgctatcaatgtttaagtctcaagatggcgtgaagggattaattagacagggttggcatgggagtgccctaaacaaaagcaagtgcattgctgcatgtatgtatgtatattacgatttcattgcaactgtaggaacgagctcaaaaaagaaggaaatgataggcaaactaaaatgaaccagacgagaagaaaaagaatcaaatcgtgtctgttgttgttttgtggcaaagagaacagggccacttacatctagataaccagatacagagagtttagttcaagtaaatgtacttttgagcaacaggatcaaagaccgtacaaagatgtcatcatacaagaccaatggacctagtgtaatttgcccaccccttggatccgcctctggtggacataagtgaatgaacgcattggaagcaattcctctaaaaaaaaaaaaaaaaa

SEQ ID NO: 2057 - protein, 139 aa, Zea mays
  misc_feature (1)..(139): useful for making plants with increased cold tolerance as described in USSN 12/514,991
  misc_feature (1)..(139): Ceres CLONE ID no.1639137
  misc_feature (1)..(139): Score of 144.2 for HMM of FIGURE 2 of USSN 12/514,991.
  misc_feature (1)..(139): Functional Homolog Of Ceres SEEDLINE ID no. ME09090
MEKEHIKMAMLRQEQTFRQQVHELHRVYQVQKQLMTQTQITQHHQQRCGSSGKTEEEEDFNLELTLATGAGRTRQEKPSTSDSEATMSSSTSAESEQAQRFMPSSNVTNLRFQGESNRHDDHQVMQSAWRYQCLSLKMA

SEQ ID NO: 2058 - protein, 286 aa, Vitis vinifera
  misc_feature (1)..(286): useful for making plants with increased cold tolerance as described in USSN 12/514,991
  misc_feature (1)..(286): Public GI ID no.147772914
  misc_feature (1)..(286): Score of 263 for HMM of FIGURE 2 of USSN 12/514,991.
  misc_feature (1)..(286): Functional Homolog Of Ceres SEEDLINE ID no. ME09090
MSTSLALTHDPMSWPFHIQIDFTWAINGHDHHPLSSPILKIRALLHCWIQDPVVSHSFGQVKRYPLNGGLGKLRKNSDFMVKVSLGIGPFPRTVQGVGRVSMEKLLNPYDREYMKMAMLKHEETFKEQSQERLNSNDISMNQINHQEKPRMKLDLEQPAEEYNAELDGDGVLEIVDESKLELTLGPVSYSRRKKAETPLTSDSGPSFSSSSTGSSHMKRTNSRTPKRIDTTKEESNGHDWGLFNVPDMKPGFQSGRKNGFHVDEQLRQERLNQPPWIVQVLSLNMT

SEQ ID NO: 2059 - DNA, 1339 bp, Panicum virgatum
  misc_feature (1)..(1339): useful for making plants with increased cold tolerance as described in USSN 12/514,991
  misc_feature (1)..(1339): Ceres CLONE ID no.1816186
acaatgatcaggaactgagagtggcaagagccaaggagtaagctcagtaggatacagttcgtgagtcacttctctgacatcaagcagttacactaggcttacctacccttctcatttgtagtaaacatatttttggatcaggacattctgataacaatcaaacttctttcagtcttctattttcagaaacctaccagacatattgtagccttagactgctttcattcttaaagttgcacagcactcacttcttatctgaattcacttctggttagaggagagagatagagtagaagcacacaattccacaatgcccatggagcaagtattcaggcacggcgacaaagatacgctgaagatggccatgctgaagcacgaacagactttcagacagcaagttcacgagctccatcgcttatacaggatccagaagcttctgatgcgagacctcaagagggagctcaagagccagaggaacctgtcgacctccccgaacggcggctccaccgagcacagcagaggcgcgctcggcatgtgcgcctacgagcaccgctacgccgctcgcggtcccggcggctacgtagcagtagcgacaccaacgccccgcacggcgctcagcttcgacgtcgtggcgccggacgtcgagtacgtgcggagcgcggaggaggaggaggacgacgacgcggaggaggagaccgacgacgacgcggagctggagctcacgctggccgtgggcggcggcggggccaagaagaggtacggcgagtacccgtccggcggggagagcctctcgtcgtcgtcgacggagtccgacgtgctcaacgcctccggccgcgagtggcgccaggcgcgcggcacgccgtaccaccacaagaggaggccgggcgccgggctggacgtggtacaggcggtggatgacggcgtcgggatgcaggcgccgccgccgctgctgttccactggctcagcctcaagatggcataacgctatgagagggggaaccaaagaaacacattgcatgtgtcgattgctgctcctagtgtcactgtgtgtgtcagggtgttgacttgctactgttcttcagttgaatgctgcgtgttcagatcaagtctagaaattaaatcaataattgactagtcgttcaggagaatgtaggagccacttcccaaaatgtaaggaggctgtaggggcttgcttttcagctacaagtgtgactacctaacggcaagtgcttctgcagttctgctcttgttgacgacagatacaaggcggcgaaaatgcaagacaagttcggtgaaaacaataggaccttgtgccctgcaaaaaaaaaaaaaaaaaaaa

SEQ ID NO: 2060 - protein, 223 aa, Panicum virgatum
  misc_feature (1)..(223): useful for making plants with increased cold tolerance as described in USSN 12/514,991
  misc_feature (1)..(223): Ceres CLONE ID no.1816186
  misc_feature (1)..(223): Score of 93.3 for HMM of FIGURE 2 of USSN 12/514,991.
  misc_feature (1)..(223): Functional Homolog Of Ceres SEEDLINE ID no. ME09090
MPMEQVFRHGDKDTLKMAMLKHEQTFRQQVHELHRLYRIQKLLMRDLKRELKSQRNLSTSPNGGSTEHSRGALGMCAYEHRYAARGPGGYVAVATPTPRTALSFDVVAPDVEYVRSAEEEEDDDAEEETDDDAELELTLAVGGGGAKKRYGEYPSGGESLSSSSTESDVLNASGREWRQARGTPYHHKRRPGAGLDVVQAVDDGVGMQAPPPLLFHWLSLKMA

SEQ ID NO: 2061 - DNA, 798 bp, Panicum virgatum
  misc_feature (1)..(798): useful for making plants with increased cold tolerance as described in USSN 12/514,991
  misc_feature (1)..(798): Ceres CLONE ID no.2029721
aagtgcctctctaaccctacccctcctcctgcaccagaaagtgccccctgttgcatggttcttcgaggcctcgatcccgataagcatccaagtgtgagaggtgcctgtctccacttcttgacttgttcttctgttgctacaacatgtcaagatatcatctgaagcagtatgagaaggatcacatgaagatggccatgctgaagcaggaacagacattcaagcagcaggttcaagaactgcatcgactgtaccgggtccagaagctactgatgaccgacgcggcgaacgcagcagcaatgcccgcggccacccgatgcgacctcgaggacgagaggcgcgccgcggagaaccacgccggctcgagcaagtcgggggacggctcctactcggagcaggggaaggccaccgctccccagctcgccctacaagagagcgagctcgagctgacgctgtctctagggtgcttcgggacggccgggaagaaggcagccaagaaggaggtgtcgtcgagcgtggactccaggacgagcatttcgtcgtcgtcgacggagtccggtagccccgactgcagggtcgccctgcctgctccgtcgctgatcgggtccgcggctgctggtagcgtggggcagcgtctggagcaggacgggctgcagcagcctccttggctccacaagtgtctgaatctggcacgatagggtagttcctgtctcactgcatcgttgtaatgtcaaccattctgcaattcttatgccactgcaaaaaaaaaaaaaaattcctgaaaaaaaaaaaaaaaaaaaa

SEQ ID NO: 2062 - protein, 183 aa, Panicum virgatum
  misc_feature (1)..(183): useful for making plants with increased cold tolerance as described in USSN 12/514,991
  misc_feature (1)..(183): Ceres CLONE ID no.2029721
  misc_feature (1)..(183): Score of 113.2 for HMM of FIGURE 2 of USSN 12/514,991.
  misc_feature (1)..(183): Functional Homolog Of Ceres SEEDLINE ID no. ME09090
MSRYHLKQYEKDHMKMAMLKQEQTFKQQVQELHRLYRVQKLLMTDAANAAAMPAATRCDLEDERRAAENHAGSSKSGDGSYSEQGKATAPQLALQESELELTLSLGCFGTAGKKAAKKEVSSSVDSRTSISSSSTESGSPDCRVALPAPSLIGSAAAGSVGQRLEQDGLQQPPWLHKCLNLAR

SEQ ID NO: 2063 - DNA, 1442 bp, Panicum virgatum
  misc_feature (1)..(1442): useful for making plants with increased cold tolerance as described in USSN 12/514,991
  misc_feature (1)..(1442): Ceres CLONE ID no.1911555
atgggctgtgaagctccctcatgacaccaggacgggagaatcttaattctcaatctccttcctcctcccctgcctcaccagatgtacatatacatccatgatgaccggcttgcctcccagcagaaaccaaagtttcctgggcttctctgcttgccggtgagctacagatcagagaggaagaggagattgcccttgttaaccggcagggagttgaggaggtcaggagattctgaatacaggtgagcagagtgatcctctgttcttggttctcttgtttagttctttcaaagttgagagttttttcatacatgtttcgagttcagagtttgcatatcgttctttgtgtttgtgctggagttcttgccatatgcagtcctgtcttttgcgatgaaatgaccttgtttgaaagggcctacagtatcgtgtttcagtcaattatttcgcggttctgttatgggtagatgtgtcaaagtctgtatctatgaccaatgcctgcaagaatttttggttttgttagtttacctagtttcagaacgtaacaatatgattcccaaggaacttttctgaaagcagatttatttttgaaacgaatccatgaaacatactacttgtggactttcttaaaggctcagtataaaaatgtttgcaacgaccggatccaatttccatttgcagcaccaactgaatcactgattcttgaattcacatgaaacagactcacaattaagcaaaagggatcagcatgaaccttcaccaagacatggagagggagcagatgaggatggccatactgaagcaagagcaaatattcagacaacaggttcatgagttgcaccggctgtaccacgttcagaagcagttgatgcagcagatgccaacaaccgtatcgtcgaatcgagctccggtgatcgtcgacgtcaagccgaaaccgcaactggacatttggcacggcgagaaggctacaaatcctcagcaactcatcagcttctcgagctacaaggcccatgcccctgcacctgctcctgcagaggactgcaaccttgagctgactctagcaaccgggccaagcaccagcggcagctgcaacgctgagaggcagcaggggaagcggctcaagtcgtcgtccaactcggactccgggaccacggcggtgtcgtcgacgtcgacggactcggagctggcgcagttcagggaggccgacgtgatggcgtcggcggcggcgaggtttcccggcgagagtaggaggaggatggatcagatggggcaaggtccgtggatgtaccagtgcttgagcctgaagacggcatgatggtgtgtaggactggggtgtaggtttcagatggagacagagcgcatgtttgacacatgcacagttgtacatcacagaggtgattgaaaaaaaacaagaaggtgatttgttgcaaaaaaaaaaaaaaaaaaaa

SEQ ID NO: 2064 - protein, 188 aa, Panicum virgatum
  misc_feature (1)..(188): useful for making plants with increased cold tolerance as described in USSN 12/514,991
  misc_feature (1)..(188): Ceres CLONE ID no.1911555
  misc_feature (1)..(188): Score of 109.8 for HMM of FIGURE 2 of USSN 12/514,991.
  misc_feature (1)..(188): Functional Homolog Of Ceres SEEDLINE ID no. ME09090
MNLHQDMEREQMRMAILKQEQIFRQQVHELHRLYHVQKQLMQQMPTTVSSNRAPVIVDVKPKPQLDIWHGEKATNPQQLISFSSYKAHAPAPAPAEDCNLELTLATGPSTSGSCNAERQQGKRLKSSSNSDSGTTAVSSTSTDSELAQFREADVMASAAARFPGESRRRMDQMGQGPWMYQCLSLKTA

SEQ ID NO: 2065 - protein, 197 aa, Oryza sativa subsp. indica
  misc_feature (1)..(197): useful for making plants with increased cold tolerance as described in USSN 12/514,991
  misc_feature (1)..(197): Public GI ID no.125537171
  misc_feature (1)..(197): Score of 132.9 for HMM of FIGURE 2 of USSN 12/514,991.
  misc_feature (1)..(197): Functional Homolog Of Ceres SEEDLINE ID no. ME09090
MDKLVRQCDMEVMKMAMLKHEETFRQQVHELHRLYRIQRQLMSDLTMAELSSGHRRRQPRRSSKQPRRALNLQLPADEYIVNADAADDNDDTAELDLTLAVGGGRSSRKCNAAIAAAAAAAAGGSSPFASDCSGSGLSSSPSSAEYSDGAAMFLHAPPPMPPPCQRAMAFDLAMGDAMKQQQSPWLVQCQYLSLRMT

SEQ ID NO: 2066 - protein, 302 aa, Oryza sativa subsp. japonica
  misc_feature (1)..(302): useful for making plants with increased cold tolerance as described in USSN 12/514,991
  misc_feature (1)..(302): Public GI ID no.50582687
  misc_feature (1)..(302): Score of 182.1 for HMM of FIGURE 2 of USSN 12/514,991.
  misc_feature (1)..(302): Functional Homolog Of Ceres SEEDLINE ID no. ME09090
MEYICTVGDPEDLRKKLISLVNLIRTCANEFVWKSIICTGGILPLAEIPQNFMVEKESRQIMQQDDHGTWKSAHVHVHGTVSEYHQLADLSQGQEHNKNKVKLKMMVQMEKLVRQCDMEVMKMAMLKHEETFKQQVYELHRLYRVQKQLMSDLNRSPPELTCRRRQRRKQHTRRRALNLQLPADEYIVVADAGGQATPLPPPPPSSREDELALTLAVGGGGAAGRRNNKRRESSPFTSNCSGGSLTTATSTSTSSSTDSDGSLRQPPPCPRAMAFDVLHDGSTAAAAAAAPWLQQRLSLRMA

SEQ ID NO: 2067 - protein, 199 aa, Oryza sativa subsp. japonica
  misc_feature (1)..(199): useful for making plants with increased cold tolerance as described in USSN 12/514,991
  misc_feature (1)..(199): Public GI ID no.77556291
  misc_feature (1)..(199): Score of 134.7 for HMM of FIGURE 2 of USSN 12/514,991.
  misc_feature (1)..(199): Functional Homolog Of Ceres SEEDLINE ID no. ME09090
MMRMDKLVRQCDMEVMKMAMLKHEETFRQQVHELHRLYRIQRQLMSDLTMAELSSGHRRRQPRRSSKQPRRALNLQLPADEYIVSADAADDNDDTAELDLTLAVGGGRSSRKCNAAIAAAAAAAGGSSPFASDCSGSGLSSSPSSAEYSDGAAMFLHAPPPMPPPCQRAMAFDLAMGDAMKQQQSPWLVQCQYLSLRMT

SEQ ID NO: 2068 - protein, 191 aa, Oryza sativa subsp. japonica
  misc_feature (1)..(191): useful for making plants with increased cold tolerance as described in USSN 12/514,991
  misc_feature (1)..(191): Public GI ID no.115453727
  misc_feature (1)..(191): Score of 104.8 for HMM of FIGURE 2 of USSN 12/514,991.
  misc_feature (1)..(191): Functional Homolog Of Ceres SEEDLINE ID no. ME09090
MSRYLKQYEKEHMKMAMLRQEETFKQQVQELHRLYRVQKLLMDAGSAITMQGISCIPEDDYHAEENEAGSSRPWHTFPGSDNDKPQAHTSVLEESELDLTLAIGRTTTTKKEAPSSSVDSRTSNSSSSTESGSTNCRAVMPHRPSRLGSSSAVKVVAGGPGVGTTQQHLDLEQQDALKQPPWLHRCLNLAR

SEQ ID NO: 2069 - protein, 155 aa, Oryza sativa subsp. japonica
  misc_feature (1)..(155): useful for making plants with increased cold tolerance as described in USSN 12/514,991
  misc_feature (1)..(155): Public GI ID no.115488726
  misc_feature (1)..(155): Score of 193.4 for HMM of FIGURE 2 of USSN 12/514,991.
  misc_feature (1)..(155): Functional Homolog Of Ceres SEEDLINE ID no. ME09090
MEKEHIKMAILKQEQTFRQQVNELHRVYRVQKQLMIEMQSISTQAQAKADNRTIPRLEMDHQQWYRNSGEKKAPEFVEDFDLELTLATGAGRKQEKPSNSDSGATVSSSTSAESESEQRFPESNVALRFQNESKRHDDQLMQSPWLYQCLSLKMA

SEQ ID NO: 2070 - protein, 209 aa, Oryza sativa subsp. japonica
  misc_feature (1)..(209): useful for making plants with increased cold tolerance as described in USSN 12/514,991
  misc_feature (1)..(209): Public GI ID no.115486361
  misc_feature (1)..(209): Score of 119.9 for HMM of FIGURE 2 of USSN 12/514,991.
  misc_feature (1)..(209): Functional Homolog Of Ceres SEEDLINE ID no. ME09090
MEREQMRMAILRQEQTFRQQVHELHRLYHVQKQLMKQMQIAKLNQAQAIAANAETKPKFEITFAENSTNHHHHHQFYSFQSSKIMSPPAAAAAAADQEEEEECDLQLTLATGSSGGGDGTARGHKGKKEVRSSNSDSGTAASSTSTESELAQFKNHHHHQLDCAAAAPVASPAARFQGESKKRVVVVVDNEMSLLQPPWLNQCLSLRMA

SEQ ID NO: 2071 - DNA, 657 bp, Sorghum bicolor
  misc_feature (1)..(657): useful for making plants with increased cold tolerance as described in USSN 12/514,991
  misc_feature (1)..(657): Ceres ANNOT ID no.6034678
atggagcaagcattcaggcactgcgataaagacacgctgaagatggccatgctgaaacatgaagagactttcagacagcaagttcacgagctccatcgcctatacaggattcaaaagcttctgatgcgagacctcaaacgggagctcaagagccagaggaacctgtccacctcgccgaacggaagctgcaccgagtacaacataggagctctcggcatgtgcacctatgagcaccgctacgccgctcgcggccgcggcggacacgtcgcagcagcgacgccgacgccgcgcaccgctctcagcctcgacgtcgtggcgccagtcatcgagtacgtgcggagcgcggaggaggaggacgacgacgaggcggaggaaaccgacgacgacgcggagctggagctcacgctcgccgtgggcggagccggggccaagaagaggtacggcgagtacccgtccggtggggagagcctctcgtcgtcgtccacggaatccgacgtgctcaccgtctccggccgtgagtggcgccaggcgcgcggcacgccgtatcacaagaggaggccggcgaccgggctggacgtggttcaggtggaggacggcgtcggggtgcagccaccgccgccgctgctgttccactggctcagcctcaagatggcatga

SEQ ID NO: 2072 - protein, 218 aa, Sorghum bicolor
  misc_feature (1)..(218): useful for making plants with increased cold tolerance as described in USSN 12/514,991
  misc_feature (1)..(218): Ceres ANNOT ID no.6034678
  misc_feature (1)..(218): Score of 88.8 for HMM of FIGURE 2 of USSN 12/514,991.
  misc_feature (1)..(218): Functional Homolog Of Ceres SEEDLINE ID no. ME09090
MEQAFRHCDKDTLKMAMLKHEETFRQQVHELHRLYRIQKLLMRDLKRELKSQRNLSTSPNGSCTEYNIGALGMCTYEHRYAARGRGGHVAAATPTPRTALSLDVVAPVIEYVRSAEEEDDDEAEETDDDAELELTLAVGGAGAKKRYGEYPSGGESLSSSSTESDVLTVSGREWRQARGTPYHKRRPATGLDVVQVEDGVGVQPPPPLLFHWLSLKMA

SEQ ID NO: 2073 - DNA, 642 bp, Sorghum bicolor
  misc_feature (1)..(642): useful for making plants with increased cold tolerance as described in USSN 12/514,991
  misc_feature (1)..(642): Ceres ANNOT ID no.6074420
atgatgatggacaggcagcagctcgtgaggcaatgcgacatggaggtcatgaagatggccatgctcaagcacgaagaaaccttcaggcagcaggtccacgagctgcaccgcctgtaccgcatccagagggagctgatgagcgacctgacccgagacgtcgacgcgccggcgctgctaaccaccaccacccgccggcgcagcaagcagccacggcgggcgctgaacttgcagctcccggccgacgagtacatcgtcagtgccgacgaggaccacgaccacgccgccggcacggagctagagctgacgctcgccatcggcgggcgctgctcatcagccgccggcactggcagccgtcgcaagaaccacaggaggaggcagcgcgacaacgccggtagtggcggctcctcctcgcccttcgggtccgactgctccggcgccagcgtcctgtcgtcgtcgtcgccgccgtcgtccgccgagtactactccgacgacgggccggcggtgttccacgcgccgccgccgccgccgccgccgccgtgccagagggccgtggcgtttgaccttggagaaggcatgatgatgaggcagcacgcgccgtggctgctgcagtgccagcagtacctcagcctgaggatgacatga

SEQ ID NO: 2074 - protein, 213 aa, Sorghum bicolor
  misc_feature (1)..(213): useful for making plants with increased cold tolerance as described in USSN 12/514,991
  misc_feature (1)..(213): Ceres ANNOT ID no.6074420
  misc_feature (1)..(213): Score of 124.8 for HMM of FIGURE 2 of USSN 12/514,991.
  misc_feature (1)..(213): Functional Homolog Of Ceres SEEDLINE ID no. ME09090
MMMDRQQLVRQCDMEVMKMAMLKHEETFRQQVHELHRLYRIQRELMSDLTRDVDAPALLTTTTRRRSKQPRRALNLQLPADEYIVSADEDHDHAAGTELELTLAIGGRCSSAAGTGSRRKNHRRRQRDNAGSGGSSSPFGSDCSGASVLSSSSPPSSAEYYSDDGPAVFHAPPPPPPPPCQRAVAFDLGEGMMMRQHAPWLLQCQQYLSLRMT

SEQ ID NO: 2075 - DNA, 645 bp, Sorghum bicolor
  misc_feature (1)..(645): useful for making plants with increased cold tolerance as described in USSN 12/514,991
  misc_feature (1)..(645): Ceres ANNOT ID no.6074418
atgatgatggacaggcagcagctcgtgaggcaatgcgacatggaggtcatgaagatggccatgctcaagcacgaagaaaccttcaggcagcaggtccacgagctgcaccgcctgtaccgcatccagagggagctgatgagtggtgacctgacccgagacgcgccggagctgaccatgtccatgaccacccggcgccggcgcagcaagcagccacggcgggcgctgaacctgcagctcccagccgacgagtacatcgtcagtgccgacgaggacgaggacgctgacgccgccgcctgcacggagctggagctgacgctggccatcggcgggcggcggtgctcggccggcggcagccgtcgcaagagcaacgggaggaggcaacaacaagcagagcagcgcgacaacgccggctccgcctccccgttcgggtccgactgctccggcgcgagcgtcctgtcgtcgtcgccgtcgccgccgtcggccgagtactactccgacgacgggccggcggtgttccacgcgctgccaccgccaccgccgtgccagagggccgtggcgtttgaccttggaggaggcatgatgatgaggcagcacgcgccgtggctgcagcagtgccatcagtacctcagcctgaggatgacatga

SEQ ID NO: 2076 - protein, 214 aa, Sorghum bicolor
  misc_feature (1)..(214): useful for making plants with increased cold tolerance as described in USSN 12/514,991
  misc_feature (1)..(214): Ceres ANNOT ID no.6074418
  misc_feature (1)..(214): Score of 126.5 for HMM of FIGURE 2 of USSN 12/514,991.
  misc_feature (1)..(214): Functional Homolog Of Ceres SEEDLINE ID no. ME09090
MMMDRQQLVRQCDMEVMKMAMLKHEETFRQQVHELHRLYRIQRELMSGDLTRDAPELTMSMTTRRRRSKQPRRALNLQLPADEYIVSADEDEDADAAACTELELTLAIGGRRCSAGGSRRKSNGRRQQQAEQRDNAGSASPFGSDCSGASVLSSSPSPPSAEYYSDDGPAVFHALPPPPPCQRAVAFDLGGGMMMRQHAPWLQQCHQYLSLRMT

SEQ ID NO: 2077 - DNA, 570 bp, Sorghum bicolor
  misc_feature (1)..(570): useful for making plants with increased cold tolerance as described in USSN 12/514,991
  misc_feature (1)..(570): Ceres ANNOT ID no.6094914
atggagaataagcttgcgagtcactgcgacatggagctcgtgaagatggccatgctcaggcacgaagagaccttcaggcagcaggtccacgagctgcaccggctgtaccgcgtccagaagcacctgatgttgtcgtcggagctcgtcagctgccggcgccagatcaggcggcggcgcaggcagcagccgcggcgcgcgctggacgtgcacctgcgcctccccgccgacgagtgcgtcgtcgtcgcgccaccgccgtcagcggacgacgggctggagctgacgctggccatcggcagtagtggtagtggcggccggggccggaggcggcgccgggatgaggctgatgagagcacggccaccgctactccccccttggcctcggagtcggacatctccggcgagagcctgctgacgacgtcgtcgtcgacggacaccggcggatcgccgccgtatcagattcagagggcgatgccggcgttccgtctccaggaagcgacgacgccggtggtgaagcagccgccgccgcggtcgccatggctcgtgcagcgagtcagcctcgagatggcgtga

SEQ ID NO: 2078 - protein, 189 aa, Sorghum bicolor
  misc_feature (1)..(189): useful for making plants with increased cold tolerance as described in USSN 12/514,991
  misc_feature (1)..(189): Ceres ANNOT ID no.6094914
  misc_feature (1)..(189): Score of 101.2 for HMM of FIGURE 2 of USSN 12/514,991.
  misc_feature (1)..(189): Functional Homolog Of Ceres SEEDLINE ID no. ME09090
MENKLASHCDMELVKMAMLRHEETFRQQVHELHRLYRVQKHLMLSSELVSCRRQIRRRRRQQPRRALDVHLRLPADECVVVAPPPSADDGLELTLAIGSSGSGGRGRRRRRDEADESTATATPPLASESDISGESLLTTSSSTDTGGSPPYQIQRAMPAFRLQEATTPVVKQPPPRSPWLVQRVSLEMA

SEQ ID NO: 2079 - protein, 207 aa, Arabidopsis thaliana
  misc_feature (1)..(207): useful for making plants with increased cold tolerance as described in USSN 12/514,991
  misc_feature (1)..(207): Ceres SEEDLINE ID no.ME25677
  misc_feature (70)..(124): Pfam Name: Auxin_inducible Pfam Description: Auxin responsive protein
  misc_feature (1)..(207): Score of 40.8 for HMM of FIGURE 1 of USSN 12/514,991.
  misc_feature (1)..(207): Functional Homolog Of Ceres SEEDLINE ID no. ME12469
MQAYNRSKTRREEQEEKHMTQMEELVHQCDMEVMKMAMLKHEQTFRQQVHDLHRLYRVQKQLMGDQSGRPSVPPCHQVQRRREHPRRPELSLQLPVDDDEYAVVSGGTGRLATPPSMESEDELELTLAVGGGGGNGGSSRSQRRRRESATDCSGRRSPQTPSSSTDSDDALRTVPHHQRATACDLRGGVMVSKQPQWLVRCLSLRMA

SEQ ID NO: 2080 - protein, 119 aa, Arabidopsis thaliana
  misc_feature (1)..(119): useful for making plants with increased cold tolerance as described in USSN 12/514,991
  misc_feature (1)..(119): Ceres SEEDLINE ID no.ME02192
  misc_feature (1)..(119): Also Known As Ceres ME LINE ME14195
  misc_feature (10)..(102): Pfam Name: Auxin_inducible Pfam Description: Auxin responsive protein
  misc_feature (1)..(119): Score of 126.6 for HMM of FIGURE 1 of USSN 12/514,991.
  misc_feature (1)..(119): Functional Homolog Of Ceres SEEDLINE ID no. ME12469
MAKVGKLTKLKSAMKKWPSFAKNHHHSTSSAAVSDELSEDNNLHVVYVGQTRRPYMLRPDIISHPLFQELVDRSSSRSIEQDREIVVACEVVLFEHLLWMLKSGQEGGSVEELAEFYTY

SEQ ID NO: 2081 - protein, 132 aa, Arabidopsis thaliana
  misc_feature (1)..(132): useful for making plants with increased cold tolerance as described in USSN 12/514,991
  misc_feature (1)..(132): Ceres SEEDLINE ID no.ME25264
  misc_feature (4)..(114): Pfam Name: Auxin_inducible Pfam Description: Auxin responsive protein
  misc_feature (1)..(132): Score of 149 for HMM of FIGURE 1 of USSN 12/514,991.
  misc_feature (1)..(132): Functional Homolog Of Ceres SEEDLINE ID no. ME12469
MKQLIRRLSRVADSAQYSLLRSDSQRPSRRSESFLRSSVTRRSKKQTSSVPEGHVPVYVGDEMERFVVSAELLNHPVFIGLLNRSAQEYGYEQKGVLQIPCHVLVFERIMESLRLGLPVPIDVQDLIGDGTI

SEQ ID NO: 2082 - protein, 111 aa, Arabidopsis thaliana
  misc_feature (1)..(111): useful for making plants with increased cold tolerance as described in USSN 12/514,991
  misc_feature (1)..(111): Ceres SEEDLINE ID no.ME25217
  misc_feature (32)..(92): Pfam Name: Auxin_inducible Pfam Description: Auxin responsive protein
  misc_feature (1)..(111): Score of 123.9 for HMM of FIGURE 1 of USSN 12/514,991.
  misc_feature (1)..(111): Functional Homolog Of Ceres SEEDLINE ID no. ME12469
MRTLVKKLLWCGAKNISSSRTSALPEEGRVRVYVGKDKESQCKLEVEANLLNHPMLEDLLRLSEEEFGHSYEGALRIACEIDVFIKLVNLHKTTNHHNNSVCFHNNSTKLL

SEQ ID NO: 2083 - protein, 183 aa, Arabidopsis thaliana
  misc_feature (1)..(183): useful for making plants with increased cold tolerance as described in USSN 12/514,991
  misc_feature (1)..(183): Ceres SEEDLINE ID no.ME25456
  misc_feature (58)..(119): Pfam Name: Auxin_inducible Pfam Description: Auxin responsive protein
  misc_feature (1)..(183): Score of 131.5 for HMM of FIGURE 1 of USSN 12/514,991.
  misc_feature (1)..(183): Functional Homolog Of Ceres SEEDLINE ID no. ME12469
MKNPILKTWRKVKSFGHTSSSTTPSFTKSKSCHGSFRLEDAKSNESKGKPKKESPSHGFFTVYVGPTKQRIVVKTKLLNHPLFKNLLEDAETEYGYRRDGPIVLPCEVDFFFKALADMKSNPGHHDHDDDYDDDDGFTNSPICGFVCSPYRSYGGGVTDPLAMKRNGSYKLLRSPSLFKLTRF

SEQ ID NO: 2084 - protein, 124 aa, Arabidopsis thaliana
  misc_feature (1)..(124): useful for making plants with increased cold tolerance as described in USSN 12/514,991
  misc_feature (1)..(124): Ceres SEEDLINE ID no.ME25221
  misc_feature (48)..(113): Pfam Name: Auxin_inducible Pfam Description: Auxin responsive protein
  misc_feature (1)..(124): Score of 135.9 for HMM of FIGURE 1 of USSN 12/514,991.
  misc_feature (1)..(124): Functional Homolog Of Ceres SEEDLINE ID no. ME12469
MKSKFIKSCEKKLKKMTSKVIIPCASCESCYERICWAFKKEAEVIPRDVPKGHLVVYVGEEYKRFVININLLKHPLFQALLDQAQDAYGFSADSRLWIPCNESTFLDVVRCAGAPQHQNNCICI

SEQ ID NO: 2085 - protein, 113 aa, Arabidopsis thaliana
  misc_feature (1)..(113): useful for making plants with increased cold tolerance as described in USSN 12/514,991
  misc_feature (1)..(113): Ceres SEEDLINE ID no.ME25219
  misc_feature (48)..(108): Pfam Name: Auxin_inducible Pfam Description: Auxin responsive protein
  misc_feature (1)..(113): Score of 121 for HMM of FIGURE 1 of USSN 12/514,991.
  misc_feature (1)..(113): Functional Homolog Of Ceres SEEDLINE ID no. ME12469
MCKKFKIFMRKLQICCLFTRFSKRVGNYCEFEEEGNAASMIPSDVKEGHVAVIAVKGERIKRFVLELEELNKPEFLRLLEQAREEFGFQPRGPLTIPCQPEEVQKILQGSRES

SEQ ID NO: 2086 - protein, 124 aa, Arabidopsis thaliana; identical to SEQ ID NO: 2007
  misc_feature (1)..(124): useful for making plants with increased cold tolerance as described in USSN 12/514,991
  misc_feature (1)..(124): Ceres SEEDLINE ID no.ME02978
  misc_feature (22)..(111): Pfam Name: Auxin_inducible Pfam Description: Auxin responsive protein
  misc_feature (1)..(124): Score of 146.7 for HMM of FIGURE 1 of USSN 12/514,991.
  misc_feature (1)..(124): Functional Homolog Of Ceres SEEDLINE ID no. ME12469

SEQ ID NO: 2087 - protein, 105 aa, Arabidopsis thaliana
  misc_feature (1)..(105): useful for making plants with increased cold tolerance as described in USSN 12/514,991
  misc_feature (1)..(105): Ceres SEEDLINE ID no.ME25211
  misc_feature (5)..(105): Pfam Name: Auxin_inducible Pfam Description: Auxin responsive protein
  misc_feature (1)..(105): Score of 191.2 for HMM of FIGURE 1 of USSN 12/514,991.
  misc_feature (1)..(105): Functional Homolog Of Ceres SEEDLINE ID no. ME12469
MAVKRSSKLTQTAMLKQILKRCSSLGKKQCYDEEGLPLDVPKGHFPVYVGEKRTRYIVPISFLTHPEFLILLQQAEEEFGFRHDMGGLTIPCEEVVFLSLTSMIR

SEQ ID NO: 2088 - protein, 150 aa, Arabidopsis thaliana
  misc_feature (1)..(150): useful for making plants with increased cold tolerance as described in USSN 12/514,991
  misc_feature (1)..(150): Ceres SEEDLINE ID no.ME25266
  misc_feature (7)..(101): Pfam Name: Auxin_inducible Pfam Description: Auxin responsive protein
  misc_feature (1)..(150): Score of 222.5 for HMM of FIGURE 1 of USSN 12/514,991.
  misc_feature (1)..(150): Functional Homolog Of Ceres SEEDLINE ID no. ME12469
MGKNNKIGSVVRIRQMLKQWQKKAHIGSSNNDPVSDVPPGHVAVSVGENRRRYVVRAKHLNHPIFRRLLAEAEEEYGFANVGPLAIPCDESLFEDIIAIVTRCESSSSSGRGNPPAATLEDLRRCSHVGLAKNNVESRPLLPGIAEKSVC

SEQ ID NO: 2089 - protein, 142 aa, Arabidopsis thaliana
  misc_feature (1)..(142): useful for making plants with increased cold tolerance as described in USSN 12/514,991
  misc_feature (1)..(142): Ceres SEEDLINE ID no.ME20371
  misc_feature (21)..(115): Pfam Name: Auxin_inducible Pfam Description: Auxin responsive protein
  misc_feature (1)..(142): Score of 182.4 for HMM of FIGURE 1 of USSN 12/514,991.
  misc_feature (1)..(142): Functional Homolog Of Ceres SEEDLINE ID no. ME12469
MGFEENQKQSPKQSPNHIKHMVFKFHFHVPHLHILPHHHHHHHHDVPKGCVAIMVGHEDDEEGLHRFVVPLVFLSHPLFLDLLKEAEKEYGFKHDGPITIPCGVDEFKHVQEVIDEETHRRHSHGGHGHNNHNHHNNHLRCF

SEQ ID NO: 2090 - protein, 108 aa, Arabidopsis thaliana
  misc_feature (1)..(108): useful for making plants with increased cold tolerance as described in USSN 12/514,991
  misc_feature (1)..(108): Ceres SEEDLINE ID no.ME25205
  misc_feature (6)..(108): Pfam Name: Auxin_inducible Pfam Description: Auxin responsive protein
  misc_feature (1)..(108): Score of 169.4 for HMM of FIGURE 1 of USSN 12/514,991.
  misc_feature (1)..(108): Functional Homolog Of Ceres SEEDLINE ID no. ME12469
MSILKKSTKLAQTAMLRQILKRCSSLGKKNGGGGYEEVDLPLDVPKGHFPVYVGHNRSRYIVPISFLTNLDFQCLLRRAEEEFGFDHDMGLTIPCDELFFQDLTSMIR

SEQ ID NO: 2091 - protein, 103 aa, Arabidopsis thaliana
  misc_feature (1)..(103): useful for making plants with increased cold tolerance as described in USSN 12/514,991
  misc_feature (1)..(103): Ceres SEEDLINE ID no.ME25206
  misc_feature (28)..(96): Pfam Name: Auxin_inducible Pfam Description: Auxin responsive protein
  misc_feature (1)..(103): Score of 127.1 for HMM of FIGURE 1 of USSN 12/514,991.
  misc_feature (1)..(103): Functional Homolog Of Ceres SEEDLINE ID no. ME12469
MPHKVIDMHFHEREEEEDTGESRSSSRTPRGHFVVYVGTKKKLERFVIPTTFLKSPSFQKLLDNAAEEFGYAEAHRDKIVLPCDVSTFRSLVMFLTSHQDKSH

SEQ ID NO: 2092 - protein, 104 aa, Arabidopsis thaliana
  misc_feature (1)..(104): useful for making plants with increased cold tolerance as described in USSN 12/514,991
  misc_feature (1)..(104): Ceres SEEDLINE ID no.ME25209
  misc_feature (7)..(104): Pfam Name: Auxin_inducible Pfam Description: Auxin responsive protein
  misc_feature (1)..(104): Score of 173.9 for HMM of FIGURE 1 of USSN 12/514,991.
  misc_feature (1)..(104): Functional Homolog Of Ceres SEEDLINE ID no. ME12469
MAIKKSNKAALSQAASLKQILKRCSSLGKKNQGNCYFNDVPKGHFPVYVGQHRSRYVVPISWLDHHEFQSLLQLAEEEFGFEHEMGLTIPCDEVVFRSLISMFR

SEQ ID NO: 2093 - protein, 89 aa, Arabidopsis thaliana
  misc_feature (1)..(89): useful for making plants with increased cold tolerance as described in USSN 12/514,991
  misc_feature (1)..(89): Ceres SEEDLINE ID no.ME07184
  misc_feature (1)..(89): Pfam Name: Auxin_inducible Pfam Description: Auxin responsive protein
  misc_feature (1)..(89): Score of 148.9 for HMM of FIGURE 1 of USSN 12/514,991.
  misc_feature (1)..(89): Functional Homolog Of Ceres SEEDLINE ID no. ME12469
MAFLRSFLGAKQIIRRESSSTPRGFMAVYVGENDQKKKRYVVPVSYLNQPLFQQLLSKSEEEFGYDHPMGGLTIPCHESLFFTVTSQIQ

SEQ ID NO: 2094 - protein, 148 aa, Arabidopsis thaliana
  misc_feature (1)..(148): useful for making plants with increased cold tolerance as described in USSN 12/514,991
  misc_feature (1)..(148): Ceres SEEDLINE ID no.ME25265
  misc_feature (11)..(105): Pfam Name: Auxin_inducible Pfam Description: Auxin responsive protein
  misc_feature (1)..(148): Score of 228.2 for HMM of FIGURE 1 of USSN 12/514,991.
  misc_feature (1)..(148): Functional Homolog Of Ceres SEEDLINE ID no. ME12469
MAGGIGKCSKIRHIVKLRQMLRQWRNKARMSSVRRSVPSDVPSGHVAVYVGRSCRRFVVLATYLNHPILMNLLVKAEEEFGFANQGPLVIPCEESVFEESIRFITRSSRFTCTDDLKKNRHGGIRSKLDLLMESRPLLHGVSEKAIIW

SEQ ID NO: 2095 - protein, 99 aa, Arabidopsis thaliana
  misc_feature (1)..(99): useful for making plants with increased cold tolerance as described in USSN 12/514,991
  misc_feature (1)..(99): Ceres SEEDLINE ID no.ME25243
  misc_feature (1)..(98): Pfam Name: Auxin_inducible Pfam Description: Auxin responsive protein
  misc_feature (1)..(99): Score of 165.2 for HMM of FIGURE 1 of USSN 12/514,991.
  misc_feature (1)..(99): Functional Homolog Of Ceres SEEDLINE ID no. ME12469
MGVERGSGKGLKQMLKRCSSLGKKSSVDVNFNGVPKGHFVVYVGHSRSRHVIPISFLTHPIFQMLLQQSEEEFGFFQDNGLTIPCDEHFFRALISSINP

SEQ ID NO: 2096 - protein, 172 aa, Arabidopsis thaliana
  misc_feature (1)..(172): useful for making plants with increased cold tolerance as described in USSN 12/514,991
  misc_feature (1)..(172): Ceres SEEDLINE ID no.ME05746
  misc_feature (25)..(124): Pfam Name: Auxin_inducible Pfam Description: Auxin responsive protein
  misc_feature (1)..(172): Score of 240.1 for HMM of FIGURE 1 of USSN 12/514,991.
  misc_feature (1)..(172): Functional Homolog Of Ceres SEEDLINE ID no. ME12469
PLTFSFSHKENQITKPEKMAGGLGKCSKIRHIVRLRQMLRRWRDQARMSSSFSRCVPSDLPSGHVAVYVGSSCRRFVVRATYLNHPVLRNLLVQAEEEFGFVNQGPLVIPCEESVFEESIRFISRSDSTRSRRFTCPDDFQKNCHVVGIRSKPDLWIESRPLLHGVTEKAVW

SEQ ID NO: 2097 - DNA, 570 bp, Sorghum bicolor
  misc_feature (1)..(570): useful for making plants with increased cold tolerance as described in USSN 12/514,991
  misc_feature (1)..(570): Ceres ANNOT ID no.6042104
atgggcgacgacggcgcgaaggcggcggcgacgggcatcaagcagatcgtgcggctgcgagagctgctgcacaagtggcacttgatggcgctgggcgcgaagcagcagcgggatcatcaggaggacgacgaggaccacgccggcggcggcgtgccggatcaggatgcggtggcgtcggcgatcccgccgttcgtgctgcggcggctgcggcgcgcggagacggcggactcggtgctgtcggacgacgagagctacagccctgagccgccgccggacgttccccggggctactgccccgtgtacgtcgggccggagcagcggcggttcgtgatcccgaccagctacctggcgcaccccgtgttccggctcctgctggagaaggccgaggaggagttcgggttccggcaccagggcgcgctcgccatcccctgcgagaccgaggccttcaagtacatcctccagtgcgtcgagcgccacgacaagggcctcgccgccgccgccgccggcgacgaagcagcgaaccaccggaccgtcgtgctggagcaagagccagcgatgcatcatgcttaa

SEQ ID NO: 2098 - protein, 189 aa, Sorghum bicolor
  misc_feature (1)..(189): useful for making plants with increased cold tolerance as described in USSN 12/514,991
  misc_feature (1)..(189): Ceres ANNOT ID no.6042104
  misc_feature (65)..(157): Pfam Name: Auxin_inducible Pfam Description: Auxin responsive protein
  misc_feature (1)..(189): Score of 111.3 for HMM of FIGURE 1 of USSN 12/514,991.
  misc_feature (1)..(189): Functional Homolog Of Ceres SEEDLINE ID no. ME12469
MGDDGAKAAATGIKQIVRLRELLHKWHLMALGAKQQRDHQEDDEDHAGGGVPDQDAVASAIPPFVLRRLRRAETADSVLSDDESYSPEPPPDVPRGYCPVYVGPEQRRFVIPTSYLAHPVFRLLLEKAEEEFGFRHQGALAIPCETEAFKYILQCVERHDKGLAAAAAGDEAANHRTVVLEQEPAMHHA

SEQ ID NO: 2099 - DNA, 516 bp, Sorghum bicolor
  misc_feature (1)..(516): useful for making plants with increased cold tolerance as described in USSN 12/514,991
  misc_feature (1)..(516): Ceres ANNOT ID no.6007020
atggagcagtccggcgccaagaagtcgaacaagatcaccgagatcgtgcgcatgcagcagatgctgaagaagtggcgcaagctctcggtcacccccaaggacaaggagccaagctcgcccaccgccgccggcggcggcggcaatgccggcgagagcaaggccaagaagttcctgaagcggacgctttccttcacggacggcccgccgtcgggctcccctccgccgccgcccaagggccacctcgccgtgtgcgtgggccccgcgatgcagaggttcgtgatcccgatggagtacctgaagcaccgcgccttcgcggcgctgctgcgggaggccgaggaggagttcggcttccagcaggagggcgtgctccgcatcccctgcgaggtccccgtcttcgagtccatcctcaaggccgtcgagaagaacaagaaggacgccgccttctgttactgcagcgtcgagtacgccgccgacgaggtcggacgtggcacgcccaacaacccgctctgcagatag

SEQ ID NO: 2100 - protein, 171 aa, Sorghum bicolor
  misc_feature (1)..(171): useful for making plants with increased cold tolerance as described in USSN 12/514,991
  misc_feature (1)..(171): Ceres ANNOT ID no.6007020
  misc_feature (52)..(140): Pfam Name: Auxin_inducible Pfam Description: Auxin responsive protein
  misc_feature (1)..(171): Score of 128.8 for HMM of FIGURE 1 of USSN 12/514,991.
  misc_feature (1)..(171): Functional Homolog Of Ceres SEEDLINE ID no. ME12469
MEQSGAKKSNKITEIVRMQQMLKKWRKLSVTPKDKEPSSPTAAGGGGNAGESKAKKFLKRTLSFTDGPPSGSPPPPPKGHLAVCVGPAMQRFVIPMEYLKHRAFAALLREAEEEFGFQQEGVLRIPCEVPVFESILKAVEKNKKDAAFCYCSVEYAADEVGRGTPNNPLCR

SEQ ID NO: 2101 - DNA, 438 bp, Sorghum bicolor
  misc_feature (1)..(438): useful for making plants with increased cold tolerance as described in USSN 12/514,991
  misc_feature (1)..(438): Ceres ANNOT ID no.6020339
atggaggagtaccagcaagtgcagcagcagcatcagggtggtggccgggggagcaacaagatccgggacatcgtgcggctgcagcagctgctgaagaagtggaagaagctggcgacggtgacgccgtcggcggcgtcgggcggcaagggcggcgggaggagcagcgtgccgaggggctccttcgcggtgtacgtgggcgaggagatgcggcggttcgtgatccccaccgagtacctgggccactgggcattcgcggagctgctccgggaggccgaggaggagttcgggttccggcacgagggcgcgctccggatcccctgcgacgtcgagtccttcgaggccatcctccgcctcgtgcagcagggcggcggcaggaagaaggagcccactgccgccatgtgcgactgctcctccgagaccgagatcctctgcagatga

SEQ ID NO: 2102 - protein, 145 aa, Sorghum bicolor
  misc_feature (1)..(145): useful for making plants with increased cold tolerance as described in USSN 12/514,991
  misc_feature (1)..(145): Ceres ANNOT ID no.6020339
  misc_feature (27)..(120): Pfam Name: Auxin_inducible Pfam Description: Auxin responsive protein
  misc_feature (1)..(145): Score of 131.1 for HMM of FIGURE 1 of USSN 12/514,991.
  misc_feature (1)..(145): Functional Homolog Of Ceres SEEDLINE ID no. ME12469
MEEYQQVQQQHQGGGRGSNKIRDIVRLQQLLKKWKKLATVTPSAASGGKGGGRSSVPRGSFAVYVGEEMRRFVIPTEYLGHWAFAELLREAEEEFGFRHEGALRIPCDVESFEAILRLVQQGGGRKKEPTAAMCDCSSETEILCR

SEQ ID NO: 2103 - DNA, 414 bp, Sorghum bicolor
  misc_feature (1)..(414): useful for making plants with increased cold tolerance as described in USSN 12/514,991
  misc_feature (1)..(414): Ceres ANNOT ID no.6018684
atgatggccatgagctacttccgggcgccgagacggctctacgggaggaagcagcaccagcagcagaagcgggagagtgcagccctgctggtggacgaggacggcggcgacgaccaaggcgaggcggcggcggcggcgggcgcggtgcccaagggctacttcgccgtgtacgtgggcgccgagtcccggcggttcgtggtgcccacgagctacctcagcgagccggcgttccgggagctcatggagcgcgccgcggaggagttcggcttcaaccaggccggcggcctccgcatcccctgccgcgaggaggacttccaggccaccgtcgccgctctcgagcagtccaggcgtcgcggcgccggctgggcgcgagggtcggccgccggaacaacgcgatgggctcgtgccagctag

SEQ ID NO: 2104 - protein, 137 aa, Sorghum bicolor
  misc_feature (1)..(137): useful for making plants with increased cold tolerance as described in USSN 12/514,991
  misc_feature (1)..(137): Ceres ANNOT ID no.6018684
  misc_feature (46)..(113): Pfam Name: Auxin_inducible Pfam Description: Auxin responsive protein
  misc_feature (1)..(137): Score of 91.7 for HMM of FIGURE 1 of USSN 12/514,991.
  misc_feature (1)..(137): Functional Homolog Of Ceres SEEDLINE ID no. ME12469
MMAMSYFRAPRRLYGRKQHQQQKRESAALLVDEDGGDDQGEAAAAAGAVPKGYFAVYVGAESRRFVVPTSYLSEPAFRELMERAAEEFGFNQAGGLRIPCREEDFQATVAALEQSRRRGAGWARGSAAGTTRWARAS

SEQ ID NO: 2105 - DNA, 453 bp, Sorghum bicolor
  misc_feature (1)..(453): useful for making plants with increased cold tolerance as described in USSN 12/514,991
  misc_feature (1)..(453): Ceres ANNOT ID no.6038217
atggcgaaatgcagcagcaagatccggtacatcgtgtggctccggcagacgctgcggcggtggcggtcccgggcggcggcgcgcgcggcggtggaggcggcggcggtcccggtcccggcgggccacgtggcggtgtgcgtgggcggcgcgtcgcggcggttcgtggtgcgggcggcgcacctgaaccaccccgtgttccgggagctgctccggcaggcggaggaggagtatgggttcccgtcgggggcctgcgccggccccatcgcgctcccctgcgacgagggcctcttcgagcacgtcctccgccacctctcctccccgtccaagtcctcccgcttcgtcaccctcgaggacctgaagagcggcgccggcctatcctgctgctgcgttgtcgccgccggcgactcgctcccgctcctccacggcatctccgccgacaaggccgtctggtga

SEQ ID NO: 2106 - protein, 150 aa, Sorghum bicolor
  misc_feature (1)..(150): useful for making plants with increased cold tolerance as described in USSN 12/514,991
  misc_feature (1)..(150): Ceres ANNOT ID no.6038217
  misc_feature (4)..(105): Pfam Name: Auxin_inducible Pfam Description: Auxin responsive protein
  misc_feature (1)..(150): Score of 124.8 for HMM of FIGURE 1 of USSN 12/514,991.
  misc_feature (1)..(150): Functional Homolog Of Ceres SEEDLINE ID no. ME12469
MAKCSSKIRYIVWLRQTLRRWRSRAAARAAVEAAAVPVPAGHVAVCVGGASRRFVVRAAHLNHPVFRELLRQAEEEYGFPSGACAGPIALPCDEGLFEHVLRHLSSPSKSSRFVTLEDLKSGAGLSCCCVVAAGDSLPLLHGISADKAVW

SEQ ID NO: 2107 - DNA, 468 bp, Sorghum bicolor
  misc_feature (1)..(468): useful for making plants with increased cold tolerance as described in USSN 12/514,991
  misc_feature (1)..(468): Ceres ANNOT ID no.6038196
atgtgcaaggtggcgatcacgattccgtccctcgtgtggctgcgccgcgccgtgcggcggtggcggtcccgtggccgcgccgcggatgcctccggcttctcctcctcctccccgcgtccctgcaccgcggtgccggcggggcacgtggcggtgtgcgtggaggccgccggcggatccggctccggctccaccaggcggttcgtggtgcgggtggcgcacctcagccacccggcgttccgggagctgctgcggcaggcggaggaggagtacggcttcccggcggcccccgggcccgtcgcgcttccctgcgacgaggaccacttcctcgacgtcctccaccgcgtgtcctcttcgggcaccaccgcctcctcctgctgcggcctcgccacgcggcggtgcgcgcgcggcgagtcgcggccgctgctgcaaggaagaataatggctgtggatcagaagctcgcctggtga

SEQ ID NO: 2108 - protein, 155 aa, Sorghum bicolor
  misc_feature (1)..(155): useful for making plants with increased cold tolerance as described in USSN 12/514,991
  misc_feature (1)..(155): Ceres ANNOT ID no.6038196
  misc_feature (17)..(116): Pfam Name: Auxin_inducible Pfam Description: Auxin responsive protein
  misc_feature (1)..(155): Score of 104.5 for HMM of FIGURE 1 of USSN 12/514,991.
  misc_feature (1)..(155): Functional Homolog Of Ceres SEEDLINE ID no. ME12469
MCKVAITIPSLVWLRRAVRRWRSRGRAADASGFSSSSPRPCTAVPAGHVAVCVEAAGGSGSGSTRRFVVRVAHLSHPAFRELLRQAEEEYGFPAAPGPVALPCDEDHFLDVLHRVSSSGTTASSCCGLATRRCARGESRPLLQGRIMAVDQKLAW

SEQ ID NO: 2109 - DNA, 402 bp, Sorghum bicolor
  misc_feature (1)..(402): useful for making plants with increased cold tolerance as described in USSN 12/514,991
  misc_feature (1)..(402): Ceres ANNOT ID no.6038197
atgtgcaaggcggtgatcacgctctcgtcgctcgtctggctgcgccacacgctgcggcggtggcggtcccgcgccgcggttccggcggggcacgtcgcggtgtccgtgcgaggcggcggcgacggcgacggggcggcgttggggccgaggcggttcgtggtgcgggtggcgcgcctcggccacccggcgttccgggacctgctgcggcaggctgaggaggagtacggcttcccggcgggtcccggaccgatcacgctcccctgcgacgagggccacttcctcgacgtcctcagccgcgtgtcctcgtcggtcgcctcctgcggcctccgtcggtgcgcgcgcggcgagtcccggccgctgctgcaggggagaatggccgtggatcacaacctcgtctggtga

SEQ ID NO: 2110 - protein, 133 aa, Sorghum bicolor
  misc_feature (1)..(133): useful for making plants with increased cold tolerance as described in USSN 12/514,991
  misc_feature (1)..(133): Ceres ANNOT ID no.6038197
  misc_feature (26)..(101): Pfam Name: Auxin_inducible Pfam Description: Auxin responsive protein
  misc_feature (1)..(133): Score of 94.8 for HMM of FIGURE 1 of USSN 12/514,991.
  misc_feature (1)..(133): Functional Homolog Of Ceres SEEDLINE ID no. ME12469
MCKAVITLSSLVWLRHTLRRWRSRAAVPAGHVAVSVRGGGDGDGAALGPRRFVVRVARLGHPAFRDLLRQAEEEYGFPAGPGPITLPCDEGHFLDVLSRVSSSVASCGLRRCARGESRPLLQGRMAVDHNLVW

SEQ ID NO: 2111 - DNA, 366 bp, Sorghum bicolor
  misc_feature (1)..(366): useful for making plants with increased cold tolerance as described in USSN 12/514,991
  misc_feature (1)..(366): Ceres ANNOT ID no.6091626
atgagggccctgctggaccggtgccgcctgtcgccgtcgtccaagaaggcccgcggccgcgagccgccggagggctgcctggcggtgtacgtgggcgcggcgagggagcggttcgtggtccgcaccgagtgcgtcaaccaccgcctgttcagggcgctgctggaggaggccgaggaggcgcgcgggccctactgctacgcggcggacgggccgctcgagctgccctgcgacgccgccgcgttcgcgcgcgccgtggaggcgatcgagcgggagatggccgaggagaggaccacggtcgggtgcggtggcgggggtatcgtgagggcaacgcactcggcagcgcaccggacggcggcagcgtggtga

SEQ ID NO: 2112 - protein, 121 aa, Sorghum bicolor
  misc_feature (1)..(121): useful for making plants with increased cold tolerance as described in USSN 12/514,991
  misc_feature (1)..(121): Ceres ANNOT ID no.6091626
  misc_feature (23)..(89): Pfam Name: Auxin_inducible Pfam Description: Auxin responsive protein
  misc_feature (1)..(121): Score of 58 for HMM of FIGURE 1 of USSN 12/514,991.
  misc_feature (1)..(121): Functional Homolog Of Ceres SEEDLINE ID no. ME12469
MRALLDRCRLSPSSKKARGREPPEGCLAVYVGAARERFVVRTECVNHRLFRALLEEAEEARGPYCYAADGPLELPCDAAAFARAVEAIEREMAEERTTVGCGGGGIVRATHSAAHRTAAAW

SEQ ID NO: 2113 - DNA, 381 bp, Sorghum bicolor
  misc_feature (1)..(381): useful for making plants with increased cold tolerance as described in USSN 12/514,991
  misc_feature (1)..(381): Ceres ANNOT ID no.6064510
atgaaggcagggtcgtccaaggggagattcctcaatctcaaggccttcctccatgcgtggaagaaactcgccgccgctgagacggcgacggccagcgccgctgggtgggcacagctcgacggcgacggcgaaaccatccccagggacgtgcccaagggccacacggtggtgtacgtcggggaggagctgaggcggtacgtggtcagggtgtcctccctcgaccacccgctgttccgcgagctgctcgaccgggcgcgggacgagtacggcttcgccgccgccgacacgaggctgtgcctcccctgcgacgaggacatgttcctcgccgtcctctgccatgtcgacgccgagcgagagtggagcctggcactgtgcagctga

SEQ ID NO: 2114 - protein, 126 aa, Sorghum bicolor
  misc_feature (1)..(126): useful for making plants with increased cold tolerance as described in USSN 12/514,991
  misc_feature (1)..(126): Ceres ANNOT ID no.6064510
  misc_feature (49)..(115): Pfam Name: Auxin_inducible Pfam Description: Auxin responsive protein
  misc_feature (1)..(126): Score of 102.6 for HMM of FIGURE 1 of USSN 12/514,991.
  misc_feature (1)..(126): Functional Homolog Of Ceres SEEDLINE ID no. ME12469
MKAGSSKGRFLNLKAFLHAWKKLAAAETATASAAGWAQLDGDGETIPRDVPKGHTVVYVGEELRRYVVRVSSLDHPLFRELLDRARDEYGFAAADTRLCLPCDEDMFLAVLCHVDAEREWSLALCS

SEQ ID NO: 2115 - protein, 98 aa, Arabidopsis thaliana
  misc_feature (1)..(98): useful for making plants with increased cold tolerance as described in USSN 12/514,991
  misc_feature (1)..(98): Ceres SEEDLINE ID no.ME25692
  misc_feature (3)..(96): Pfam Name: Auxin_inducible Pfam Description: Auxin responsive protein
  misc_feature (1)..(98): Score of 126.4 for HMM of FIGURE 1 of USSN 12/514,991.
  misc_feature (1)..(98): Functional Homolog Of Ceres SEEDLINE ID no. ME12469
MGILSFPSVAHNAKKILKHQSLLGRNHSNLPEGHVAVYVGEFQKKRFVVPISYINHPSFLALLNQSEEEFGFNHPMGGLTIPCKEDAFIDLTSRLHDS

SEQ ID NO: 2116 - protein, 105 aa, Arabidopsis thaliana
  misc_feature (1)..(105): useful for making plants with increased cold tolerance as described in USSN 12/514,991
  misc_feature (1)..(105): Public GI ID no.15236200
  misc_feature (2)..(105): Pfam Name: Auxin_inducible Pfam Description: Auxin responsive protein
  misc_feature (1)..(105): Score of 140.3 for HMM of FIGURE 1 of USSN 12/514,991.
  misc_feature (1)..(105): Functional Homolog Of Ceres SEEDLINE ID no. ME12469
MGLSRFAISNATKQILKLNSLANRNRTSSSSSDHVPKGHVAVYVGEQIEMEKKRFVVPISFLNHPSFKEFLSRAEEEFGFNHPMGGLTIPCREEVFLDLIASRLQ

SEQ ID NO: 2117 - DNA, 465 bp, Papaver somniferum
  misc_feature (1)..(465): useful for making plants with increased cold tolerance as described in USSN 12/514,991
  misc_feature (1)..(465): Ceres CLONE ID no.1631220
atccatcttcaaattcttctattacatctttcagcactcatcacaagcaaaatcttcacatctcattgttaatcattaatctctctgcaaaaatgggtcttatgcgtttaatggtctcgcaatcaaaacaaattctcaaactacactctcttaaaaaccagttatctcaatcttcatcaacagttcctaaaggacattgcgccgtttacgttggagaaaccgagaagaagaggtttattgttcctctatcttacttgaaccatccttcgttccagaacttgctaagttgtgcagaagaagagtttgggttcgatcatccaatgggaagactcacaataccttgcaaggaagacgctttcattgatctgacttctcaattgaattcttcttgaggacttggattaatcagataatagtttcaatagcttaactgtagacatttttttagctgaggattgaattcct

SEQ ID NO: 2118 - protein, 99 aa, Papaver somniferum
  misc_feature (1)..(99): useful for making plants with increased cold tolerance as described in USSN 12/514,991
  misc_feature (1)..(99): Ceres CLONE ID no.1631220
  misc_feature (1)..(97): Pfam Name: Auxin_inducible Pfam Description: Auxin responsive protein
  misc_feature (1)..(99): Score of 128.6 for HMM of FIGURE 1 of USSN 12/514,991.
  misc_feature (1)..(99): Functional Homolog Of Ceres SEEDLINE ID no. ME12469
MGLMRLMVSQSKQILKLHSLKNQLSQSSSTVPKGHCAVYVGETEKKRFIVPLSYLNHPSFQNLLSCAEEEFGFDHPMGRLTIPCKEDAFIDLTSQLNSS

SEQ ID NO: 2119 - protein, 94 aa, Arabidopsis thaliana
  misc_feature (1)..(94): useful for making plants with increased cold tolerance as described in USSN 12/514,991
  misc_feature (1)..(94): Public GI ID no.15236199
  misc_feature (1)..(81): Pfam Name: Auxin_inducible Pfam Description: Auxin responsive protein
  misc_feature (1)..(94): Score of 130.6 for HMM of FIGURE 1 of USSN 12/514,991.
  misc_feature (1)..(94): Functional Homolog Of Ceres SEEDLINE ID no. ME12469
MAIRLSRVINSKQSQKQQSRVPKGHVAVYVGEEMESKKRFVVPISYLNHPSFQGLLSRAEEEFGFNHPIGGLTIPCREETFVGLLNSYGCIVST

SEQ ID NO: 2120 - protein, 100 aa, Vitis vinifera
  misc_feature (1)..(100): useful for making plants with increased cold tolerance as described in USSN 12/514,991
  misc_feature (1)..(100): Public GI ID no.147804677
  misc_feature (1)..(95): Pfam Name: Auxin_inducible Pfam Description: Auxin responsive protein
  misc_feature (1)..(100): Score of 143.5 for HMM of FIGURE 1 of USSN 12/514,991.
  misc_feature (1)..(100): Functional Homolog Of Ceres SEEDLINE ID no. ME12469
MGIRLPSKIHNAKQILKLQSLLSRNQSSVPKGHCAVYVGEIQKKRFVVPISYLNHPAFQDLLHLAEEEFGFDHPMGGLTIPCEEDAFIDLTSRLNAMSVM

SEQ ID NO: 2121 - DNA, 297 bp, Populus balsamifera subsp. trichocarpa
  misc_feature (1)..(297): useful for making plants with increased cold tolerance as described in USSN 12/514,991
  misc_feature (1)..(297): Ceres ANNOT ID no.1460704
atgggtatccttagttttccttctgtggctcataatgccaagaaaatcctcaaacatcagtctcttcttggtagaaatcactcaaatcttccggaagggcacgttgcagtgtacgttggagaattccaaaagaagcggtttgtggtcccaatttcatatattaatcatccttctttcctagccttgcttaatcaatccgaggaagaatttggcttcaatcatccaatgggtggtcttacaattccttgcaaagaagatgccttcattgatctcacttctcggctacacgactcgtga

SEQ ID NO: 2122 - protein, 98 aa, Populus balsamifera subsp. trichocarpa; identical to SEQ ID NO: 2115
  misc_feature (1)..(98): useful for making plants with increased cold tolerance as described in USSN 12/514,991
  misc_feature (1)..(98): Ceres ANNOT ID no.1460704
  misc_feature (3)..(96): Pfam Name: Auxin_inducible Pfam Description: Auxin responsive protein
  misc_feature (1)..(98): Score of 126.4 for HMM of FIGURE 1 of USSN 12/514,991.
  misc_feature (1)..(98): Functional Homolog Of Ceres SEEDLINE ID no. ME12469

SEQ ID NO: 2123 - protein, 96 aa, Vitis vinifera
  misc_feature (1)..(96): useful for making plants with increased cold tolerance as described in USSN 12/514,991
  misc_feature (1)..(96): Public GI ID no.147839947
  misc_feature (1)..(94): Pfam Name: Auxin_inducible Pfam Description: Auxin responsive protein
  misc_feature (1)..(96): Score of 129.8 for HMM of FIGURE 1 of USSN 12/514,991.
  misc_feature (1)..(96): Functional Homolog Of Ceres SEEDLINE ID no. ME12469
MGIRLPSMGQAKQILKLQSLLSRNQAEVPKGHFAIYVGEVKKKRYVVPISYLDHPSFRSLLSQAEEEFGFNHPMGGLTIPCKEHAFLDLTSQLQIS

SEQ ID NO: 2124 - protein, 95 aa, Vitis vinifera
  misc_feature (1)..(95): useful for making plants with increased cold tolerance as described in USSN 12/514,991
  misc_feature (1)..(95): Public GI ID no.147776039
  misc_feature (1)..(93): Pfam Name: Auxin_inducible Pfam Description: Auxin responsive protein
  misc_feature (1)..(95): Score of 130 for HMM of FIGURE 1 of USSN 12/514,991.
  misc_feature (1)..(95): Functional Homolog Of Ceres SEEDLINE ID no. ME12469
MAIRFQRIIPAKQILRRILPSPESTNVPKGHVPVYVGETEKKRFVIPISYLKHPSFQNLLSQAEEEFGFDHPLGGLTIPCREEAFIDLTCSLNCS

SEQ ID NO: 2125 - DNA, 276 bp, Populus balsamifera subsp. trichocarpa
  misc_feature (1)..(276): useful for making plants with increased cold tolerance as described in USSN 12/514,991
  misc_feature (1)..(276): Ceres ANNOT ID no.1513983
atggcaattcgtttaactggaagccttgccaagcaaattttccgccgatcttcaaaatcttttgatgtgccaaaaggtttcgtggcagtatacgttggggagaccgaaaagaagcgatttgtggttccagtatcctatctgaaccagcctatatttcaagatttgctatgtaaagctgaagaagagtttggctttgatcatccaatgggtggtttgacaattccttgtagagaagatactttcatccatgtcacttcaagcttgagcagatcatga

SEQ ID NO: 2126 - protein, 91 aa, Populus balsamifera subsp. trichocarpa
  misc_feature (1)..(91): useful for making plants with increased cold tolerance as described in USSN 12/514,991
  misc_feature (1)..(91): Ceres ANNOT ID no.1513983
  misc_feature (1)..(89): Pfam Name: Auxin_inducible Pfam Description: Auxin responsive protein
  misc_feature (1)..(91): Score of 139.4 for HMM of FIGURE 1 of USSN 12/514,991.
  misc_feature (1)..(91): Functional Homolog Of Ceres SEEDLINE ID no. ME12469
MAIRLTGSLAKQIFRRSSKSFDVPKGFVAVYVGETEKKRFVVPVSYLNQPIFQDLLCKAEEEFGFDHPMGGLTIPCREDTFIHVTSSLSRS

SEQ ID NO: 2127 - protein, 95 aa, Vitis vinifera
  misc_feature (1)..(95): useful for making plants with increased cold tolerance as described in USSN 12/514,991
  misc_feature (1)..(95): Public GI ID no.147804680
  misc_feature (1)..(93): Pfam Name: Auxin_inducible Pfam Description: Auxin responsive protein
  misc_feature (1)..(95): Score of 128.9 for HMM of FIGURE 1 of USSN 12/514,991.
  misc_feature (1)..(95): Functional Homolog Of Ceres SEEDLINE ID no. ME12469
MAIRFQRIIPAKQILRRILPSPESTNVPKGHVPVYVGETQKKRFVIPISYLKHPSFQNLLSQAEEEFGFDHPLGGLTIPCREEAFIDLTCSLNCS

SEQ ID NO: 2128 - protein, 92 aa, Medicago truncatula
  misc_feature (1)..(92): useful for making plants with increased cold tolerance as described in USSN 12/514,991
  misc_feature (1)..(92): Public GI ID no.140059206
  misc_feature (1)..(90): Pfam Name: Auxin_inducible Pfam Description: Auxin responsive protein
  misc_feature (1)..(92): Score of 121.1 for HMM of FIGURE 1 of USSN 12/514,991.
  misc_feature (1)..(92): Functional Homolog Of Ceres SEEDLINE ID no. ME12469
MGFRLPAIRRSSFSASQSSNKQVEVPKGHLAVYVGEKMRRFMIPISFLNEPLFQELLSQAEEEFGYCHPMGGLTIPCKEDVFLHTASLLNGL

SEQ ID NO: 2129 - protein, 80 aa, Vitis vinifera
  misc_feature (1)..(80): useful for making plants with increased cold tolerance as described in USSN 12/514,991
  misc_feature (1)..(80): Public GI ID no.147863615
  misc_feature (6)..(78): Pfam Name: Auxin_inducible Pfam Description: Auxin responsive protein
  misc_feature (1)..(80): Score of 121.6 for HMM of FIGURE 1 of USSN 12/514,991.
  misc_feature (1)..(80): Functional Homolog Of Ceres SEEDLINE ID no. ME12469
MSTIQVLQESDVPRGHFAVYVGDTQKKRFVVPISYLNHPSFQDLLQQAEEEFGFDHPMGGLTIPCKEETFVDLASRLNHL

SEQ ID NO: 2130 - DNA, 441 bp, Populus balsamifera subsp. trichocarpa
  misc_feature (1)..(441): useful for making plants with increased cold tolerance as described in USSN 12/514,991
  misc_feature (1)..(441): Ceres ANNOT ID no.1460717
atggcaattcgtttaactggaagccttgccaagcaaattttccgccgatcttcaaaatcttttgatgtgccaaaaggtttcgtggcagtatacgttggggagaccgaaaagaagcgatttgtggttccagtatcctatctgaaccagcctatatttcaagatttgctatgtaaagctgaagaagagtttggctttgatcatccaatgggtggtttgacaattccttgtagagaagatactttcatccatgagggggacggaagcaagcgtagacctgcacagatgactcgtaaagtttatcatgaggagaaagatgtgcttttgcgtagttcgttgattgaaatgcatgttaagtgtggttctatagagaaggctttgcaagttttcaacatggcaggatttagactgggaggcgggagagaaacagggatgtgtagttga

SEQ ID NO: 2131 - protein, 146 aa, Populus balsamifera subsp. trichocarpa
  misc_feature (1)..(146): useful for making plants with increased cold tolerance as described in USSN 12/514,991
  misc_feature (1)..(146): Ceres ANNOT ID no.1460717
  misc_feature (1)..(81): Pfam Name: Auxin_inducible Pfam Description: Auxin responsive protein
  misc_feature (1)..(146): Score of 123.4 for HMM of FIGURE 1 of USSN 12/514,991.
  misc_feature (1)..(146): Functional Homolog Of Ceres SEEDLINE ID no. ME12469
MAIRLTGSLAKQIFRRSSKSFDVPKGFVAVYVGETEKKRFVVPVSYLNQPIFQDLLCKAEEEFGFDHPMGGLTIPCREDTFIHEGDGSKRRPAQMTRKVYHEEKDVLLRSSLIEMHVKCGSIEKALQVFNMAGFRLGGGRETGMCS

SEQ ID NO: 2132 - protein, 95 aa, Vitis vinifera
  misc_feature (1)..(95): useful for making plants with increased cold tolerance as described in USSN 12/514,991
  misc_feature (1)..(95): Public GI ID no.147776038
  misc_feature (1)..(93): Pfam Name: Auxin_inducible Pfam Description: Auxin responsive protein
  misc_feature (1)..(95): Score of 124.6 for HMM of FIGURE 1 of USSN 12/514,991.
  misc_feature (1)..(95): Functional Homolog Of Ceres SEEDLINE ID no. ME12469
MAIRFQRIIPTKQILRRILPSPESTNVPKGHVPVYVGETEKKRFVIPISYLKHPSFQNLLSQAEEEFGFDHPLGALTIPCREEAFIDLAFSLNCS

SEQ ID NO: 2133 - protein, 95 aa, Vitis vinifera
  misc_feature (1)..(95): useful for making plants with increased cold tolerance as described in USSN 12/514,991
  misc_feature (1)..(95): Public GI ID no.147776034
  misc_feature (1)..(93): Pfam Name: Auxin_inducible Pfam Description: Auxin responsive protein
  misc_feature (1)..(95): Score of 121.4 for HMM of FIGURE 1 of USSN 12/514,991.
  misc_feature (1)..(95): Functional Homolog Of Ceres SEEDLINE ID no. ME12469
MAIRFQRIIPAKQILRRILPSPESTSVPKGYVPVYVGETQKKRFVIPISYLKHPSFQSLLSQAEEEFGFDHPLGGLTIPCREEAFINLTCSLNCS

SEQ ID NO: 2134 - protein, 163 aa, Vitis vinifera
  misc_feature (1)..(163): useful for making plants with increased cold tolerance as described in USSN 12/514,991
  misc_feature (1)..(163): Public GI ID no.147839948
  misc_feature (95)..(161): Pfam Name: Auxin_inducible Pfam Description: Auxin responsive protein
  misc_feature (1)..(163): Score of 178.7 for HMM of FIGURE 1 of USSN 12/514,991.
  misc_feature (1)..(163): Functional Homolog Of Ceres SEEDLINE ID no. ME12469
MGIRLPSVVQAKQILKLQLLLSRNRAEVPKGHFAVYVGEVEKKRYVVPISYLNHPSFRSLLCQAEEEFGFNHPMGGRGGWKGEREARPCVPGQEVPTGHFAVYVGEVEKRRYVVPISYLNHPSFRSLLCQAEEEFGFTHPMGGLTIPCNEDAFVDLTSQLLAS

SEQ ID NO: 2135 - protein, 90 aa, Medicago truncatula
  misc_feature (1)..(90): useful for making plants with increased cold tolerance as described in USSN 12/514,991
  misc_feature (1)..(90): Public GI ID no.140063887
  misc_feature (1)..(88): Pfam Name: Auxin_inducible Pfam Description: Auxin responsive protein
  misc_feature (1)..(90): Score of 119.3 for HMM of FIGURE 1 of USSN 12/514,991.
  misc_feature (1)..(90): Functional Homolog Of Ceres SEEDLINE ID no. ME12469
MGFRLPVVSKRASNQASSKCTNVPKGYIAVYVGDEMKRFVIPISYLNQPSFQELLNQAEEQFGYDHPTGGLTIPCREDVFLNITSRLNLC

SEQ ID NO: 2136 - protein, 95 aa, Vitis vinifera
  misc_feature (1)..(95): useful for making plants with increased cold tolerance as described in USSN 12/514,991
  misc_feature (1)..(95): Public GI ID no.147804682
  misc_feature (1)..(93): Pfam Name: Auxin_inducible Pfam Description: Auxin responsive protein
  misc_feature (1)..(95): Score of 122.7 for HMM of FIGURE 1 of USSN 12/514,991.
  misc_feature (1)..(95): Functional Homolog Of Ceres SEEDLINE ID no. ME12469
MAIRFQRIIPAKQILRRILPSPEPTNVPKGYVPVYVGETQKKRFVIPISYLKHPSFQNLLSQAEEEFGFDHPLGGLTIPCREEAFINLTCGLNCS

SEQ ID NO: 2137 - protein, 99 aa, Arabidopsis thaliana
  misc_feature (1)..(99): useful for making plants with increased cold tolerance as described in USSN 12/514,991
  misc_feature (1)..(99): Public GI ID no.15234825
  misc_feature (2)..(99): Pfam Name: Auxin_inducible Pfam Description: Auxin responsive protein
  misc_feature (1)..(99): Score of 130.5 for HMM of FIGURE 1 of USSN 12/514,991.
  misc_feature (1)..(99): Functional Homolog Of Ceres SEEDLINE ID no. ME12469
MAIRIPRVLQSSKQILRQAKLLSSSSSSSSLDVPKGYLAVYVGEQNMKRFVVPVSYLDQPSFQDLLRKAEEEFGFDHPMGGLTIPCSEEIFIDLASRFN

SEQ ID NO: 2138 - protein, 90 aa, Medicago truncatula
  misc_feature (1)..(90): useful for making plants with increased cold tolerance as described in USSN 12/514,991
  misc_feature (1)..(90): Public GI ID no.140063859
  misc_feature (1)..(90): Pfam Name: Auxin_inducible Pfam Description: Auxin responsive protein
  misc_feature (1)..(90): Score of 127.7 for HMM of FIGURE 1 of USSN 12/514,991.
  misc_feature (1)..(90): Functional Homolog Of Ceres SEEDLINE ID no. ME12469
MGFRLNVIRRASFTASQAALKSAEVPKGYVAVYVGEKQKRFVVPISYLNQPLFQELLHQAEEEFGYDHPMGGLTIPCTEGVFQHVTSCLN

SEQ ID NO: 2139 - DNA, 279 bp, Populus balsamifera subsp. trichocarpa
  misc_feature (1)..(279): useful for making plants with increased cold tolerance as described in USSN 12/514,991
  misc_feature (1)..(279): Ceres ANNOT ID no.1460716
atggcaattcgttttcctagtgttcttgccaagaaaatcccccgtcaatcttcatccaagtctttggatgtacagaaaggtttcatagcggtatatgttggggaagctgacaagaagagatttctggttccagtttcctatttgaaccagcctttgtttcgggatttgctatgtaaagctgaggaggagttcggttttgatcatccaatgggtggtttaacgattccctgcgacgaagagactttccttgatgtcacttctagcttgagtagatcataa

SEQ ID NO: 2140 - protein, 92 aa, Populus balsamifera subsp. trichocarpa
  misc_feature (1)..(92): useful for making plants with increased cold tolerance as described in USSN 12/514,991
  misc_feature (1)..(92): Ceres ANNOT ID no.1460716
  misc_feature (1)..(90): Pfam Name: Auxin_inducible Pfam Description: Auxin responsive protein
  misc_feature (1)..(92): Score of 121.9 for HMM of FIGURE 1 of USSN 12/514,991.
  misc_feature (1)..(92): Functional Homolog Of Ceres SEEDLINE ID no. ME12469
MAIRFPSVLAKKIPRQSSSKSLDVQKGFIAVYVGEADKKRFLVPVSYLNQPLFRDLLCKAEEEFGFDHPMGGLTIPCDEETFLDVTSSLSRS

SEQ ID NO: 2141 - protein, 91 aa, Medicago truncatula
  misc_feature (1)..(91): useful for making plants with increased cold tolerance as described in USSN 12/514,991
  misc_feature (1)..(91): Public GI ID no.92870695
  misc_feature (1)..(91): Pfam Name: Auxin_inducible Pfam Description: Auxin responsive protein
  misc_feature (1)..(91): Score of 123.6 for HMM of FIGURE 1 of USSN 12/514,991.
  misc_feature (1)..(91): Functional Homolog Of Ceres SEEDLINE ID no. ME12469
MGFRIAKLIRMPSFSSTQASSKGFEVPKGYLAVYVGDQMRRFVIPVSYLNQPSFQELLNQSEEEYGYDHPMGGLTIPCSEDEFRNLTSRMN

SEQ ID NO: 2142 - protein, 92 aa, Medicago truncatula
  misc_feature (1)..(92): useful for making plants with increased cold tolerance as described in USSN 12/514,991
  misc_feature (1)..(92): Public GI ID no.92889202
  misc_feature (1)..(90): Pfam Name: Auxin_inducible Pfam Description: Auxin responsive protein
  misc_feature (1)..(92): Score of 123.6 for HMM of FIGURE 1 of USSN 12/514,991.
  misc_feature (1)..(92): Functional Homolog Of Ceres SEEDLINE ID no. ME12469
MGFRLSAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 2143 - protein, 92 aa, Medicago truncatula
  misc_feature (1)..(92): useful for making plants with increased cold tolerance as described in USSN 12/514,991
  misc_feature (1)..(92): Public GI ID no.92889209
  misc_feature (1)..(90): Pfam Name: Auxin_inducible Pfam Description: Auxin responsive protein
  misc_feature (1)..(92): Score of 120.6 for HMM of FIGURE 1 of USSN 12/514,991.
  misc_feature (1)..(92): Functional Homolog Of Ceres SEEDLINE ID no. ME12469
MGFRLPAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 2144 - DNA, 523 bp, Glycine max
  misc_feature (1)..(523): useful for making plants with increased cold tolerance as described in USSN 12/514,991
  misc_feature (1)..(523): Ceres CLONE ID no.675190
aacagaagtgattcacatcctaaagcatttgaagttcaaaaacttgcatcttattcacaatattctcttcccaagtctcaactcatacaacaacaatgggttttcgcttacctggcatcaggaagacatcaattgctgcaaaccaagcatcttccaaatctgtggaggtgccaaagggctaccttgtagtctatgttggagacaaaatgaggcggtttcttatccccgtatcatacttgaaccaaccatcctttcaagatttgttgaatcaagctgaggaagaattcgggtatgaccatccaatgggcggtctcacaataccatgcaaggaggatgagttcctaaccgtcacctctcacttgaatgacctgtaaatcatgctaatggatacacggatagattagatgaggcaaatttgtacagaagaggcattttcttttattgttagggatttctattttctactgaagttgaaacctgtttccttaatgagaattaatgcagcacaagacacgtattgttc

SEQ ID NO: 2145 - protein, 92 aa, Glycine max
  misc_feature (1)..(92): useful for making plants with increased cold tolerance as described in USSN 12/514,991
  misc_feature (1)..(92): Ceres CLONE ID no.675190
  misc_feature (1)..(90): Pfam Name: Auxin_inducible Pfam Description: Auxin responsive protein
  misc_feature (1)..(92): Score of 114.9 for HMM of FIGURE 1 of USSN 12/514,991.
  misc_feature (1)..(92): Functional Homolog Of Ceres SEEDLINE ID no. ME12469
MGFRLPGIRKTSIAANQASSKSVEVPKGYLVVYVGDKMRRFLIPVSYLNQPSFQDLLNQAEEEFGYDHPMGGLTIPCKEDEFLTVTSHLNDL

SEQ ID NO: 2146 - DNA, 519 bp, Glycine max
  misc_feature (1)..(519): useful for making plants with increased cold tolerance as described in USSN 12/514,991
  misc_feature (1)..(519): Ceres CLONE ID no.591793
acagatcatcccaatactagttaactgttttcttctactactttgaaatcattctgctgattagtgtgtgcagaaacagaaaaaaatgggttttcgcttacctggtattagatgttcatcattcagtgcaagccaagcatcctcttgcaaggtttcagaagtcccaaaagggtatcttgcagtgtatgttggagagaaaatgaagaggttcttgattccagtatcattcttgaacgagcctttatttcaagaattgcttagccaagttgaagaggagttcggttactgtcatcccatgggtggtctcacaattccctgcaaggaggatgtgttcttaaatatagcttctcgcccgaaccggctataataattcatataacaaaagatcctaatccctaaataaactagttgacacaactttgttcagaaggtttttcttttttcaattttgttgtttaattccccttaagtggaaaaaaattcatctgaatgagaaccttatgaaactaagttgctgcg

SEQ ID NO: 2147 - protein, 93 aa, Glycine max
  misc_feature (1)..(93): useful for making plants with increased cold tolerance as described in USSN 12/514,991
  misc_feature (1)..(93): Ceres CLONE ID no.591793
  misc_feature (1)..(91): Pfam Name: Auxin_inducible Pfam Description: Auxin responsive protein
  misc_feature (1)..(93): Score of 113.1 for HMM of FIGURE 1 of USSN 12/514,991.
  misc_feature (1)..(93): Functional Homolog Of Ceres SEEDLINE ID no. ME12469
MGFRLPGIRCSSFSASQASSCKVSEVPKGYLAVYVGEKMKRFLIPVSFLNEPLFQELLSQVEEEFGYCHPMGGLTIPCKEDVFLNIASRPNRL

SEQ ID NO: 2148 - protein, 101 aa, Medicago truncatula
  misc_feature (1)..(101): useful for making plants with increased cold tolerance as described in USSN 12/514,991
  misc_feature (1)..(101): Public GI ID no.140066073
  misc_feature (4)..(100): Pfam Name: Auxin_inducible Pfam Description: Auxin responsive protein
  misc_feature (1)..(101): Score of 134.5 for HMM of FIGURE 1 of USSN 12/514,991.
  misc_feature (1)..(101): Functional Homolog Of Ceres SEEDLINE ID no. ME12469
MKTTSNRFVGIVQAKQKLQRTLSQRIRMASSVGDVPKGHLAVYVGNDHKRFVIPISYLSHPLFKDLLDWAEEEFGFNHPMGGLTIPCTEDYFISLTSSLNY

SEQ ID NO: 2149 - protein, 90 aa, Arabidopsis thaliana
  misc_feature (1)..(90): useful for making plants with increased cold tolerance as described in USSN 12/514,991
  misc_feature (1)..(90): Public GI ID no.15238736
  misc_feature (1)..(90): Pfam Name: Auxin_inducible Pfam Description: Auxin responsive protein
  misc_feature (1)..(90): Score of 123.3 for HMM of FIGURE 1 of USSN 12/514,991.
  misc_feature (1)..(90): Functional Homolog Of Ceres SEEDLINE ID no. ME12469
MAFVRSLLGAKKILSRSTGAGSAAPKGFLAVYVGESQKKRYLVPVSYLNQPSFQALLSKSEEEFGFDHPMGGLTIPCPEDTFINVTSRLQ

SEQ ID NO: 2150 - protein, 90 aa, Arabidopsis thaliana
  misc_feature (1)..(90): useful for making plants with increased cold tolerance as described in USSN 12/514,991
  misc_feature (1)..(90): Public GI ID no.15238719
  misc_feature (1)..(90): Pfam Name: Auxin_inducible Pfam Description: Auxin responsive protein
  misc_feature (1)..(90): Score of 126.9 for HMM of FIGURE 1 of USSN 12/514,991.
  misc_feature (1)..(90): Functional Homolog Of Ceres SEEDLINE ID no. ME12469
MALVRSLLGAKKILSRSTAAVSAAPKGFLAVYVGESQKKRYLVPLSYLNQPSFQALLSKSEDEFGFDHPMGGLTIPCHEDTFINVTSRLQ

SEQ ID NO: 2151 - DNA, 747 bp, Gossypium hirsutum
  misc_feature (1)..(747): useful for making plants with increased cold tolerance as described in USSN 12/514,991
  misc_feature (1)..(747): Ceres CLONE ID no.1809028
gagaatcctcccatcccactacaccttctattctactaccacttccacacaacaacagcaatggcaattagaaaaccatccaaactgcctcaaaccgcagttctgaagcaaatcctgaagaaatgttcaagcttaggcaggaaacatggatatgacgaagatgggctcccacttgacgtaccaaaaggtcactttgccgtttacgttggtgaaaacagaaacagatacatcgtccctatctcattcttgacccaccctgagttccaatgtttgcttcgacgagcggaggaagagtttgggtttaaccatgatatgggccttaccatcccttgtgaagaagttgtttttcgctctcttgcatctatgcttaaatgaaaatgggaaaaaagaatatattgagttgcgaaatgaaggggttctgcctttgcatttttggagaaagatggccaagagaagcatagcaaccatatatattgaatagctagtttctcttttttctaacatcatttcttcattgtgattcttgatcccttttggggttctttcttttctttttactacttcgaacccggggtttttaatgttttattaattagttattagtgactctaactagacctaagaattataacattttctgggtccaaccatttgtataaacttgtgtttcctcacaaattttgtgagagaagttgaatgttaaggaaacaaccttattttatcttcccaaaaaaaaaaaaaaaaaaa

SEQ ID NO: 2152 - protein, 104 aa, Gossypium hirsutum
  misc_feature (1)..(104): useful for making plants with increased cold tolerance as described in USSN 12/514,991
  misc_feature (1)..(104): Ceres CLONE ID no.1809028
  misc_feature (5)..(104): Pfam Name: Auxin_inducible Pfam Description: Auxin responsive protein
  misc_feature (1)..(104): Score of 175.9 for HMM of FIGURE 1 of USSN 12/514,991.
  misc_feature (1)..(104): Functional Homolog Of Ceres SEEDLINE ID no. ME12469
MAIRKPSKLPQTAVLKQILKKCSSLGRKHGYDEDGLPLDVPKGHFAVYVGENRNRYIVPISFLTHPEFQCLLRRAEEEFGFNHDMGLTIPCEEVVFRSLASMLK

SEQ ID NO: 2153 - DNA, 693 bp, Glycine max
  misc_feature (1)..(693): useful for making plants with increased cold tolerance as described in USSN 12/514,991
  misc_feature (1)..(693): Ceres CLONE ID no.1042637
acactacaaaaaaataaaattaagtttagtttgaacaaggtgcaagcaagagaagcaaaataatggccatcaaaaaatccaataaactaccacaagctattgttctcaagcaaattgtcaagagatgctcaagttttggcaagaagcagacctacaatgaagagggtcttcctgatgatgtgccaaaaggccattttgcggtctatgttggagagaacaggaccagatatattatcccaatttcatggctggctcaccctcagtttcaaattttgctccaaagagctgaggaggagtttggcttcaaccacgacatgggacttaccataccatgcgatgaagttgcatttgagtcattaacttccatgatgagatgagaaaggagagggactactacaacatatttgagaaacggaggattatcatcataattcccttgtcaagtggtgatttactagtaaaaaagtcccattgtctagtggaggttatgacttggtcgctactattaacattttacgtttggtgttgtaattgtatatagtatggaagatagatatatagatcgatgtccaattagtttttccttggcagtgttatttgtttctttaatgagtggtgatttaaatgaagcagtgttgttcatggggggtattaccccgttgaatatttttatatccaaaaaaaaaaaaaaaa

SEQ ID NO: 2154 - protein, 104 aa, Glycine max
  misc_feature (1)..(104): useful for making plants with increased cold tolerance as described in USSN 12/514,991
  misc_feature (1)..(104): Ceres CLONE ID no.1042637
  misc_feature (5)..(104): Pfam Name: Auxin_inducible Pfam Description: Auxin responsive protein
  misc_feature (1)..(104): Score of 170.4 for HMM of FIGURE 1 of USSN 12/514,991.
  misc_feature (1)..(104): Functional Homolog Of Ceres SEEDLINE ID no. ME12469
MAIKKSNKLPQAIVLKQIVKRCSSFGKKQTYNEEGLPDDVPKGHFAVYVGENRTRYIIPISWLAHPQFQILLQRAEEEFGFNHDMGLTIPCDEVAFESLTSMMR

SEQ ID NO: 2155 - protein, 121 aa, Vitis vinifera
  misc_feature (1)..(121): useful for making plants with increased cold tolerance as described in USSN 12/514,991
  misc_feature (1)..(121): Public GI ID no.147833400
  misc_feature (16)..(95): Pfam Name: Auxin_inducible Pfam Description: Auxin responsive protein
  misc_feature (1)..(121): Score of 127.1 for HMM of FIGURE 1 of USSN 12/514,991.
  misc_feature (1)..(121): Functional Homolog Of Ceres SEEDLINE ID no. ME12469
MGSGEKNFLNFHMHVHHGNGNNKKEMRDIPKGCLAVLVGQGEEQQRFVIPVIYINHPLFMELLKEAEEEYGFEQKGPITIPCHVEEFRYVQGMIDKEKSHHHHSHHHDLHDHHNHHHCFWV

SEQ ID NO: 2156 - protein, 107 aa, Tulipa gesneriana
  misc_feature (1)..(107): useful for making plants with increased cold tolerance as described in USSN 12/514,991
  misc_feature (1)..(107): Public GI ID no.10185820
  misc_feature (5)..(107): Pfam Name: Auxin_inducible Pfam Description: Auxin responsive protein
  misc_feature (1)..(107): Score of 159.3 for HMM of FIGURE 1 of USSN 12/514,991.
  misc_feature (1)..(107): Functional Homolog Of Ceres SEEDLINE ID no. ME12469
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 2157 - protein, 108 aa, Oryza sativa subsp. indica
  misc_feature (1)..(108): useful for making plants with increased cold tolerance as described in USSN 12/514,991
  misc_feature (1)..(108): Public GI ID no.125539290
  misc_feature (4)..(103): Pfam Name: Auxin_inducible Pfam Description: Auxin responsive protein
  misc_feature (1)..(108): Score of 132.3 for HMM of FIGURE 1 of USSN 12/514,991.
  misc_feature (1)..(108): Functional Homolog Of Ceres SEEDLINE ID no. ME12469
MAITGSKKPGQLKQMLRRCSSSLGIKGAGGDDDGLPGDVPRGHFAVYVGISRRRYIVPVACLAAPEFQELLRKAEEEFGFDHDMGITLPCDEATFHGVLASASATSIR

SEQ ID NO: 2158 - protein, 96 aa, Oryza sativa subsp. japonica
  misc_feature (1)..(96): useful for making plants with increased cold tolerance as described in USSN 12/514,991
  misc_feature (1)..(96): Public GI ID no.115445937
  misc_feature (1)..(95): Pfam Name: Auxin_inducible Pfam Description: Auxin responsive protein
  misc_feature (1)..(96): Score of 139.8 for HMM of FIGURE 1 of USSN 12/514,991.
  misc_feature (1)..(96): Functional Homolog Of Ceres SEEDLINE ID no. ME12469
MAKKIAPAANLKQILRRCSSLGRRQQQQGAVPRGHFPVYVGESRCRYVVPIACLEHPDFLLLLRKAEEEFGFEHDAAITLPCHEADFEALLAALTA

SEQ ID NO: 2159 - protein, 104 aa, Vitis vinifera
  misc_feature (1)..(104): useful for making plants with increased cold tolerance as described in USSN 12/514,991
  misc_feature (1)..(104): Public GI ID no.147856535
  misc_feature (5)..(104): Pfam Name: Auxin_inducible Pfam Description: Auxin responsive protein
  misc_feature (1)..(104): Score of 187.7 for HMM of FIGURE 1 of USSN 12/514,991.
  misc_feature (1)..(104): Functional Homolog Of Ceres SEEDLINE ID no. ME12469
MAIRKSNKLPQTAVLKQILKRCSSLGKKNGYDEDGLPLDVPKGHFAVYVGENRSRYIVPISFLSHPEFQCLLQRAEEEFGFDHDMGLTIPCEEVVFRSLTSMLR

SEQ ID NO: 2160 - protein, 156 aa, Phaseolus vulgaris
  misc_feature (1)..(156): useful for making plants with increased cold tolerance as described in USSN 12/514,991
  misc_feature (1)..(156): Public GI ID no.24943206
  misc_feature (76)..(141): Pfam Name: Auxin_inducible Pfam Description: Auxin responsive protein
  misc_feature (1)..(156): Score of 148.9 for HMM of FIGURE 1 of USSN 12/514,991.
  misc_feature (1)..(156): Functional Homolog Of Ceres SEEDLINE ID no. ME12469
MDDGGGSKLSGIRQIVRLKEMFQKWQTVTLGSKESNHDSDVARPGGIPPMINKRLTNVLYCDSDEDSCYSPQPPHDVPKGYLAVYVGPELRRFIIPTSYLSHSLFKVLLEKAAEEFGFDQSGGLTIPCEIETFKYLLNCMENHDDSSAGNTGTVEE

SEQ ID NO: 2161 - protein, 99 aa, Tulipa gesneriana
  misc_feature (1)..(99): useful for making plants with increased cold tolerance as described in USSN 12/514,991
  misc_feature (1)..(99): Public GI ID no.10185816
  misc_feature (2)..(99): Pfam Name: Auxin_inducible Pfam Description: Auxin responsive protein
  misc_feature (1)..(99): Score of 133.8 for HMM of FIGURE 1 of USSN 12/514,991.
  misc_feature (1)..(99): Functional Homolog Of Ceres SEEDLINE ID no. ME12469
MAKNHKLPAAALKQMLMRCSSIGRRQNCQGLPVDVPKGHFVVYVGEKRSRFIVPISYLARPEFQQLLRHAEEEFGFEHDIGLTIPCEEVVFRLLTLALR

SEQ ID NO: 2162 - DNA, 1064 bp, Arabidopsis thaliana
  misc_feature (1)..(1064): useful for making plants with increased tolerance to oxidative stress as described in USSN 12/445,005
  misc_feature (1)..(1064): Ceres CLONE ID no. 268310
  misc_feature (1)..(1064): Also Known As Ceres ME LINE ME02077
gtcaaatcaaatccttcttcctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttcatcaaaccggtttcgagttttctgaatttgaaaccaaaccggaaataatcgatctcgtcactcccaaaccggagatttctgatttcgaggtgaaatctgaaatttcaattgaatcgaacgattccttcacgttccaatcgaatcctcctcgtgtcactgttcaatccaatcgaaaaccgccgttgaagatcgcaccaccgaaccgaaccaagtggattcaattcgcaaccggaaatcctaaaccggaacttcccgaaccggttgtagcagcagaagagaagaggcattacagaggagtgaggatgaggccgtggggaaaattcgcggcggagatccgagatccgactcgtcgtggaactcgggtttggcttgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaaacggaagagagacagcgaggaggaggaagtgaaggtggtgaagaaagtgctaaagaaggaggagagttacgccgttagcgacggagagaatgttgagtcaggtttgacggcgatagatgactgggattatcgataccgtcgacctcgagggggggcccggtacccaattcgccctatagccagagctctggtatcgataccgtcgacctcgagggggggcccgctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgt

SEQ ID NO: 2163 - protein, 301 aa, Arabidopsis thaliana
  misc_feature (1)..(301): useful for making plants with increased tolerance to oxidative stress as described in USSN 12/445,005
  misc_feature (1)..(301): Ceres CLONE ID no. 268310
  misc_feature (1)..(301): Also Known As Ceres ME LINE ME02077
  misc_feature (135)..(187): Pfam Name: AP2 Pfam Description: AP2 domain
  misc_feature (1)..(301): Score of 727.5 for HMM of FIGURE 3 of USSN 12/445,005.
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDWDYRYRRPRGGARYPIRPIARALVSIPSTSRGGPLESCFNEICETPMIA

SEQ ID NO: 2164 - protein, 290 aa, Brassica oleracea
  misc_feature (1)..(290): useful for making plants with increased tolerance to oxidative stress as described in USSN 12/445,005
  misc_feature (1)..(290): Public GI no. 89257562
  misc_feature (1)..(290): Functional Homolog of  Ceres CLONE ID no. 268310
  misc_feature (149)..(201): Pfam Name: AP2 Pfam Description: AP2 domain
  misc_feature (1)..(290): Score of 695.1 for HMM of FIGURE 3 of USSN 12/445,005.
MATPSEASALSFIKKHLLDESSPLPKVTTTNPWIASETISNFSIFGSFDQTGFDFSEFETKPEITDLVTHRFTDSFESEPEANAEIQLASSESFTFQSNPRGVSGPASRSNRKPPLKIDPPSRTEWIQFATENPQPEQLPVHVAAEEKRHYRGVRMRPWGKFAAEIRDPNRRGTRVWLGTFDTAIEAARAYDQAAFRLRGSKAIVNFPLEVGTWNQRADVGQNKRKRDGEGEEVTVVAKVLKTEESHAVETETSSLTAVDDWDLTELLSMPLLSPLSPHPPFGYPQLTVV

SEQ ID NO: 2165 - DNA, 1165 bp, Panicum virgatum
  misc_feature (1)..(1165): useful for making plants with increased tolerance to oxidative stress as described in USSN 12/445,005
  misc_feature (1)..(1165): Ceres CLONE ID no. 1725082
ataccagtcagtacaccactcggacggcgcacgcaccgcagctccagcggcagcgccgccgcacgccgtgcccgcaggtctctccttctcaggccttctcctgacctcctctcgagtctcgccgctcgactcggccgcgcgccgatggccctgctgcgggagcacctcgacctcatccgcgcgcacctcctcgacgaccgccacgaccacgacaacgacgccgccgccagctccgaggaccactcggcgtcgtcgccctcgccctcgccgcccgccgggcggaggccactgccggcgctctccgtcgcgctgcccccgcggccagcgctcgccctgcagcagcagcagcagctgtgggcggcgccgccgccgcagatcattcaccagcaggagcagagctactactactgcccggaagccgaggaggatgacttccggcggtaccgcggcgtgcggcagcggccgtggggcaagtacgcggcggagatccgggacccggcgcggaagggcgcgcgcgtgtggctgggcacctacgacaccgccgtggaggccgcgcgcgcctacgaccgcgccgcgttccgcctgcgcggctccaaggccatcctcaacttccccaacgaggtcgccttcggcaccgccgcgcggtgggggccgccgcctcctcctgctgccgccccccgctatcccgccgccgccggtaataacaagagggcgaggtcgccggagcgggggccgcaagaacagggcgccgggtgcatggtcatcagggaggtgaagcgggagcgggtgcaggagcccgccgggagttgcggttgggacggcgtggccacggcgccgacggcggcgagcggaggcgcggacttctgggaggaggaggagctgctcaagggggcgatctgcagcctgccgccgctctcgccgctgtcaccgcccccgcagctggccttcccgcagctctccgtcagctgacgtgtcgaagcatgcggctgatccatccatctgtggataggcatggagaagggcgcgtggactcctaattaactgatgagttattagtgttaatccactttgaggagttctaccatgagtacaactccaccaaatattctttcgttcgttgtctattcaagtatcttagtccaaacgacaagtaaatgttcttcgc

SEQ ID NO: 2166 - protein, 274 aa, Panicum virgatum
  misc_feature (1)..(274): useful for making plants with increased tolerance to oxidative stress as described in USSN 12/445,005
  misc_feature (1)..(274): Ceres CLONE ID no. 1725082
  misc_feature (1)..(274): Functional Homolog of  Ceres CLONE ID no. 268310
  misc_feature (98)..(150): Pfam Name: AP2 Pfam Description: AP2 domain
  misc_feature (1)..(274): Score of 135.6 for HMM of FIGURE 3 of USSN 12/445,005.
MALLREHLDLIRAHLLDDRHDHDNDAAASSEDHSASSPSPSPPAGRRPLPALSVALPPRPALALQQQQQLWAAPPPQIIHQQEQSYYYCPEAEEDDFRRYRGVRQRPWGKYAAEIRDPARKGARVWLGTYDTAVEAARAYDRAAFRLRGSKAILNFPNEVAFGTAARWGPPPPPAAAPRYPAAAGNNKRARSPERGPQEQGAGCMVIREVKRERVQEPAGSCGWDGVATAPTAASGGADFWEEEELLKGAICSLPPLSPLSPPPQLAFPQLSVS

SEQ ID NO: 2167 - protein, 307 aa, Medicago truncatula
  misc_feature (1)..(307): useful for making plants with increased tolerance to oxidative stress as described in USSN 12/445,005
  misc_feature (1)..(307): Public GI no. 92878368
  misc_feature (1)..(307): Functional Homolog of  Ceres CLONE ID no. 268310
  misc_feature (155)..(207): Pfam Name: AP2 Pfam Description: AP2 domain
  misc_feature (1)..(307): Score of 746.0 for HMM of FIGURE 3 of USSN 12/445,005.
MANFEEASALKRIKMHLLGEFSPLPSPISTPCFDFDFDFEFQTIPNISQSESNSSTSDSSISLDHYLTNLLETDTQIPLFEFDTKPQLMEHESPKALTSSHHVNQPQRTVEKKPKLSRKPSLEIALPKKTEWIQFGKPDPKPEVVVQKPEVAEKQHYRGVRQRPWGKFAAEIRDPNKRGSRVWLGTFETAIEAAKAYDSAAFRLRGSKAILNFPLEVNAVAASAETTVEGNKKRCREEEEEEEEEVVEVKPVVKKEKITEYDMNCFKEMPLTPSFWTGLWDGDVKGLVSVPPLSPLPSFCLSPLVVV

SEQ ID NO: 2168 - protein, 276 aa, Glycine max
  misc_feature (1)..(276): useful for making plants with increased tolerance to oxidative stress as described in USSN 12/445,005
  misc_feature (1)..(276): Ceres CLONE ID no. 1661141
  misc_feature (1)..(276): Functional Homolog of  Ceres CLONE ID no. 268310
  misc_feature (137)..(189): Pfam Name: AP2 Pfam Description: AP2 domain
  misc_feature (1)..(276): Score of 666.5 for HMM of FIGURE 3 of USSN 12/445,005.
MANALEVSALNRIKLHLLGELSPLTQFQEPNTTSLCSQSSTSDSFTTVDQIFSEFLDFPTTTTSSTEQNQFSAFEFEPKPGIIEPQLEFSFPTTRCKSSRRPSLQISLPKKTEWIQFGEPEVTETVSQSNPNAEEKKHYRGVRQRPWGKFAAEIRDPNKRGSRVWLGTFDTAIEAAKAYDRAAFRLRGSKAILNFPLEAGADDRKRQREEKVEPVLEVVKREKIGESDVSLIKNNPLTPSSWLGFWGSDANGIFTVPPLSPLSPHPALGFPQLMVV

SEQ ID NO: 2169 - protein, 307 aa, Medicago truncatula
  misc_feature (1)..(307): useful for making plants with increased tolerance to oxidative stress as described in USSN 12/445,005
  misc_feature (1)..(307): Public GI no. 92878365
  misc_feature (1)..(307): Functional Homolog of  Ceres CLONE ID no. 268310
  misc_feature (152)..(204): Pfam Name: AP2 Pfam Description: AP2 domain
  misc_feature (1)..(307): Score of 629.4 for HMM of FIGURE 3 of USSN 12/445,005.
MANFEEVSALKRIKFHLLGEFSPLPSPISTPCFDFDFDFEFQTNQTASQSESNSSTSISMNQYFTNLLETDAQIPLFEFDTKPQMMEHESPKALTSSHPFSQSQRTTEKKPKLARKPSLEIALPKKTEWIQFSKPDPKPEAVVQKPEAVKKQHYRGVRQRPWGKFAAEIRDPNKRGSRVWLGTFETAIEAAKAYDSAAFRMRGSKAILNFPLEVNAAAATETAVTAVETTGDGNKKRCREEEEEEVVEVKPVVKKEKITEYDMSCFKEMPLTPSFWTGLWDGDVKGMSSVSPLSPLSSFCLSPLVVV

SEQ ID NO: 2170 - DNA, 1167 bp, Gossypium hirsutum
  misc_feature (1)..(1167): useful for making plants with increased tolerance to oxidative stress as described in USSN 12/445,005
  misc_feature (1)..(1167): Ceres CLONE ID no. 1894778
aaccgaaaatttcagtatctttcagaaatctcttagcttcttttcctttttctttttcatctctgaaacttttttaggtttttcagttattggatatggaaagtagcagtgaagtgtcgagtgcgcttcaatatatcgaacaatatttacttgatgaaaatcaatttactcctgcgggattggggagcttttcaactgcaaatcaatggataaatgaaccgatacccgaggtttccacctctccgtctcagtctctttgctctcaaacttccacctctgattcctgtcttacgctatccaattttaattgcctcgacgtcgatgatttcttcaacttctctcccaatttcccaggtttcgagtctaaccgaatggatgtttttgaatttgactcgaaacctcaatttatccatctaaccgctcctaagccctttgaatttgcacctcaaatcactgaactttcagctgttaaacctccagctccttcgaattcgagttccagctctcataatcgaaaaccgtcgctcaaaatatcgttaccgcataaagtagagtggattcagttccgcaaaccgtattcgactaaggcacagccgacgaattcaaattccgaagacaaaaataagcattacagaggtgtccgacagagaccgtgggggaagtttgcggccgagatccgagatccgaaccgaagaggttcacggatctggttgggaacctttgataccgcaatagaagccgcaaaggcttacgaccgagccgcttttaagctacgtggctcgaaagcgattcttaacttccctctagaagccgggaagcttgacgtaaccgccgtcgacggagagaggaaacggagcagaggcgacggcgcttgggatgagaaacaagttaaggccgttaagagagcaaatgatgacgtgaccaaagcgagagataacggcgatgggcctttaacgccgtcaaattggacatcatttatggattggaataatgaggcaaagggaatatttaacatgccattgttatcgccgttatctccacacccgccgttaggctttcaacaagtgacggtcatctaatgataatgtatataaattcttttatttgtttttagaattctggaattctcttctttcaaaagaaaaaaaataaaaattgggattctat

SEQ ID NO: 2171 - protein, 327 aa, Gossypium hirsutum
  misc_feature (1)..(327): useful for making plants with increased tolerance to oxidative stress as described in USSN 12/445,005
  misc_feature (1)..(327): Ceres CLONE ID no. 1894778
  misc_feature (1)..(327): Functional Homolog of  Ceres CLONE ID no. 268310
  misc_feature (177)..(229): Pfam Name: AP2 Pfam Description: AP2 domain
  misc_feature (1)..(327): Score of 377.1 for HMM of FIGURE 3 of USSN 12/445,005.
MESSSEVSSALQYIEQYLLDENQFTPAGLGSFSTANQWINEPIPEVSTSPSQSLCSQTSTSDSCLTLSNFNCLDVDDFFNFSPNFPGFESNRMDVFEFDSKPQFIHLTAPKPFEFAPQITELSAVKPPAPSNSSSSSHNRKPSLKISLPHKVEWIQFRKPYSTKAQPTNSNSEDKNKHYRGVRQRPWGKFAAEIRDPNRRGSRIWLGTFDTAIEAAKAYDRAAFKLRGSKAILNFPLEAGKLDVTAVDGERKRSRGDGAWDEKQVKAVKRANDDVTKARDNGDGPLTPSNWTSFMDWNNEAKGIFNMPLLSPLSPHPPLGFQQVTVI

SEQ ID NO: 2172 - protein, 318 aa, Oryza sativa subsp. japonica
  misc_feature (1)..(318): useful for making plants with increased tolerance to oxidative stress as described in USSN 12/445,005
  misc_feature (1)..(318): Public GI no. 50927523
  misc_feature (1)..(318): Functional Homolog of  Ceres CLONE ID no. 268310
  misc_feature (138)..(190): Pfam Name: AP2 Pfam Description: AP2 domain
  misc_feature (1)..(318): Score of 134.6 for HMM of FIGURE 3 of USSN 12/445,005.
MDFPGDAEDFALEFIREHLLGGDAPVLPPAAVPAAAAYLPTSTMFLPQQQRGYAGLTPQEYVVDSAPAADQAAFRDDQPDPAADVMIMFGGERFPAVKPSSSSSPSLTVTVPPSSFGSWAPAAVPAVAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 2173 - protein, 282 aa, Nicotiana sylvestris
  misc_feature (1)..(282): useful for making plants with increased tolerance to oxidative stress as described in USSN 12/445,005
  misc_feature (1)..(282): Public GI no. 8809575
  misc_feature (1)..(282): Functional Homolog of  Ceres CLONE ID no. 268310
  misc_feature (136)..(188): Pfam Name: AP2 Pfam Description: AP2 domain
  misc_feature (1)..(282): Score of 664.3 for HMM of FIGURE 3 of USSN 12/445,005.
MASPQENSTTLDLIRQHLLDDNVFLEHYCSETETTTLIYSQSSSSSESLDQSFSFEPTLNYATTAQSSNLEVSTFFNNSKTEFDSFEFGTIPNVSAARSSSLKQTSFKERKPSLNIAIPVKQEVVQKVELAPTEKKHYRGVRQRPWGKFAAEIRDPNRKGTRVWLGTFDTAIEAAKAYDRAAYKLRGSKAIVNFPLEVANFKQEFNNEIRPLVNSSRKRVRETVNEEQLVINKEMKIEEERVPTAPLTPSSWSAIWDSGDGKGIFEVPPLSPFGAYSQLVMI

SEQ ID NO: 2174 - protein, 291 aa, Nicotiana tabacum
  misc_feature (1)..(291): useful for making plants with increased tolerance to oxidative stress as described in USSN 12/445,005
  misc_feature (1)..(291): Public GI no. 1208497
  misc_feature (1)..(291): Functional Homolog of  Ceres CLONE ID no. 268310
  misc_feature (143)..(195): Pfam Name: AP2 Pfam Description: AP2 domain
  misc_feature (1)..(291): Score of 584.2 for HMM of FIGURE 3 of USSN 12/445,005.
MASPQENCTTLDLIRQHLLDDNVFMEHYCPQPILYSQSSSSSESLNSIASELNNETFSFEPTLKYADTAQSSNLDISSFFNNSKTEFDSFEFETKPNVSAARISSNSPKQTSFKERKPSLNIAIPMKQQEVVQKVEVVPTEKKHYRGVRQRPWGKFAAEIRDPNRKGTRVWLGTFDTAIEAAKAYDRAAFKLRGSKAIVNFPLEVANFKQQDNEILQPANSGRKRMRETENEEIVIKKEVKREERVPAAAAPLTPSSWSAIWEGEDGKGIFEVPPLSPLSPHMAYSQLVMI

SEQ ID NO: 2175 - protein, 272 aa, Capsicum annuum
  misc_feature (1)..(272): useful for making plants with increased tolerance to oxidative stress as described in USSN 12/445,005
  misc_feature (1)..(272): Public GI no. 60459383
  misc_feature (1)..(272): Functional Homolog of  Ceres CLONE ID no. 268310
  misc_feature (122)..(174): Pfam Name: AP2 Pfam Description: AP2 domain
  misc_feature (1)..(272): Score of 648.8 for HMM of FIGURE 3 of USSN 12/445,005.
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINKEMKIEEEERVAQTAPLTPSNWSTIWDSGNGKGIFEVPPLSPLSPHMSYSQLVMI

SEQ ID NO: 2176 - DNA, 1803 bp, Arabidopsis thaliana
  misc_feature (1)..(1803): useful for making plants with increased tolerance to oxidative stress as described in USSN 12/445,005
  misc_feature (1)..(1803): Ceres LOCUS ID no. At4g35180
  misc_feature (1)..(1803): Ceres ANNOT. ID 508342
  misc_feature (1)..(1803): Also Known As Ceres ME LINE ME06123
  misc_feature (1)..(1803): Genomic Sequence of SEQ ID NO:93
  misc_feature (1)..(203): exon
  misc_feature (204)..(308): Intron
  misc_feature (309)..(442): exon
  misc_feature (443)..(575): Intron
  misc_feature (576)..(991): exon
  misc_feature (992)..(1096): Intron
  misc_feature (1097)..(1228): exon
  misc_feature (1229)..(1317): Intron
  misc_feature (1318)..(1803): exon
atgtcaccagccccctccacggatccacaaccaatctccggcgaaaaaaacggcggcgatggtggtaggattccggtagaagagtggctgccgatcacagaatcaagaaaaggaaatgtttatacggcgacgtttcatcttctctgttcgggaattggtctccaagtgattcttcttcctgcagctttcgcagcactcggatggtaataactctattcataattctctttagtttctttattttgtccgatttgtgaaatctctgctttgagtaccgttttgattattttatttatttatttttctagggtatggggaacgataatcttaacggtagggtttgtatggaagctctacacgacgtggcttcttgttcaactccacgaagcggttccgggaattcgtatcagcagatacgtgagactcgcaattgcttcttttggtatgtaactatttaacaaaaatcctaattctctcttgatttgtcgttttttgagttttggaatttattaagaacttcagtttcgttaaacgataccgtttctgatgttgttgtaatgaaacaatataattaggtgtgaagcttgggaaacttctcggaatattccctgtgatgtatctctcaggaggagcttgtacgattctggttataaccggagggaaatcaatacaacaactgttacaaattatgtctgacgacaatacagcgccacttacttcagtgcaatgcttcttggtttttagttgcattgcgatgatcatgtctcagtttccgaatctaaattctctctttggagtctcgttgatcggtgcttttatgggaattgcgtattgcaccgtgatatggattttacctgtagctagtgactcacaaaggactcaagtcagtgtctcgtacgctacaatggataaaagtttcgttcacattttcaacgctattggattgatagctctagtatatcgcgggaacaatctcgtccttgagatacaggttttgactaactcgcagttaaaacatgatttagacgttttcaaaatatattttcttctttcgtttagtattaataatgtggtttctttggggtgatatttgtagggtactcttccttccgattcaaagaacccttcatgtaagacaatgtggagagcagtgatgatctctcatgctctcgtcgcgatttgtatgtttccattaacgtttgttgtatattgggcatacggagacaaggtatatgtcaaaaccaaacactattccattttttgtaggtgtatatgtttgcatttacattttgaatagaatttttttttttttgatagattccggcgacgggaggtcccgtgggcaactatctgaaactttacacacaagagcactcgaagcgagcagcctgtttcatacacctcacgtttatcttctcttgcttatgttcatatccgataaacttaatgccggcgtgtgacaacatagagatggtgtacataaccaagaagaaaaagcctgcatccatcattgtccggatgatgttgcgtgtgtttttgagcttggtttgtttcactatagccgttggattcccgttcttgccttatctagcggttcttattggagcaatagccttgcttgtgacgtttacgtatccatgtttcatgtggatctctatcaaaaagccccaaaggaaaagcccaatgtggttgtttaacgttttggtgggttgcctaggtgcttctctcagcgttttgcttctggttgcctcggctatgcgtttggctcaaaagggtttgcatgctaacttcttcagaccctaa

SEQ ID NO: 2177 - DNA, 1596 bp, Arabidopsis thaliana
  misc_feature (1)..(1596): useful for making plants with increased tolerance to oxidative stress as described in USSN 12/445,005
  misc_feature (1)..(1596): Ceres LOCUS ID no. At4g35180
  misc_feature (1)..(1596): Also Known As Ceres ME LINE ME06123
acttatttgatttggaatcacaagaaagtggtggttctcctttatttatgtcaccagccccctccacggatccacaaccaatctccggcgaaaaaaacggcggcgatggtggtaggattccggtagaagagtggctgccgatcacagaatcaagaaaaggaaatgtttatacggcgacgtttcatcttctctgttcgggaattggtctccaagtgattcttcttcctgcagctttcgcagcactcggatgggtatggggaacgataatcttaacggtagggtttgtatggaagctctacacgacgtggcttcttgttcaactccacgaagcggttccgggaattcgtatcagcagatacgtgagactcgcaattgcttcttttggtgtgaagcttgggaaacttctcggaatattccctgtgatgtatctctcaggaggagcttgtacgattctggttataaccggagggaaatcaatacaacaactgttacaaattatgtctgacgacaatacagcgccacttacttcagtgcaatgcttcttggtttttagttgcattgcgatgatcatgtctcagtttccgaatctaaattctctctttggagtctcgttgatcggtgcttttatgggaattgcgtattgcaccgtgatatggattttacctgtagctagtgactcacaaaggactcaagtcagtgtctcgtacgctacaatggataaaagtttcgttcacattttcaacgctattggattgatagctctagtatatcgcgggaacaatctcgtccttgagatacagggtactcttccttccgattcaaagaacccttcatgtaagacaatgtggagagcagtgatgatctctcatgctctcgtcgcgatttgtatgtttccattaacgtttgctgtatattgggcatacggagacaagattccggcgacgggaggtcccgtgggcaactatctgaaactttacacacaagagcactcgaagcgagcagcctgtttcatacacctcacgtttatcttctcttgcttatgttcatatccgataaacttaatgccggcgtgtgacaacatagagatggtgtacataaccaagaagaaaaagcctgcatccatcattgtccggatgatgttgcgtgtgtttttgagcttggtttgtttcactatagccgttggattcccgttcttgccttatctagcggttcttattggagcaatagccttgcttgtgacgtttacgtatccatgtttcatgtggatctctatcaaaaagccccaaaggaaaagcccaatgtggttgtttaacgttttggtgggttgcctaggtgcttctctcagcgttttgcttctggttgcctcggctatgcgtttggctcaaaagggtttgcatgctaacttcttcagaccctaaagcatccttgcaatcgttagaatgtaattagaatttgtggcacacgtggtaaacttgggactactaacatgttcagttgaaatatttaaattttgtaattatgatattttaatgtatacttctctcaaaaaagagaaaatcgtcagttgatgacaacactattcaacttgttaattcc

SEQ ID NO: 2178 - protein, 456 aa, Arabidopsis thaliana
  misc_feature (1)..(456): useful for making plants with increased tolerance to oxidative stress as described in USSN 12/445,005
  misc_feature (1)..(456): Ceres LOCUS ID no. At4g35180
  misc_feature (1)..(456): Also Known As Ceres ME LINE ME06123
  misc_feature (36)..(442): Pfam Name: Aa_trans Pfam Description: Transmembrane amino acid transporter protein
  misc_feature (1)..(456): Score of 1135.5 for HMM of FIGURE 5 of USSN 12/445,005.
MSPAPSTDPQPISGEKNGGDGGRIPVEEWLPITESRKGNVYTATFHLLCSGIGLQVILLPAAFAALGWVWGTIILTVGFVWKLYTTWLLVQLHEAVPGIRISRYVRLAIASFGVKLGKLLGIFPVMYLSGGACTILVITGGKSIQQLLQIMSDDNTAPLTSVQCFLVFSCIAMIMSQFPNLNSLFGVSLIGAFMGIAYCTVIWILPVASDSQRTQVSVSYATMDKSFVHIFNAIGLIALVYRGNNLVLEIQGTLPSDSKNPSCKTMWRAVMISHALVAICMFPLTFAVYWAYGDKIPATGGPVGNYLKLYTQEHSKRAACFIHLTFIFSCLCSYPINLMPACDNIEMVYITKKKKPASIIVRMMLRVFLSLVCFTIAVGFPFLPYLAVLIGAIALLVTFTYPCFMWISIKKPQRKSPMWLFNVLVGCLGASLSVLLLVASAMRLAQKGLHANFFRP

SEQ ID NO: 2179 - DNA, 1509 bp, Populus balsamifera subsp. trichocarpa
  misc_feature (1)..(1509): useful for making plants with increased tolerance to oxidative stress as described in USSN 12/445,005
  misc_feature (1)..(1509): Ceres ANNOT ID no. 1450631
atgggagaaattggcaatgttgaacaattacctttccacaacctacccagttcagccaccggccctgaattatctcttcatgtcatcagtgttgcagcaagttccatgcgagaaatgcagagtgctgctacgagtacaagcatgggggtttatgattcctcagatagttcaggctacctgtctgaggtcaacccacaagaagcttggcttcctattacagaatcaagaaatggcaatactgttacttccgtgtttcatttactttcttcaggaattgggattcaagcccttctacttcctgtggcattttccattcttggatgggcatggggaatcatatgcttgtcgctagcatttacctggcaactctataccatatgggttcttgtccaacttcatgaatcagtacctggaattggaactcgctacagcagatatctccaacttgcaatagccgcctttggtccaaaacttgggaagttgctggctatatttccagtaatgtatttatccgggggctcatgtgtgttgctgattatcagaggagctggaactatggagcttttcttcaaaatgatgtttcgaggtgaggctacaattgaagacagtccattggcaggggcagggtggtttttggtcttcacttgcatggctatagcattggctcaacggcctaacttgaattccattgctgggttctcccttatcggtgcagtcactgccattgcctattgtactctgatctgggcactgcccatctctaagggcaggcctagtggtgtatcttataattcacagaaggaggaatccggcatgtctgaaatgtttgatgtcttgaatgcaattgggatgattgtgcttgctttcaggggtcacaatcttggcaccctgccttcaagttcaaaatgtccatccaaaaagctaatgtggagaggagtgactctctcatacataataatagccatttgcttgtttcctattgcaattgctggattttggacttatggaaacaagataccctcgaatggagggatgttgactgcatttatgcagttgcatggacacgacacatcaaaatttgcgaagggccttgtatacttgctagtagtgattaactgccttagttcattccaaatctacgccatgccagttttcgacaacctggaattcaggtacacttgcatgaagaacaagcgatgctcgtggtgggttcgcaccgggtttcggctttttttcggaggattggccttctttatagctgtggcttttccatttttacctagcctggctgctttaatcggaggaatcgcgttaccccttacactggcttatccatgtttcatgtggatttcgatcaagaaaccccatcaaaagggccatggtgtcatgtggtgtcttaatctaggacttggatgcttaggcatggttctgagtgttctattggtcgttgcagcagtttggaatttggctaccaaaggcctacatgccaacttcttccaccccgaatga

SEQ ID NO: 2180 - protein, 502 aa, Populus balsamifera subsp. trichocarpa
  misc_feature (1)..(502): useful for making plants with increased tolerance to oxidative stress as described in USSN 12/445,005
  misc_feature (1)..(502): Ceres ANNOT ID no. 1450631
  misc_feature (1)..(502): Functional Homolog of  Ceres LOCUS ID no. At4g35180
  misc_feature (76)..(487): Pfam Name: Aa_trans Pfam Description: Transmembrane amino acid transporter protein
  misc_feature (1)..(502): Score of 1211.5 for HMM of FIGURE 5 of USSN 12/445,005.
MGEIGNVEQLPFHNLPSSATGPELSLHVISVAASSMREMQSAATSTSMGVYDSSDSSGYLSEVNPQEAWLPITESRNGNTVTSVFHLLSSGIGIQALLLPVAFSILGWAWGIICLSLAFTWQLYTIWVLVQLHESVPGIGTRYSRYLQLAIAAFGPKLGKLLAIFPVMYLSGGSCVLLIIRGAGTMELFFKMMFRGEATIEDSPLAGAGWFLVFTCMAIALAQRPNLNSIAGFSLIGAVTAIAYCTLIWALPISKGRPSGVSYNSQKEESGMSEMFDVLNAIGMIVLAFRGHNLGTLPSSSKCPSKKLMWRGVTLSYIIIAICLFPIAIAGFWTYGNKIPSNGGMLTAFMQLHGHDTSKFAKGLVYLLVVINCLSSFQIYAMPVFDNLEFRYTCMKNKRCSWWVRTGFRLFFGGLAFFIAVAFPFLPSLAALIGGIALPLTLAYPCFMWISIKKPHQKGHGVMWCLNLGLGCLGMVLSVLLVVAAVWNLATKGLHANFFHPE

SEQ ID NO: 2181 - protein, 543 aa, Glycine max
  misc_feature (1)..(543): useful for making plants with increased tolerance to oxidative stress as described in USSN 12/445,005
  misc_feature (1)..(543): Ceres CLONE ID no. 1658212
  misc_feature (1)..(543): Functional Homolog of  Ceres LOCUS ID no. At4g35180
  misc_feature (117)..(528): Pfam Name: Aa_trans Pfam Description: Transmembrane amino acid transporter protein
  misc_feature (1)..(543): Score of 1379.4 for HMM of FIGURE 5 of USSN 12/445,005.
MGEAKEIWSAPITPRTASVVGTPVVASPPVSCPPSQLHSPSLTRSPLLHPEDGDAPRPNKTSKTPKTPRTPRTPRTPLRISNLTPKFLTPLGSPVRKALRFTKLDPQDAWLPITESRNGNKYYAAFHTLCSGIGIQALVLPVAFTFLGWTWGIISMTLAFIWQLYTLWLLVNLHESVEQGVRYCRYLQLCGATFGEKLGKILALFPILYLSAGTCTTLIIIGGSTARTFYQVVCGETCTAKPMTTVEWYLVFTCVAVVLSQLPNLNSIAGVSLIGAVTAVGYCTAIWVTSVARGALKDVSYNPVRTGSSIENAFGVLNALGIIAFAFRGHNLILEIQSTMPSSEKHPSHVPMWKGVKVSYTIIAACLFPMAIGGYWAYGQLIPANGGMLTALYQYHSRDVSRFVLGLTSFFVVVNGLCSFQIYGMPAFDDMESGYTARMKKPCPWWLRAFIRVFFGFLCFFIGVAVPFLSQLAGLIGGVALPVTFAYPCFMWLKTKKPKKLSLMWWLNWFLGTLGVALSAILVAASLYVIVDTGVNVSFFNPQ

SEQ ID NO: 2182 - protein, 512 aa, Oryza sativa subsp. japonica
  misc_feature (1)..(512): useful for making plants with increased tolerance to oxidative stress as described in USSN 12/445,005
  misc_feature (1)..(512): Public GI no. 50927941
  misc_feature (1)..(512): Functional Homolog of  Ceres LOCUS ID no. At4g35180
  misc_feature (84)..(489): Pfam Name: Aa_trans Pfam Description: Transmembrane amino acid transporter protein
  misc_feature (1)..(512): Score of 1401.5 for HMM of FIGURE 5 of USSN 12/445,005.
MSSEVTSVPPTPTPPPVSTPPSQIQSPAAPASSRASPLRGMGTPNIASPVRKAVASVSGYLGEVGQMTRLADPRDAWLPITESRSGNAYYAAFHSLSSGIGFQALVLPVAFSLLGWTWAIICLTVAFAWQLYTLWLLVKLHEPVAGGTRYSRYMYLATTVFGEKWGKILALLPVMYLSAGTCTALIIVGGGSMKLLFNIACGEVCLARPLTTVEWYLVFVCVAALLSQLPNLNSIAGVSLVGATAAVAYCTMIWVVSVAKGRVAGVSYDPVRTTDEEDGAIGILNGLGIIAFAFRGHNLVLEIQATMPSTLKHPSHVPMWKGVKAAYVIIALCLYPVAVGGFWAYGDQIPPNGILSALYKFHSQDVSRVVLGTATLLVIVNCLTTYQIYAMPVFDNMETGYVHKKNRPCPWWMRAGFRALFGAINLLIAVALPFLSELAGLLGGISLPVTLAYPCFMWVAIMRPAKGTAMWYTNWGLGSLGMGLSFVLIVGNLWGLVEKGLHVKFFKPADFQ

SEQ ID NO: 2183 - protein, 484 aa, Zea mays
  misc_feature (1)..(484): useful for making plants with increased tolerance to oxidative stress as described in USSN 12/445,005
  misc_feature (1)..(484): Ceres CLONE ID no. 383013
  misc_feature (1)..(484): Functional Homolog of  Ceres LOCUS ID no. At4g35180
  misc_feature (86)..(411): Pfam Name: Aa_trans Pfam Description: Transmembrane amino acid transporter protein
  misc_feature (1)..(484): Score of 1121.0 for HMM of FIGURE 5 of USSN 12/445,005.
MSSSREVMVLSDSEVQSAPPTPRPPPPVSAPPSQIHSPSPARSPLASPVRKAVAGVKAGCLEEEVGGHVTRLADPRDAWLPVTESRSGNAYYAAFHSLSSGIGFQALVLPTAFASLGWTWAIICLTLAFGWQLYTLWLLVRLHEPVAGATRYSRYMHLATTVFGDRWANILALLPVTYLSAGICTALIIVGGGSMKMLFGIAYGGSCLARPLTAVEWYLVFVCAAVVLSQLPNLNSIAGVSLVAAVAAVAYCTMIWAVSVARGRVAGVSYDPVHKAPDDVDAALGVLNGLGIIAFAFRGHNVVLEIQGTMPSTLKHPSHVPMWKGVKVAYAIIALCLYPIAIGGFWAYGNQIPPNGILSALYKFHSRDASRLVLGVTTLLVIINCLTTFQIYAMPVYDNMEAGYVHKKNRPCPCGCARASAPSSARSTSSSPSRCRSCRSSPASSEGSRCRSPWPTRASCGWRSRSRGRAPPRGTSTGRWESLA

SEQ ID NO: 2184 - protein, 505 aa, Triticum aestivum
  misc_feature (1)..(505): useful for making plants with increased tolerance to oxidative stress as described in USSN 12/445,005
  misc_feature (1)..(505): Ceres CLONE ID no. 788118
  misc_feature (1)..(505): Functional Homolog of  Ceres LOCUS ID no. At4g35180
  misc_feature (77)..(487): Pfam Name: Aa_trans Pfam Description: Transmembrane amino acid transporter protein
  misc_feature (1)..(505): Score of 1399.0 for HMM of FIGURE 5 of USSN 12/445,005.
MTSEVQSAPPTPRPVSAPPSQMHSPAPSRSPLRAMASPLASPVKKAVASVRGYLEEVGHITKLADPRDAWLPITASRSGNAYYAAFHNLSSGVGFQALVLPAAFASLGWTWAIVCLTVAFAWQLYTLRLLVNLHEPVAGGTRYSRYMHLATTVFGERWGKILALLPTMYLSAGTCTALIIVGGGSMKILFSIACGPACVARPPTMVEWYVVFVCVAVVLSQLPNLNSIAGVSLVGATAAVGYCTMIWVISVTKGRVAGVSYDPVKASSDVDRTIAVLNGLGIIAFAFRGHNLVLEIQGTMPSTLKHPSHVPMWKGVKFAYLVVALCLYPVAIGGFWAYGNQIPPNGILSALYKFHSRDVSRLVIGLATLLVIVNCLTTFQIYAMPVFDNMEAGYVHKKNRPCPWWLRAGFRALFGAVNLLIAVALPFLSELAGLLGGISLPVTLAYPCFMWLAIMKPGRGTAMWCVNWALGCLGMGLSFVLIVGNLWGLVATGLHVQFFKPAEFQ

SEQ ID NO: 2185 - DNA, 2018 bp, Arabidopsis thaliana
  misc_feature (1)..(2018): useful for making plants with increased tolerance to oxidative stress as described in USSN 12/445,005
  misc_feature (1)..(2018): Ceres LOCUS ID no. At5g14260
  misc_feature (1)..(2018): Also Known As Ceres ME LINE ME00922
  misc_feature (1)..(2018): Ceres Clone 41610
tcttccgataaaaaccggatcccccgggctgcaggaattcgcacgagaccattacctagaacatcctaatcgaaaaaaaacgcaaaagaagaacggagcaaaatcttcagaatcgtcgccggagaatctttacgtttcgacataatcggaattttggaattgataattccgatggaaggggttatcacatgtttccatacgaaatgcgtctctcttccaattcgttctttcccactttctagggtttcttcacttcctcggtggaggaacaataaattgatctcttcatcgcgatcggttcatctaagaagcttgtgcgtttcggcttcgagctcagatactttagtcgcgggcggttcaccaaaggaagacgagaggcagagcaaagtatcgagcaagaaggaaggagatgactccgaggatttgaagttttggatggataagaatgggttgccaccttgcaaggttattctcaaggagaaaccagctcatgatcagaagcataaacctatacattatgttgctgctagtgaggatcttcagaagggtgatgtggcgttttcagttcctgattctctggtggtcactctggaaagagttttgggaaacgagactattgctgaactgttgacgacgaacaaattatccgaactggcttgtctagctttgtatttgatgtatgagaagaaacaaggaaagaaatcagtatggtatccctatataagagaacttgatcgtcaaagaggaagaggtcagttagatgcggaatcccctttgctgtggtcagaggctgagttagattacctaactggtagtcctaccaaggccgaagttcttgagagggctgaagggatcaaaagagaatacaatgagcttgacactgtctggttcatggctggatctttgtttcagcaatacccatttgacataccaactgaagctttttcatttgagattttcaaacaggcatttgttgccattcagtcatgtgtggtgcatttacaaaatgtcggtttggctcgtcggtttgctttggttcctcttggtcctcccttgttggcctattgttccaactgcaaggcaatgcttactgctgttgatggtgctgttgaactcgtggtagataggccatataaggccggggatcctatagttgtctggtgtgggccacaaccaaatgcgaaattgcttctgaactatggatttgttgatgaggataacccttatgatagagtaatagttgaggcagcgttcaacactgaggatccccaataccaggacaagagaatggttgctcaaaggaacggaaaattatcccaacaagtatttcaggttcgtgtgggaaaagaaagagaagctgttcaagacatgcttccctacctgcggttgggttacatgtctgatccttctgaaatgcagtcagtaatttcatcccaaggtccagtttgtccgatgagcccttgtatggaaagagcagtactagatcagcttgctaattacttcatgagacggttatctggctaccctactactccgaaagaagatgatgcattgttggcagatcctagtttgagtcctaggaagcgagttgcaacccggcttgtccaactggagaagaaaatactagttgcatgccttacgacaacagttgatcttttaaatcagttgcccgatacagccatctctccatgcccagcaccatatgctccttccttgaaataaaaaggttcgtgttgtagctgcaatttgtgggacatggcaggagtaatttttggtcgtgtccttgatcattacaatctgaggtcgcttaactacggtagataagggtgtactaggagcgttatctgccgcttgacacgcaaatgtttcagcatatgattgtcctttttttcttacaacaatgaagccttaagtcgcattgttcaaagtgtacatacatgaatgaaccttcttgttcttccccaactccctctgtaatgttttatctctgttttagaaatttagaatttatcatttct

SEQ ID NO: 2186 - protein, 516 aa, Arabidopsis thaliana
  misc_feature (1)..(516): useful for making plants with increased tolerance to oxidative stress as described in USSN 12/445,005
  misc_feature (1)..(516): Ceres LOCUS ID no. At5g14260
  misc_feature (1)..(516): Ceres Clone 41610
  misc_feature (1)..(516): Also Known As Ceres ME LINE ME00922
  misc_feature (361)..(485): Pfam Name: Rubis-subs-bind Pfam Description: Rubisco LSMT substrate-binding
  misc_feature (83)..(338): Pfam Name: SET Pfam Description: SET domain
  misc_feature (1)..(516): Score of 1261.8 for HMM of FIGURE 8 of USSN 12/445,005.
MEGVITCFHTKCVSLPIRSFPLSRVSSLPRWRNNKLISSSRSVHLRSLCVSASSSDTLVAGGSPKEDERQSKVSSKKEGDDSEDLKFWMDKNGLPPCKVILKEKPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAAFNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 2187 - DNA, 1509 bp, Populus balsamifera subsp. trichocarpa
  misc_feature (1)..(1509): useful for making plants with increased tolerance to oxidative stress as described in USSN 12/445,005
  misc_feature (1)..(1509): Ceres ANNOT ID no. 1536088
atggaattcacttgtttacacaacaaatgcatttcaccttctcttactgttctctctagggtttcaatttcattttccaatcttcctaaacgcgccgtttcatttcaccggcggcggagaaatttgtgctttgcaacattagtcgatgggaaacgtactagtgaagttgtgagcaaaagaggaggagaagaagaagacgaatttggggatttgaagtcttggatgcataaaaatggattgcctccttgcaaagttgtgcttaaagaaagaccttctcatgacaagaaacttcgacctattcattatgttgctgctagcgaggatcttcaggccagtgatgtggcggtttcggtgcccaattcgcttgttgttacactcgagagggttttgggaaatgagactcttgcggaactcttaaccacaaacaaattatcggaattggcatgcttggccttatacctgatgtatgagaagaagcaaggaaagaagtcattctggtatccatatataagggagcttgatcgtcagcgaggtaggggtcagctggctgtggaatctccacttttatggtctgaggctgaattggcttacctgactggtagcccaactaaggctgaagttcttgacagggcagatggaattaaaagagaatatgaggagctagacactgtttggttcatggctggttctctgtttcagcaatatccatatgatatacctactgaagcctttccctttgagatttttaaacaagcttttgtagccattcaatcctgtgtggtgcatttacagaaagtcagtttggctcgaagatttgctttggttcctcttggaccacctttgctagcatacagtagcaactgcaaggcaatgttaactgctgttgatggtgctgttgaattagtggttgatcgaccatacaaggctggggagcccattgttgtatggtgtgggccacagccaaattcaaaattgcttttaaactatggctttgttgatgaagataatccttatgaccgaatagcagttgaggcagcactgaacactgaggaccctcagtatcaggacaagagaatggttgctcaaagaaatgggaaattgtcagtgcaagtttttcaagtatacgctggaaaggaaaaagaagccgtgtcagatattcttccttatttgcgattgggatatgtatcagatccttctgaaatgcaatctgtaatttcttctcaaggtccagtttgtccagtaagcccttgtatggaacaagcagtgttagatcagcttactgtttattttagaacgcgccttgctggctattgtaccagcataagtgaagatgagttgatgttggcagatcctaacttgaaccccaagaagcgagtggctactcagcttgttagattggaaaagaaaatgctgaaggcatgcttgcaggctacagttgatttgataaaccagttacctgatcacaccatgcctccatgcccagctccttatgcccctttattgaaatga

SEQ ID NO: 2188 - protein, 502 aa, Populus balsamifera subsp. trichocarpa
  misc_feature (1)..(502): useful for making plants with increased tolerance to oxidative stress as described in USSN 12/445,005
  misc_feature (1)..(502): Ceres ANNOT ID no. 1536088
  misc_feature (1)..(502): Functional Homolog of  Ceres LOCUS ID no. At5g14260
  misc_feature (103)..(324): Pfam Name: SET Pfam Description: SET domain
  misc_feature (347)..(471): Pfam Name: Rubis-subs-bind Pfam Description: Rubisco LSMT substrate-binding
  misc_feature (1)..(502): Score of 1271.2 for HMM of FIGURE 8 of USSN 12/445,005.
MEFTCLHNKCISPSLTVLSRVSISFSNLPKRAVSFHRRRRNLCFATLVDGKRTSEVVSKRGGEEEDEFGDLKSWMHKNGLPPCKVVLKERPSHDKKLRPIHYVAASEDLQASDVAVSVPNSLVVTLERVLGNETLAELLTTNKLSELACLALYLMYEKKQGKKSFWYPYIRELDRQRGRGQLAVESPLLWSEAELAYLTGSPTKAEVLDRADGIKREYEELDTVWFMAGSLFQQYPYDIPTEAFPFEIFKQAFVAIQSCVVHLQKVSLARRFALVPLGPPLLAYSSNCKAMLTAVDGAVELVVDRPYKAGEPIVVWCGPQPNSKLLLNYGFVDEDNPYDRIAVEAALNTEDPQYQDKRMVAQRNGKLSVQVFQVYAGKEKEAVSDILPYLRLGYVSDPSEMQSVISSQGPVCPVSPCMEQAVLDQLTVYFRTRLAGYCTSISEDELMLADPNLNPKKRVATQLVRLEKKMLKACLQATVDLINQLPDHTMPPCPAPYAPLLK

SEQ ID NO: 2189 - protein, 509 aa, Oryza sativa subsp. japonica
  misc_feature (1)..(509): useful for making plants with increased tolerance to oxidative stress as described in USSN 12/445,005
  misc_feature (1)..(509): Public GI no. 77554044
  misc_feature (1)..(509): Functional Homolog of  Ceres LOCUS ID no. At5g14260
  misc_feature (114)..(331): Pfam Name: SET Pfam Description: SET domain
  misc_feature (354)..(478): Pfam Name: Rubis-subs-bind Pfam Description: Rubisco LSMT substrate-binding
  misc_feature (1)..(509): Score of 1284.4 for HMM of FIGURE 8 of USSN 12/445,005.
MASSASVSPAAASHHRLLLPCSPRRLPRPRPRPSPRLLRSARPRLVACHADTLLPSSSPAAAAAACASTASANGFSDWLREHGLPPGKVAILDRPVPCFREGKDLPLHYVAAGQDLEAGDVAFEVPMSLVVTLERVLGDESVAELLTTNKLSELACLALYLMYEKKQGQDSFWYPYIKELDRQRGRGQLAVESPLLWTESELNYLKGSPIKDEVVARDEGIRREYNELDTLWFMAGSLFQQYPFDIPTEAFPFEIFKQAFVAVQSCVVHLQKVSLARRFALVPLGPPLLTYKSNCKAMLTAVGDSVRLVVDRPYKAGEPIIVWCGPQPNSRLLLNYGFIDEDNPYDRIVIEASLNIEDPQFQEKRMVAQRNGKLAIQNFHVCVGKEKETIAEMLPYLRLGYISDPDEMQSILSSEGDTCPVSPCTERAVLDQLVGYLESRLADYPTTLDEDDAMLADGNLEPKKEVATRLVRLEKKLLHGCLQAANEFINDLPDHTVSPCPAPFAPELK

SEQ ID NO: 2190 - DNA, 507 bp, Arabidopsis thaliana
  misc_feature (1)..(507): useful for making plants with increased tolerance to oxidative stress as described in USSN 12/445,005
  misc_feature (1)..(507): Ceres LOCUS ID no. At1g26710
  misc_feature (1)..(507): Also Known As Ceres ME LINE ME12485
  misc_feature (1)..(507): Also Known As Ceres Annot. ID 544535
atgacaataccaacatataaccttttatgcataggatcattcattttcttactatgtttcagcattacctttggtcgcaaaaacctactagacaagcccggtggcactctatatgcctccaaacctgttgaagccgccgagcttagagccactttggttactaataccaaagctagagacatttcaagtaatattggtttgggagaggttggaagtcaagagatgcatcacacttacataggaacaggtgaagattcaagtcttggaaataaacaagacaatataaactctgtgcctaggaaggttataagaggtatcgtttccatctcattcgcatttcctatcatcaagattcaggttcctattccgaagccaaatattacggtggctgccataaaccaactcgatgaagaagagatgattaaaggcattgtcataactccaacaaagactaatgagttgtgtatttcccttggaaattacgatgtagagctctcatacagctaa

SEQ ID NO: 2191 - protein, 168 aa, Arabidopsis thaliana
  misc_feature (1)..(168): useful for making plants with increased tolerance to oxidative stress as described in USSN 12/445,005
  misc_feature (1)..(168): Ceres LOCUS ID no. At1g26710
  misc_feature (1)..(168): Also Known As Ceres ME LINE ME12485
  misc_feature (1)..(168): Also Known As Ceres Annot. ID 544535
MTIPTYNLLCIGSFIFLLCFSITFGRKNLLDKPGGTLYASKPVEAAELRATLVTNTKARDISSNIGLGEVGSQEMHHTYIGTGEDSSLGNKQDNINSVPRKVIRGIVSISFAFPIIKIQVPIPKPNITVAAINQLDEEEMIKGIVITPTKTNELCISLGNYDVELSYS

SEQ ID NO: 2192 - DNA, 1860 bp, Glycine max
  misc_feature (1)..(1860): useful for making plants with increased tolerance to oxidative stress as described in USSN 12/445,005
  misc_feature (1)..(1860): Ceres CLONE ID no.479625
aacttgttgcaccgtaactgaaaattgaaaccctctttcgcaaaatttcccaatttcgcgaaaccctaactagccctatggaactctctcgtctcttcgtttccgacacgtgcttcttctcccctccgattcgctgctccccttcgccggcgctgtccacgtttttcgccgtcaagaaccgccggagcaggaggaggagcagcttctgttccgcctccaatcccgacaccttggtcgccggcggtgccgccgtcgtcgctggggccggcgagaagcacgaggaggacttgaagtcttggatgcacaaacacggcctccctccctgcaaggttgtgctgaaggataaaccttgccccaatgattctcataaacctatacattacgtcgcagcaagtcaagatcttcaggttggcgatgttgcattctccgttcctaattccttggtggttacgctggagagggtgctgggaaacgagactgttgctgagctattgactacaaataaattgtccgaattggcgtgcttggcattgtatctgatgtatgagaaaaagcaggggaagaaatctttctggtatccgtacatcagggagcttgatcgccaacgaggtaggggccaactgtctgtggaatcacctcttctatggttaaaatctgagctggattacctgtcaggaagtccaattaaggatgaagttattcaaagggaagaagcaataagaaaagagtataatgaacttgacacagtctggtttatggcaggttctctatttcagcaatatccatatgacattcctactgaggccttttcatttgagattttcaaacaagcctttgctgctattcagtcttgtgtggtgcatttacagaaagttagtttagctcggagatttgctttagttcccctgggacctcctttactgtcctaccaaagcaactgcaaggcaatgctaactgctgttgatggcgctgttgagcttgcagttgatcgcccgtataaagccggggacccaattgttgtgtggtgtggccctcaacctaactcaaagttgcttataaactatggttttgttgatgaaaataattccaatgatcgtcttatagttgaggcagctttaaatactgaagatccacaatatcaagataaaagaatggtggctcaaagaaatggaaagttatcagttcaagtttttcatgtatatgctgggaaggaaagggaagctgtcttagatatgcttcgttatatgcgtttgggctatgtttcagatccttctgagatggaatctgtcatctcctctcaaggtccagtttgtcctgtaagcccttgtatggaacgggctgcgttggatcagttggctgattatttcaaggcacggctggctggctaccctacaacattggctgaagatgaatctatgctgacagatgataatctgaatccaaagaagcgagttgctacccaatatgttaggctggaaaagaaaatgctccatgcctgtttgcaggcaaccaccgacttcattaaccagcttccagaccacactatatctccatgccccgctccctatgcacctttattgaaatgaaaggaactggaaatgtatgtagtctgaactgtacaaatatggatttgatgaaccaggtcagtcaaattatatattcttgatatgcatccaattagaaatcccctgaattaaggtaatttgtggtttatcctcttcagctttggtttatatgtgaatgtaggactttaggattggataaagatactcaattctttaaacttctcactgtgtgaaaaacaccctttgttagcaaaccattaaatgtcagctgagttgtaagacaataatttctttg

SEQ ID NO: 2193 - protein, 502 aa, Glycine max
  misc_feature (1)..(502): useful for making plants with increased tolerance to oxidative stress as described in USSN 12/445,005
  misc_feature (1)..(502): Ceres CLONE ID no.479625
  misc_feature (1)..(502): Score of 1299.2 for HMM of FIGURE 8 of USSN 12/445,005.
  misc_feature (1)..(98): Pfam Name: SET Pfam Description: SET domain
  misc_feature (121)..(245): Pfam Name: Rubis-subs-bind Pfam Description: Rubisco LSMT substrate-binding
  misc_feature (1)..(502): Functional Homolog Of Ceres SEEDLINE ID no. ME00922
MELSRLFVSDTCFFSPPIRCSPSPALSTFFAVKNRRSRRRSSFCSASNPDTLVAGGAAVVAGAGEKHEEDLKSWMHKHGLPPCKVVLKDKPCPNDSHKPIHYVAASQDLQVGDVAFSVPNSLVVTLERVLGNETVAELLTTNKLSELACLALYLMYEKKQGKKSFWYPYIRELDRQRGRGQLSVESPLLWLKSELDYLSGSPIKDEVIQREEAIRKEYNELDTVWFMAGSLFQQYPYDIPTEAFSFEIFKQAFAAIQSCVVHLQKVSLARRFALVPLGPPLLSYQSNCKAMLTAVDGAVELAVDRPYKAGDPIVVWCGPQPNSKLLINYGFVDENNSNDRLIVEAALNTEDPQYQDKRMVAQRNGKLSVQVFHVYAGKEREAVLDMLRYMRLGYVSDPSEMESVISSQGPVCPVSPCMERAALDQLADYFKARLAGYPTTLAEDESMLTDDNLNPKKRVATQYVRLEKKMLHACLQATTDFINQLPDHTISPCPAPYAPLLK

SEQ ID NO: 2194 - protein, 514 aa, Arabidopsis thaliana
  misc_feature (1)..(514): useful for making plants with increased tolerance to oxidative stress as described in USSN 12/445,005
  misc_feature (1)..(514): Public GI ID no.22326803
  misc_feature (1)..(514): Score of 1258.6 for HMM of FIGURE 8 of USSN 12/445,005.
  misc_feature (359)..(483): Pfam Name: Rubis-subs-bind Pfam Description: Rubisco LSMT substrate-binding
  misc_feature (81)..(336): Pfam Name: SET Pfam Description: SET domain
  misc_feature (1)..(514): Functional Homolog Of Ceres SEEDLINE ID no. ME00922
MEGVITCFHTKCVSLPIRSFPLSRVSSLPRWRNNKLISSSRSVHLRSLCVSSSDTLVASGSPKEDERQSKVSSKKEGDDSEDLKFWMDKNGLPPCKVILKERPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAALNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 2195 - protein, 514 aa, Arabidopsis thaliana
  misc_feature (1)..(514): useful for making plants with increased tolerance to oxidative stress as described in USSN 12/445,005
  misc_feature (1)..(514): Public GI ID no.18377718
  misc_feature (1)..(514): Score of 1254.4 for HMM of FIGURE 8 of USSN 12/445,005.
  misc_feature (359)..(483): Pfam Name: Rubis-subs-bind Pfam Description: Rubisco LSMT substrate-binding
  misc_feature (81)..(336): Pfam Name: SET Pfam Description: SET domain
  misc_feature (1)..(514): Functional Homolog Of Ceres SEEDLINE ID no. ME00922
MEGVITCFHTKCVSLPIRSFPLSRVSSLPRWRNNKLISSSRSVHLRSLCVSSSDTLVASGSPKEDERQSKVSSKKEGDDSEDLKFWMDKNGLPPCKVILKERPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAALNTEGPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 2196 - protein, 537 aa, Arabidopsis thaliana
  misc_feature (1)..(537): useful for making plants with increased tolerance to oxidative stress as described in USSN 12/445,005
  misc_feature (1)..(537): Public GI ID no.7573451
  misc_feature (1)..(537): Score of 1060.0 for HMM of FIGURE 8 of USSN 12/445,005.
  misc_feature (377)..(479): Pfam Name: Rubis-subs-bind Pfam Description: Rubisco LSMT substrate-binding
  misc_feature (81)..(354): Pfam Name: SET Pfam Description: SET domain
  misc_feature (1)..(537): Functional Homolog Of Ceres SEEDLINE ID no. ME00922
MEGVITCFHTKCVSLPIRSFPLSRVSSLPRWRNNKLISSSRSVHLRSLCVSSSDTLVASGSPKEDERQSKVSSKKEGDDSEDLKFWMDKNGLPPCKVILKERPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQVVLVASSNLDCYASSCTQNVGLARRFALVPLGPPLLAYCSNCKAMLTAVDGAVELVVDRPYKAGDPIVVWCGPQPNAKLLLNYGFVDEDNPYDRVIVEAALNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALEASCNPACPTGEENTSCMPYDNSSCCSCNLWDMAGVIFGRVLDHYNLRSLNYGQFLCVQV

SEQ ID NO: 2197 - DNA, 1953 bp, Arabidopsis thaliana
  misc_feature (1)..(1953): useful for making plants with increased tolerance to oxidative stress as described in USSN 12/445,005
  misc_feature (1)..(1953): Ceres CLONE ID no.24159
aatgaaaaaaataatctgagaaaacgcaaaagaagaacggagcaaaatcttcagaatcgtcgccggagaatctttacgtttcgacataatcggaattttggaattgataattccgatggaaggggttatcacatgtttccatacgaaatgcgtctctcttccaattcgttctttcccactttctagggtttcttcacttcctcggtggaggaacaataaattgatctcttcatcgcgatcggttcatctaagaagcttgtgcgtttcggcttcgagctcagatactttagtcgcgggcggttcaccaaaggaagacgagaggcagagcaaagtatcgagcaagaaggaaggagatgactccgaggatttgaagttttggatggataagaatgggttgccaccttgcaaggttattctcaaggagagaccagctcatggatcagaagcataaacctatacattatgttgcttctagtgaggatcttcagaagggtgatgtggcgttttcagttcctgattctctggtggtcactctggaaagagttttgggaaacgagactattgctgaactgttgacgacgaacaaattatccgaactggcttgtctagctttgtatttgatgtatgagaagaaacaaggaaagaaatcagtatggtatccctatataagagaacttgatcgtcaaagaggaagaggtcagttagatgcggaatcccctttgctgtggtcagaggctgagttagattacctaactggtagtcctaccaaggccgaagttcttgagagggctgaagggatcaaaagagaatacaatgagcttgacactgtctggttcatggctggatctttgtttcagcaatacccatttgacataccaactgaagctttttcatttgagattttcaaacaggcatttgttgccattcagtcatgtgtggtgcatttacaaaatgtcggtttggctcgtcggtttgctttggttcctcttggtcctcccttgttggcctattgttccaactgcaaggcaatgcttactgctgttgatggtgctgttgaactcgtggtagataggccatataaggccggggatcctatagttgtctggtgtgggccacaaccaaatgcgaaattgcttctgaactatggatttgttgatgaggataacccttatgatagagtaatagttgaggcagcgttgaacactgaggatcctcaataccaggacaagagaatggttgctcaaaggaacggaaaattatcccaacaagtatttcaggttcgtgtgggaaaagaaagagaagctgttcaagacatgcttccctacctgcggttgggttacatgtctgatccttctgaaatgcagtcagtaatttcatcccaaggtccagtttgtccgatgagcccttgtatggaaagagcagtactagatcagcttgctaattacttcatgagacggttatctggctaccctactactccgaaagaagatgatgcattgttggcagatcctagtttgagtcctaggaagcgagttgcaacccggcttgtccaactggagaagaaaatactagttgcatgccttacgacaacagttgatcttttaaatcagttgcccgatacagccatctctccatgcccagcaccatatgctccttccttgaaataaaaaggttcgtgttgtagctgcaatttgtgggacatggcaggagtaatttttggtcgtgtccttgatcattacaatctgaggtcgcttaactacggtagataagggtgtactaggagcgttatctgccgcttgacacgcaaatgtttcagcatatgattgtcctttttttcttacaacaatgaagccttaagtcgcattgttcaaagtgtacatacatgaatgaaccttcttgttcttccccaactccctctgtaatgttttatctctgttttagaaatttagaatc

SEQ ID NO: 2198 - protein, 425 aa, Arabidopsis thaliana
  misc_feature (1)..(425): useful for making plants with increased tolerance to oxidative stress as described in USSN 12/445,005
  misc_feature (1)..(425): Ceres CLONE ID no.24159
  misc_feature (1)..(425): Score of 1010.8 for HMM of FIGURE 8 of USSN 12/445,005.
  misc_feature (26)..(247): Pfam Name: SET Pfam Description: SET domain
  misc_feature (270)..(394): Pfam Name: Rubis-subs-bind Pfam Description: Rubisco LSMT substrate-binding
  misc_feature (1)..(425): Functional Homolog Of Ceres SEEDLINE ID no. ME00922
MGCHLARLFSRRDQLMDQKHKPIHYVASSEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAALNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 2199 - DNA, 1572 bp, Populus balsamifera subsp. trichocarpa
  misc_feature (1)..(1572): useful for making plants with increased tolerance to oxidative stress as described in USSN 12/445,005
  misc_feature (1)..(1572): Ceres ANNOT ID no.1482610
atggaattcacttgtttacacaacaaatgcatttcaccttctcttactgttctctctagggtttcaatttcattttccaatcttcctaaacgcgccgtttcatttcaccggcggcggagaaatttgtgctttgcaacattagtcgatgggaaacgtactagtgaagttgtgagcaaaagaggaggagaagaagaagacgaatttggggatttgaagtcttggatgcataaaaatggattgcctccttgcaaagttgtgcttaaagaaagaccttctcatgacaagaaacttcgacctattcattatgttgctgctagcgaggatcttcaggccagtgatgtggcggtttcggtgcccaattcgcttgttgttacactcgagagggttttgggaaatgagactcttgatagtgaaacccctcagcatgctataagtgaaaccatgataaatgtcagtgtgactaatttagcggaactcttaaccacaaacaaattatcggaattggcatgcttggccttatacctgatgtatgagaagaagcaaggaaagaagtcattctggtatccatatataagggagcttgatcgtcagcgaggtaggggtcagctggctgtggaatctccacttttatggtctgaggctgaattggcttacctgactggtagcccaactaaggctgaagttcttgacagggcagatggaattaaaagagaatatgaggagctagacactgtttggttcatggctggttctctgtttcagcaatatccatatgatatacctactgaagcctttccctttgagatttttaaacaagcttttgtagccattcaatcctgtgtggtgcatttacagaaagtcagtttggctcgaagatttgctttggttcctcttggaccacctttgctagcatacagtagcaactgcaaggcaatgttaactgctgttgatggtgctgttgaattagtggttgatcgaccatacaaggctggggagcccattgttgtatggtgtgggccacagccaaattcaaaattgcttttaaactatggctttgttgatgaagataatccttatgaccgaatagcagttgaggcagcactgaacactgaggaccctcagtatcaggacaagagaatggttgctcaaagaaatgggaaattgtcagtgcaagtttttcaagtatacgctggaaaggaaaaagaagccgtgtcagatattcttccttatttgcgattgggatatgtatcagatccttctgaaatgcaatctgtaatttcttctcaaggtccagtttgtccagtaagcccttgtatggaacaagcagtgttagatcagcttactgtttattttagaacgcgccttgctggctattgtaccagcataagtgaagatgagttgatgttggcagatcctaacttgaaccccaagaagcgagtggctactcagcttgttagattggaaaagaaaatgctgaaggcatgcttgcaggctacagttgatttgataaaccagttacctgatcacaccatgcctccatgcccagctccttatgcccctttattgaaatga

SEQ ID NO: 2200 - protein, 523 aa, Populus balsamifera subsp. trichocarpa
  misc_feature (1)..(523): useful for making plants with increased tolerance to oxidative stress as described in USSN 12/445,005
  misc_feature (1)..(523): Ceres ANNOT ID no.1482610
  misc_feature (1)..(523): Score of 1242.8 for HMM of FIGURE 8 of USSN 12/445,005.
  misc_feature (170)..(345): Pfam Name: SET Pfam Description: SET domain
  misc_feature (368)..(492): Pfam Name: Rubis-subs-bind Pfam Description: Rubisco LSMT substrate-binding
  misc_feature (1)..(523): Functional Homolog Of Ceres SEEDLINE ID no. ME00922
MEFTCLHNKCISPSLTVLSRVSISFSNLPKRAVSFHRRRRNLCFATLVDGKRTSEVVSKRGGEEEDEFGDLKSWMHKNGLPPCKVVLKERPSHDKKLRPIHYVAASEDLQASDVAVSVPNSLVVTLERVLGNETLDSETPQHAISETMINVSVTNLAELLTTNKLSELACLALYLMYEKKQGKKSFWYPYIRELDRQRGRGQLAVESPLLWSEAELAYLTGSPTKAEVLDRADGIKREYEELDTVWFMAGSLFQQYPYDIPTEAFPFEIFKQAFVAIQSCVVHLQKVSLARRFALVPLGPPLLAYSSNCKAMLTAVDGAVELVVDRPYKAGEPIVVWCGPQPNSKLLLNYGFVDEDNPYDRIAVEAALNTEDPQYQDKRMVAQRNGKLSVQVFQVYAGKEKEAVSDILPYLRLGYVSDPSEMQSVISSQGPVCPVSPCMEQAVLDQLTVYFRTRLAGYCTSISEDELMLADPNLNPKKRVATQLVRLEKKMLKACLQATVDLINQLPDHTMPPCPAPYAPLLK

SEQ ID NO: 2201 - protein, 501 aa, Medicago truncatula
  misc_feature (1)..(501): useful for making plants with increased tolerance to oxidative stress as described in USSN 12/445,005
  misc_feature (1)..(501): Public GI ID no.92872502
  misc_feature (1)..(501): Score of 1167.9 for HMM of FIGURE 8 of USSN 12/445,005.
  misc_feature (346)..(470): Pfam Name: Rubis-subs-bind Pfam Description: Rubisco LSMT substrate-binding
  misc_feature (68)..(323): Pfam Name: SET Pfam Description: SET domain
  misc_feature (1)..(501): Functional Homolog Of Ceres SEEDLINE ID no. ME00922
MELSHLSLSENHFFFSTPTSPSSLSHRLPSFLSLSTNHRRRRRSFCSASNSDTLVAATGKKKRDEDDGDLKTWMHKNGLPPCKVVLKDKPSLDDSVKPIHYVAASEDLQKGDIAFSVPNSLVVTLERVLGNETIAELLTTNKFSELACLALYLMYEKKQGKKSFWYPYIRELDRQRGRGQLAVESPLLWSESELAYLEGSPLKDEIVKRIEGIRKEYNELDTVWFMSGSLFQQYPYDLPTEAFPFEIFKQAFAAVQSCVVHLQNVSLARRFALVPLGPPLLAYCSNCKAMLTAVDGAVQLVVDRPYKAGDPIVVWCGPQPNTKLLTNYGFVDEDNSNDRLIVEVALSTEDPQYQDKRIVAQRNGKLSIQTFYVYTGKEREAVSDMIPYMRLGYVSDPSEMQSVISSQGPVCPVSPCMERAVLDQLADYFNTRLAAYPTTLAEDESMLTDGSLNPKRRVATQLVRLEKKMLHACLQAIMDLISQLPDHSVSPCPAPYAPSLK

SEQ ID NO: 2202 - protein, 509 aa, Oryza sativa subsp. japonica; identical to SEQ ID NO: 2189
  misc_feature (1)..(509): useful for making plants with increased tolerance to oxidative stress as described in USSN 12/445,005
  misc_feature (1)..(509): Public GI ID no.115487958
  misc_feature (1)..(509): Score of 1284.4 for HMM of FIGURE 8 of USSN 12/445,005.
  misc_feature (114)..(331): Pfam Name: SET Pfam Description: SET domain
  misc_feature (354)..(478): Pfam Name: Rubis-subs-bind Pfam Description: Rubisco LSMT substrate-binding
  misc_feature (1)..(509): Functional Homolog Of Ceres SEEDLINE ID no. ME00922

SEQ ID NO: 2203 - protein, 505 aa, Oryza sativa subsp. indica
  misc_feature (1)..(505): useful for making plants with increased tolerance to oxidative stress as described in USSN 12/445,005
  misc_feature (1)..(505): Public GI ID no.125536207
  misc_feature (1)..(505): Score of 1263.4 for HMM of FIGURE 8 of USSN 12/445,005.
  misc_feature (110)..(327): Pfam Name: SET Pfam Description: SET domain
  misc_feature (350)..(474): Pfam Name: Rubis-subs-bind Pfam Description: Rubisco LSMT substrate-binding
  misc_feature (1)..(505): Functional Homolog Of Ceres SEEDLINE ID no. ME00922
MASSASVSPAAASHLPCSPRRLPRPRPRLRPRLLRSARPRLVACHADTLLPSSSPAAAAAACASTASANGFSDWLREHGLPPGKVAILDRPVPCFREGKDLPLHYVAAGQDLEAGDVAFEVPMSLVVTLERVLGDESVAELLTTNKLSELACLALYLMYEKKQGQDSFWYPYIKELDRQRGRGQLAVESPLLWTESELNYLKGSPIKDEVVARDEGIRREYNELDTLWFMAGSLFQQYPFDIPTEAFPFEIFKQAFVAVQSCVVHLQKVSLARRFALVPLGPPLLTYKSNCKAMLTAVGDSVRLVVDRPYKAGEPIIVWCGPQPNSRLLLNYGFIDEDNPYDRIVIEASLNIEDPQFQEKRMVAQRNGKLAIQNFHVCVGKEKETIAEMLPYLRLGYISDPDEMQSILSSEGDTCPVSPCTERAVLDQLVGYLESRLADYPTTLDEDDAMLADGNLEPKKEVATRLVRLEKKLLHGCLQAANEFINDLPDHTVSPCPAPFAPELK

SEQ ID NO: 2204 - protein, 536 aa, Oryza sativa subsp. japonica
  misc_feature (1)..(536): useful for making plants with increased tolerance to oxidative stress as described in USSN 12/445,005
  misc_feature (1)..(536): Public GI ID no.125578929
  misc_feature (1)..(536): Score of 1091.8 for HMM of FIGURE 8 of USSN 12/445,005.
  misc_feature (143)..(358): Pfam Name: SET Pfam Description: SET domain
  misc_feature (381)..(505): Pfam Name: Rubis-subs-bind Pfam Description: Rubisco LSMT substrate-binding
  misc_feature (1)..(536): Functional Homolog Of Ceres SEEDLINE ID no. ME00922
MASSASVSPAAASHHRLLLPCSPRRLTRPRPRPRPAPPPLRPPPPRRLPRRHPPPLLVPRRRRRRVRLHRLRQRVLRLAAGARAAAGEGGHPRPTRPLLPGGQGPAAALRRRGAGSRGALASGDFGVDSGGKWCEIFDCGGLLQAGDVAFEVPMSLVVTLERVLGDESVAELLTTNKLSELACLALYLMYEKKQGQDSFWYPYIKELDRQRGRGQLAVESPLLWTESELNYLKGSPIKDEVVARDEGIRREYNELDTLWFMAGSLFQQYPFDIPTEAFPFEIFKQAFVAVQSCVVHLQKVSLARRFALVPLGPPLLTYKSNCKAMLTAVGDSVRLVVDRPYKAGEPIIVWCGPQPNSRLLLNYGFIDEDNPYDRIVIEASLNIEDPQFQEKRMVAQRNGKLAIQNFHVCVGKEKETIAEMLPYLRLGYISDPDEMQSILSSEGDTCPVSPCTERAVLDQLVGYLESRLADYPTTLDEDDAMLADGNLEPKKEVATRLVRLEKKLLHGCLQAANEFINDLPDHTVSPCPAPFAPELK

SEQ ID NO: 2205 - DNA, 1323 bp, Arabidopsis thaliana
  misc_feature (1)..(1323): useful for making plants with increased tolerance to oxidative stress as described in USSN 12/445,005
  misc_feature (1)..(1323): Ceres CLONE ID no.26560
aggaaagaaatcagtatggtatccctatataagagaacttgatcgtcaaagaggaagaggtcagttagatgcggaatcccctttgctgtggtcataggctgagttagattacctaactggtagtcctaccaaggccgaagttcttgagagggctgaagggatcaaaagagaatacaatgagcttgacactgtctggttcatggctggatctttgtttcagcaatacccatttgacataccaactgaagctttttcatttgagattttcaaacaggcatttgttgccattcagtcatgtgtgatgcatttacaaaatgtcggtttggctcgtcggtttgctttggttcctcttggtcctcccttgttggcctattgttccaactgcaaggcaatgcttactgctgttgatggtgctgttgaactcgtggtagataggccatataaggccggggatcctatagttgtctggtgtgggccacaaccaaatgcgaaattgcttctgaactatggatttgttgatgaggataacccttatgatagagtaatagttgaggcagcgttgaacactgaggatcctcaataccaggacaagagaatggttgctcaaaggaacggaaaattatcccaacaagtatttcaggttcgtgtgggaaaagaaagagaagctgttcaagacatgcttccctacctgcggttgggttacatgtctgatccttctgaaatgcagtcagtaatttcatcccaaggtccagtttgtccgatgagcccttgtatggaaagagcagtactagatcagcttgctaattacttcatgagacggttatctggctaccctactactccgaaagaagatgatgcattgttggcagatcctagtttgagtcctaggaagcgagttgcaacccggcttgtccaactggagaagaaaatactagttgcatgccttacgacagttgatcttttaaatcagttgcccgatacagccatctctccatgcccagcaccatatgctccttccttgaaataaaaaggttcgtgttgtagctgcaatttgtgggacatggcaggagtaatttttggtcgtgtccttgatcattacaatctgaggtcgcttaactacggtagataagggtgtactaggagcgttatctgccgcttgacacgcaaatgtttcagcatatgattgtcctttttttcttacaacaatgaagccttaagtcgcattgttcaaagtgtacatacatgaatgaaccttcttgttcttccccaactccctctgtaatgttttatctctgttttagaaatttagaatttatcatttcc

SEQ ID NO: 2206 - protein, 275 aa, Arabidopsis thaliana
  misc_feature (1)..(275): useful for making plants with increased tolerance to oxidative stress as described in USSN 12/445,005
  misc_feature (1)..(275): Ceres CLONE ID no.26560
  misc_feature (1)..(275): Ceres SEEDLINE ID no. ME22365
  misc_feature (1)..(275): Score of 434.2 for HMM of FIGURE 8 of USSN 12/445,005.
  misc_feature (1)..(98): Pfam Name: SET Pfam Description: SET domain
  misc_feature (121)..(245): Pfam Name: Rubis-subs-bind Pfam Description: Rubisco LSMT substrate-binding
  misc_feature (1)..(275): Functional Homolog Of Ceres SEEDLINE ID no. ME00922
MAGSLFQQYPFDIPTEAFSFEIFKQAFVAIQSCVMHLQNVGLARRFALVPLGPPLLAYCSNCKAMLTAVDGAVELVVDRPYKAGDPIVVWCGPQPNAKLLLNYGFVDEDNPYDRVIVEAALNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTVDLLNQLPDTAISPCPAPYAPSLK

SEQ ID NO: 2207 - DNA, 1266 bp, Glycine max
  misc_feature (1)..(1266): useful for making plants with increased tolerance to oxidative stress as described in USSN 12/445,005
  misc_feature (1)..(1266): Ceres CLONE ID no.463156
  misc_feature (368)..(368): y is t/u or c
  misc_feature (369)..(369): y is t/u or c
  misc_feature (371)..(371): y is t/u or c
aaggatgaagttattcaaagggaagaagcaataagaaaagagtataatgaacttgacacagtctggtttatggcaggttctctatttcagcaatatccatatgacattcctactgaggccttttcatttgagattttcaaacaagcctttgctgctattcagtcttgtgtggtgcatttacagaaagttagtttagctcggagatttgctttagttcccctgggacctcctttactgtcctaccaaagcaactgcaaggcaatgctaactgctgttgatggcgctgttgagcttgcagttgatcgcccgtataaagccggggacccaattgttgtgtggtgtggccctcaacctaactcaaagttgcyyayaaactatggttttgttgatgaaaataattccaatgatcgtcttatagttgaggcagctttaaatactgaagatccacaatatcaagataaaagaatggtggctcaaagaaatggaaagttatcagttcaagtttttcatgtatatgctgggaaggaaagggaagctgtcttagatatgcttcgttatatgcgtttgggctatgtttcagatccttctgagatggaatctgtcatctcctctcaaggtccagtttgtcctgtaagcccttgtatggaacgggctgcgttggatcagttggctgattatttcaaggcacggctggctggctaccctacaacattggctgaagatgaatctatgctgacagatgataatctgaatccaaagaagcgagttgctacccaatatgttaggctggaaaagaaaatgctccatgcctgtttgcaggcaaccaccgacttcattaaccagcttccagaccacactatatctccatgccccgctccctatgcacctttattgaaatgaaaggaactggaaatgtatgtagtctgaactgtacaaatatggatttgatgaaccaggtcaattacaaatgcatatagttgaatcacggctcattgaacaatgatgcaagagttccggatttaaaaggttatgggtctgcctttccccctgaagataaaatctcaatccgagtgttttctgcatgcccccttcaggtaggcgtgtcgcttcattccctaggtaggacttaggaggaaaggaaccatcatttgagcaaatttttgtgtcttactgtaattgtaccgacgattcgaaatttgagtgttggaatgatactcaactttgtaaatggaaacctgaatcccaaatcctaattcaattgtgcat

SEQ ID NO: 2208 - protein, 276 aa, Glycine max
  misc_feature (1)..(276): useful for making plants with increased tolerance to oxidative stress as described in USSN 12/445,005
  misc_feature (1)..(276): Ceres CLONE ID no.463156
  misc_feature (1)..(276): Score of 446.3 for HMM of FIGURE 8 of USSN 12/445,005.
  misc_feature (1)..(98): Pfam Name: SET Pfam Description: SET domain
  misc_feature (121)..(245): Pfam Name: Rubis-subs-bind Pfam Description: Rubisco LSMT substrate-binding
  misc_feature (1)..(276): Functional Homolog Of Ceres SEEDLINE ID no. ME00922
MAGSLFQQYPYDIPTEAFSFEIFKQAFAAIQSCVVHLQKVSLARRFALVPLGPPLLSYQSNCKAMLTAVDGAVELAVDRPYKAGDPIVVWCGPQPNSKLPTNYGFVDENNSNDRLIVEAALNTEDPQYQDKRMVAQRNGKLSVQVFHVYAGKEREAVLDMLRYMRLGYVSDPSEMESVISSQGPVCPVSPCMERAALDQLADYFKARLAGYPTTLAEDESMLTDDNLNPKKRVATQYVRLEKKMLHACLQATTDFINQLPDHTISPCPAPYAPLLK

SEQ ID NO: 2209 - DNA, 1276 bp, Panicum virgatum
  misc_feature (1)..(1276): useful for making plants with increased tolerance to oxidative stress as described in USSN 12/445,005
  misc_feature (1)..(1276): Ceres CLONE ID no.1998672
aaaacctcctccgccgccgctgcagcgctccaccgccaccgcccctcccaaccgtcgcctcgccattccccgcctgaatccctaacgcccatggcctccgtttcccccgccgccgctgcagccgccgtctccggccccccaccacgcccgcctcctcctcccctcctcgcttcgccgcctcccgcggccccgcccgcgccctcgtccgcgtctccgcctcgccgcctgccacgcggatacgctgctcccctcctcctcctcatcggaggcccgcgcgcggccggcccccgcggtggggccctccgccgaatctgccacagactgtttcgtcgactggctgcgcgcgcgcgggctgcccccgggcaaagtggatatccgggagcggccggtgccctgcctgcgcgagggcggggaccgcccgttgcgctacatcgctgccggcgatgccctccaggttagagccgtagggcgtgggttttggattccggcagtaatgacgcgatcatgacctggatttggttggctccgtcgtttgttgtgcaggcgggggatgtggcgttcgaggtgcccatgtcactcgtcgtcacgctggagcgggttctcggggacgaatcagtagctgagttgttgacaaacaacaagttatctgagttggcatgcttggctttatatctcatgtatgagaaaaagcaaggaaaggattcatattggtacccctacattaaggagctcgaccgacaccgaggaaggggacaactagctgtggaatcaccacttttatggactgaaagtgaacttgattacctgactggaagcccattaaaggatgaagttgttgctagagatgaggcggtaaggagagagtataatgagcttgacacagtgtggttcatggcaggttcactgtttcagcaatacccttttgatatacctactgaggcttttccgtttgagatattcaaacaagcttttgttgcagtacagtcttgtgtggttcatctgcagaaagttagtttagctcgaagattcacactagttcctttggggccaccactattgacctacaagagcaactgcaaagcgatgttgacagctgatggtgattctgttcggttggtggtggatcggccatataaagctggagaaccaataatcgtctggtgtggaccacaaacaaactccaggctggttctgaactatggttttgttgatgaagacaatccctttgatcgcatatcaattgaggcatcgttaaatacagaagatcctcattacc

SEQ ID NO: 2210 - protein, 257 aa, Panicum virgatum
  misc_feature (1)..(257): useful for making plants with increased tolerance to oxidative stress as described in USSN 12/445,005
  misc_feature (1)..(257): Ceres CLONE ID no.1998672
  misc_feature (1)..(257): Score of 314.9 for HMM of FIGURE 8 of USSN 12/445,005.
  misc_feature (12)..(227): Pfam Name: SET Pfam Description: SET domain
  misc_feature (1)..(257): Functional Homolog Of Ceres SEEDLINE ID no. ME00922
MTWIWLAPSFVVQAGDVAFEVPMSLVVTLERVLGDESVAELLTNNKLSELACLALYLMYEKKQGKDSYWYPYIKELDRHRGRGQLAVESPLLWTESELDYLTGSPLKDEVVARDEAVRREYNELDTVWFMAGSLFQQYPFDIPTEAFPFEIFKQAFVAVQSCVVHLQKVSLARRFTLVPLGPPLLTYKSNCKAMLTADGDSVRLVVDRPYKAGEPIIVWCGPQTNSRLVLNYGFVDEDNPFDRISIEASLNTEDPHY

SEQ ID NO: 2211 - protein, 199 aa, Zea mays
  misc_feature (1)..(199): useful for making plants with increased tolerance to oxidative stress as described in USSN 12/445,005
  misc_feature (1)..(199): Public PUBLICCLONE ID no.100926461
  misc_feature (1)..(199): Score of 116.8 for HMM of FIGURE 8 of USSN 12/445,005.
  misc_feature (13)..(144): Pfam Name: SET Pfam Description: SET domain
  misc_feature (1)..(199): Functional Homolog Of Ceres SEEDLINE ID no. ME00922
MSLVVTLERVLGDESIAELLTNNKLSELACLALYLMYEKKQGKDSFWYPYIKELDRHRGRGQLAVESPLLWTESELDYLTGSPLKDEVVARDEAIRREYNELDTLWFMAGSLFQQYPFDIPTEAFPFEIFKQAFVAVQSCVVHLQKVSLARRFALVPLGPPLLTYRSNCKAMLTADGDSVRLGVDRPYKAGEPIIIWCG

SEQ ID NO: 2212 - protein, 282 aa, Arabidopsis thaliana
  misc_feature (1)..(282): useful for making plants with increased tolerance to oxidative stress as described in USSN 12/445,005
  misc_feature (1)..(282): Ceres SEEDLINE ID no. ME02077
  misc_feature (1)..(282): Expected Sequence
  misc_feature (1)..(282): Score of 643.8 for HMM of FIGURE 3 of USSN 12/445,005.
  misc_feature (135)..(187): Pfam Name: AP2 Pfam Description: AP2 domain
  misc_feature (1)..(282): Functional Homolog Of Ceres SEEDLINE ID no. ME02077
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 2213 - DNA, 747 bp, Gossypium hirsutum
  misc_feature (1)..(747): useful for making plants with increased tolerance to oxidative stress as described in USSN 12/445,005
  misc_feature (1)..(747): Ceres CLONE ID no.1935323
aacgaacttccaaatcttctcttcttcaatttcgaatttccagtccacaaaattcaaatccttagcttttccttttccttttttttttgaaaaaatttcaaattttttattatggaagcaagcagtgaagtaacaagtgcgcttcaatatatcaagcaatatttactcggtgagttttctccagtgggattagggagtgtttcaagtgaaaatcagtggttacctcagtcgaaacctcgagtttcgagctctggatctgaatctcatttgagctccgattcgtcttttacagtatcaaattttaattgcctcgacgatgatgatgatttctttcaattccctaccgatttccctggattccaatttgaatcaaaacctcaaattatcgatctgacgacacctaaatccctctcatcaaacgccggtgctttcgaatttgaagtcaaacctcagatcgctcaaatttcaacgacgaaacataaagtttcttcgaattcgagctctcagaatcggaaacggtcgctgaaaatctcgttgccgcataaaatggagcagattcagttcggtaaaacggatttagctcaggcggagccgaaagtctcaaattccgaagacaagaagcattatagaggagtccgacaaaggccgtgggggaagttcgcggccgaaatccgagatccgacccgacgagggtctaggatgtggctaggaaccttcgaaacgggcatcgaagccgcgaaggcttac

SEQ ID NO: 2214 - protein, 212 aa, Gossypium hirsutum
  misc_feature (1)..(212): useful for making plants with increased tolerance to oxidative stress as described in USSN 12/445,005
  misc_feature (1)..(212): Ceres CLONE ID no.1935323
  misc_feature (1)..(212): Score of 77.7 for HMM of FIGURE 3 of USSN 12/445,005.
  misc_feature (170)..(212): Pfam Name: AP2 Pfam Description: AP2 domain
  misc_feature (1)..(212): Functional Homolog Of Ceres SEEDLINE ID no. ME02077
MEASSEVTSALQYIKQYLLGEFSPVGLGSVSSENQWLPQSKPRVSSSGSESHLSSDSSFTVSNFNCLDDDDDFFQFPTDFPGFQFESKPQIIDLTTPKSLSSNAGAFEFEVKPQIAQISTTKHKVSSNSSSQNRKRSLKISLPHKMEQIQFGKTDLAQAEPKVSNSEDKKHYRGVRQRPWGKFAAEIRDPTRRGSRMWLGTFETGIEAAKAY

SEQ ID NO: 2215 - protein, 237 aa, Nicotiana tabacum
  misc_feature (1)..(237): useful for making plants with increased tolerance to oxidative stress as described in USSN 12/445,005
  misc_feature (1)..(237): Public GI ID no.12003376
  misc_feature (1)..(237): Score of 126.9 for HMM of FIGURE 3 of USSN 12/445,005.
  misc_feature (134)..(186): Pfam Name: AP2 Pfam Description: AP2 domain
  misc_feature (1)..(237): Functional Homolog Of Ceres SEEDLINE ID no. ME02077
MTESSSSQSESASSDSLPFDFLSDSFDFEADFFQFGDEVSNSSSESANSVHNSTNFIMLELEPTISSSDYEKPQVIIDLTSPKLSNVSDRKPSLKIDLPPVKKFEWIGFCNSTTQSNSIVSVTMQQKRKTEEKRHYRGVRQRPWGKYAAEIRDPTRRGARVWLGTFNTAVEAAKAYDRAAFKMRGSKAILNFPLEVGKNLSYSSSAVDGGVKRRKESDACGEEKGVKKVERCKEEES

SEQ ID NO: 2216 - protein, 250 aa, Arabidopsis thaliana
  misc_feature (1)..(250): useful for making plants with increased tolerance to oxidative stress as described in USSN 12/445,005
  misc_feature (1)..(250): Public GI ID no.8843855
  misc_feature (1)..(250): Score of 124.5 for HMM of FIGURE 3 of USSN 12/445,005.
  misc_feature (70)..(122): Pfam Name: AP2 Pfam Description: AP2 domain
  misc_feature (1)..(250): Functional Homolog Of Ceres SEEDLINE ID no. ME02077
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQITINVQPKEIQNVQDAQIEEKTNAPPELRLPDVLDAKVVTCSRHTTWQDYVDYFKSPNQRKQPERNTEDESVLIAF

SEQ ID NO: 2217 - DNA, 850 bp, Gossypium hirsutum
  misc_feature (1)..(850): useful for making plants with increased tolerance to oxidative stress as described in USSN 12/445,005
  misc_feature (1)..(850): Ceres CLONE ID no.1850283
attaattcttgaaaaagttttcaaggaaatgaccagcgttgaagaatcaacgacactcgagttcattcatcagcacctccttggagacttcacttcggctgatgcttttataagtagccttgattttggcctctctcaactacaaaattaccaggttcccgaactgtatcaacctcactctcccgtatctgacccgaattgccgaatccctgaaatcttcggctatgacgtaaaacctgaggttgttgagctggcatctccgagtgtgttcatttcagggtcgaaaatggagcagaaggtgttggtttgtgaagagaggaggcattacagaggggtgcggagaaggccatggggaaagtttgctgcagagatccgagacccgaccaggaagggacgtcgggtttggctaggtactttcgataccgatgttgatgctgccaaggcttatgattgtgcagcatttaaaatgagggggcagaaagcaatactgaatttcccactggaagctggacaggctactccaccagccacaacttgtaggaaaaggggaaaagagaagagaaataagtcgccggaaagtgacgtcatgtcacaagttagtagtgagctagcttcggcggtggtgaaggaagaagaggataagccttattgatggtcagaatatcacctgtcaccattataattagaagaagataacatgatagataatgtgaattcggtaagctgttaaaagggaggcatttaaatcacgcaccatcaaaaaatgtatatttagaagtctaattattgagttgctttgcaagttcagttggaatttgatcagtgattacaaaaaaaaaaaaaaaaaaaa

SEQ ID NO: 2218 - protein, 207 aa, Gossypium hirsutum
  misc_feature (1)..(207): useful for making plants with increased tolerance to oxidative stress as described in USSN 12/445,005
  misc_feature (1)..(207): Ceres CLONE ID no.1850283
  misc_feature (1)..(207): Score of 98.2 for HMM of FIGURE 3 of USSN 12/445,005.
  misc_feature (98)..(150): Pfam Name: AP2 Pfam Description: AP2 domain
  misc_feature (1)..(207): Functional Homolog Of Ceres SEEDLINE ID no. ME02077
MTSVEESTTLEFIHQHLLGDFTSADAFISSLDFGLSQLQNYQVPELYQPHSPVSDPNCRIPEIFGYDVKPEVVELASPSVFISGSKMEQKVLVCEERRHYRGVRRRPWGKFAAEIRDPTRKGRRVWLGTFDTDVDAAKAYDCAAFKMRGQKAILNFPLEAGQATPPATTCRKRGKEKRNKSPESDVMSQVSSELASAVVKEEEDKPY

SEQ ID NO: 2219 - protein, 208 aa, Arabis drummondii
  misc_feature (1)..(208): useful for making plants with increased tolerance to oxidative stress as described in USSN 12/445,005
  misc_feature (1)..(208): Public GI ID no.34013890
  misc_feature (1)..(208): Score of 59.2 for HMM of FIGURE 3 of USSN 12/445,005.
  misc_feature (109)..(161): Pfam Name: AP2 Pfam Description: AP2 domain
  misc_feature (1)..(208): Functional Homolog Of Ceres SEEDLINE ID no. ME02077
MATIEESSDLEAIQKHLFEDLMVSDGFMGDFDFDASFVSELWCIEPQVPKQEPDSPVFDPDSFVNEFLQVEAKSSPELNSSSSTYETDLSVKKAERFEEEEEEEEEEARHYRGVRRRPWGKFAAEIRDPAKKGSRIWLGTFESDVDAARAYDCAAFKLRGRKAVLNFPLEAGKYEAPANSGRKRKRSDVKEELQRTQSNSSSSSCDAF

SEQ ID NO: 2220 - DNA, 550 bp, Zea mays
  misc_feature (1)..(550): useful for making plants with increased tolerance to oxidative stress as described in USSN 12/445,005
  misc_feature (1)..(550): Ceres CLONE ID no.1428135
aacacaatcaaaaccataaaccaacgactccaagtctctcatatatggcatcttcacaagaccaatcagctttggacctcatcactcaacacctccttaccgatttcccttccttagagactttcgtctctagcatccatcagagcaccacctccactcttagccaacgcaagccatctcttgccaccatttcagttcctactactgcaccggtggttcaagaggatgatcataggcattacaggggcgtgaggcgtaggccgtggggtaagtatgcggctgagatcagagacccaaacaagaaaggcgttcgtgtctggttaggtacttttgacacggccgtggaggctgcaagaggttacgacagggctgcttttaaactaagaggaagcaaagccattcttaacttcccactagaagcaggcaagcaccaggactctggagacaacaagaacaagaagactgtggctttgaaagctaagaggaagagaccagaaacagaggatgaaaaccatgagagaaacctgatcagtcataaagctgtgaaaag

SEQ ID NO: 2221 - protein, 168 aa, Zea mays
  misc_feature (1)..(168): useful for making plants with increased tolerance to oxidative stress as described in USSN 12/445,005
  misc_feature (1)..(168): Ceres CLONE ID no.1428135
  misc_feature (1)..(168): Score of 93.5 for HMM of FIGURE 3 of USSN 12/445,005.
  misc_feature (64)..(116): Pfam Name: AP2 Pfam Description: AP2 domain
  misc_feature (1)..(168): Functional Homolog Of Ceres SEEDLINE ID no. ME02077
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHQDSGDNKNKKTVALKAKRKRPETEDENHERNLISHKAVK

SEQ ID NO: 2222 - DNA, 568 bp, Parthenium argentatum
  misc_feature (1)..(568): useful for making plants with increased tolerance to oxidative stress as described in USSN 12/445,005
  misc_feature (1)..(568): Ceres CLONE ID no.1605871
actcaaaacaattccttcaattcaataataatcaacccatctcttttattccttccttcactcacatggcgtcacctcatgaatcttcagcaccaatagacttcatccgccatcacttacttatcgacgaccttgttttctccgataataattcacccacttcttcttattcctcttcctcctctgttttcgatgaacagtttcactttaacccaatacctgaaccagtcatctgttcaaacacaagctttcacgaacgaaaaccctctctaaacatatccattccctttcctccaccggtgttgcagaaacccacgacggaggaacggcggcgttacagaggagttcgacaacggccgtggggaaagtttgcagcggagattcgagacccaaacaagaaagggtctagggtttggttagggacgtttgaaacagccgtagaggcagcaaaagcgtacgataaggcggcgtttaagcttcgtggtcgtaaagcgatattaaactttccgttagaagtcggaagtttaaatgagacggtggtggtgaagggtaatgggcgtaagaggat

SEQ ID NO: 2223 - protein, 167 aa, Parthenium argentatum
  misc_feature (1)..(167): useful for making plants with increased tolerance to oxidative stress as described in USSN 12/445,005
  misc_feature (1)..(167): Ceres CLONE ID no.1605871
  misc_feature (1)..(167): Score of 121.0 for HMM of FIGURE 3 of USSN 12/445,005.
  misc_feature (89)..(141): Pfam Name: AP2 Pfam Description: AP2 domain
  misc_feature (1)..(167): Functional Homolog Of Ceres SEEDLINE ID no. ME02077
MASPHESSAPIDFIRHHLLIDDLVFSDNNSPTSSYSSSSSVFDEQFHFNPIPEPVICSNTSFHERKPSLNISIPFPPPVLQKPTTEERRRYRGVRQRPWGKFAAEIRDPNKKGSRVWLGTFETAVEAAKAYDKAAFKLRGRKAILNFPLEVGSLNETVVVKGNGRKR

SEQ ID NO: 2224 - protein, 207 aa, Arabidopsis pumila
  misc_feature (1)..(207): useful for making plants with increased tolerance to oxidative stress as described in USSN 12/445,005
  misc_feature (1)..(207): Public GI ID no.38260669
  misc_feature (1)..(207): Score of 63.1 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077
MATFEDGSDLEAIQKHLFEDLLVCDGFMGDFDFDASFVSGLWCIEPQVPKQEPDSPVLDPDSFVNEFLQVEAESSPSSPELNTSPLSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2225 - protein, 207 aa, Arabidopsis arenosa
  misc_feature (1)..(207): useful for making plants with increased tolerance to oxidative stress as described in USSN 12/445,005
  misc_feature (1)..(207): Public GI ID no.38260631
  misc_feature (1)..(207): Score of 63.0 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077
MASFEESSDLEAIQSHLFEDLLACDGFMGDFDFDASFVSGLWCIESQVPKQEPDSPVLDPDSFVNEFLQVEGESSSSSSPELNSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2226 - protein, 207 aa, Arabidopsis arenosa
  misc_feature (1)..(207): useful for making plants with increased tolerance to oxidative stress as described in USSN 12/445,005
  misc_feature (1)..(207): Public GI ID no.38260685
  misc_feature (1)..(207): Score of 65.4 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077
MASFQESSDLEAIQSHLFEDLLVCDGFMGDFDFDASFVSGLWCIEPQVPKQEPDSPVLDPDSFVNEFLQVEGESSSSSPELNSSSSSTYETDQSVKKAERFEEEEEARHYRGVRRRPWGKFAAEIRDPAKKGSRIWLGTFESDVDAARAYDCAAFKLRGRKAVLNFPLDAGKYEAPANSGRKRKRSDVQEELQRTQSNSSSSSCDAF

SEQ ID NO: 2227 - protein, 345 aa, Oryza sativa
  misc_feature (1)..(345): useful for making plants with increased tolerance to oxidative stress as described in USSN 12/445,005
  misc_feature (1)..(345): Public GI ID no.14140143
  misc_feature (1)..(345): Score of 103.1 for HMM of FIGURE 3 of USSN 12/445,005.
  misc_feature (153)..(205): Pfam Name: AP2 Pfam Description: AP2 domain
  misc_feature (1)..(345): Functional Homolog Of Ceres SEEDLINE ID no. ME02077
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQAAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGSELFVPPMPSSWSWDQLEGFFGILSPLSPHPQMGFPEVAVN

SEQ ID NO: 2228 - protein, 344 aa, Oryza sativa subsp. japonica
  misc_feature (1)..(344): useful for making plants with increased tolerance to oxidative stress as described in USSN 12/445,005
  misc_feature (1)..(344): Public GI ID no.115447673
  misc_feature (1)..(344): Score of 96.1 for HMM of FIGURE 3 of USSN 12/445,005.
  misc_feature (153)..(205): Pfam Name: AP2 Pfam Description: AP2 domain
  misc_feature (1)..(344): Functional Homolog Of Ceres SEEDLINE ID no. ME02077
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQTAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGELFVPPMPSSWSWDQLEGFFGILSPLSPHPQMGFPEVAVN

SEQ ID NO: 2229 - protein, 345 aa, Oryza sativa subsp. indica
  misc_feature (1)..(345): useful for making plants with increased tolerance to oxidative stress as described in USSN 12/445,005
  misc_feature (1)..(345): Public GI ID no.125540543
  misc_feature (1)..(345): Score of 102.6 for HMM of FIGURE 3 of USSN 12/445,005.
  misc_feature (153)..(205): Pfam Name: AP2 Pfam Description: AP2 domain
  misc_feature (1)..(345): Functional Homolog Of Ceres SEEDLINE ID no. ME02077
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQAAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGGELFVPPMPSSWSWDQLEGFFGILSPLSPHPQMGFPEVAVN

SEQ ID NO: 2230 - protein, 204 aa, Capsella rubella
  misc_feature (1)..(204): useful for making plants with increased tolerance to oxidative stress as described in USSN 12/445,005
  misc_feature (1)..(204): Public GI ID no.38260649
  misc_feature (1)..(204): Score of 53.9 for HMM of FIGURE 3 of USSN 12/445,005.
  misc_feature (105)..(157): Pfam Name: AP2 Pfam Description: AP2 domain
  misc_feature (1)..(204): Functional Homolog Of Ceres SEEDLINE ID no. ME02077
MATIEESSDLEAMQKHLFEDFLVSDGFLGDFDFDASFVSGLWCIEPQVPKQEPDSPVLDPDSFVNEFLQVEAKSSPELNTSSSSTYETDQCVKKAERFEEEVETRHYRGVRRRPWGKFAAEIRDPAKKGSRIWLGTFESDVDAARAYDCAAFKLRGRKAVLNFPLDAGKYEAPANSGRKRKRSDAQEELQRTHSNSSSSSCDAF

SEQ ID NO: 2231 - protein, 218 aa, Sisymbrium irio
  misc_feature (1)..(218): useful for making plants with increased tolerance to oxidative stress as described in USSN 12/445,005
  misc_feature (1)..(218): Public GI ID no.38260618
  misc_feature (1)..(218): Score of 57.3 for HMM of FIGURE 3 of USSN 12/445,005.
  misc_feature (115)..(167): Pfam Name: AP2 Pfam Description: AP2 domain
  misc_feature (1)..(218): Functional Homolog Of Ceres SEEDLINE ID no. ME02077
MAAFEESTDLDAIQGHLFEDFMVSDGFMGDFDFNASFVSGLWCIEPVMNQVPKQEPDSPVLDPDSFVKEFLQVEAESSTSTGTTELNSSSQETDQSISTRKKSKRFEEQEEEEPRHYRGVRRRPWGKFAAEIRDPAKKGSRIWLGTFESDVDAARAYDCAAFKLRGRKAVLNFPLDAGKYEAPANSGRKRKRSDVQGELQRSQSNSSSSSSDGETTCE

SEQ ID NO: 2232 - protein, 206 aa, Brassica oleracea
  misc_feature (1)..(206): useful for making plants with increased tolerance to oxidative stress as described in USSN 12/445,005
  misc_feature (1)..(206): Public GI ID no.38196019
  misc_feature (1)..(206): Score of 59.7 for HMM of FIGURE 3 of USSN 12/445,005.
  misc_feature (108)..(160): Pfam Name: AP2 Pfam Description: AP2 domain
  misc_feature (1)..(206): Functional Homolog Of Ceres SEEDLINE ID no. ME02077
MAAFEESSDLDAIQEHLLEDFLVADGFMGDFDFNASFVSGLWCIEPVMNQVPKQEPDSPVLDPDSFVREFLQVEAESSSEQNSSPHETDQSVSPRKEAKRLEEEEEPRHYRGVRRRPWGKFAAEIRDPAKKGSRIWLGTFESNVDAARAYDCAAFKLRGRKAVLNFPLDAGKYEAPVNLGRKRKRSDVQEELQRSQSNSSSSSSDL

SEQ ID NO: 2233 - DNA, 1094 bp, Glycine max
  misc_feature (1)..(1094): useful for making plants with increased tolerance to oxidative stress as described in USSN 12/445,005
  misc_feature (1)..(1094): Ceres CLONE ID no.540272
aaaaatatctagttggaaggtttccccggagtctaaggttagagcacatgctagaacacaagattgcatttacatcataaagatgacctcttaattgactacagcaatttgagccaagactttcatgctgtggtgtggacctttgcccttgacagacaggcatatataaatatccaccttagctactaaccatttttaaaatccaatataatccacctcacaacaatattgtttcatcactcagatcccttaaagatgacaacagcagaagaaacttcaaacttggatctcatacgccaacacctattaggggaaaatatcatctcagactcctcctttttctccaatctccttcatcatcctatgaaacttgaagcaccctcatcaccagaatttgatttcacctcatatatctcagacaacacaagctttttcactttccttgaaggctatgatttgatggcagacatgaaatttgttgattcagacaacaccatcccttcaaaggaggttaagaaatgcaatatttctcctgaaccattggtgtcatcaaaagagaagccaaagaagttagaatacgataaggcaaagcgttataggggagttagaagaaggccttggggaaaatttgctgctgaaatccgtgaccctacaaggaaagggacaagggtttggcttggaacctttgacagtgaaattgatgcagctaaggcctatgattgtgctgctttcaagatgagggggcagaaggctattctgaacttccctcttgaggctggactgtctgatcctaagcctaacagttgtggcaggaaaaggagaagagagagccatgatcatgaattggagctgccacaagtccaagttcatcatggtgtttcctgagaaaaagtgagaagatataataatagatttagttgttttgtgagtagcattaagtttgttgcctagaaaaataaggttgctttgccttttagtttgtacgtagaagcaaggctaatgtgaaatgtctatatgaatctatgcaaaaagcatgttacgaaagttttactaactttgaggagttttaaaaaaatattaatcaattcttgttt

SEQ ID NO: 2234 - protein, 209 aa, Glycine max
  misc_feature (1)..(209): useful for making plants with increased tolerance to oxidative stress as described in USSN 12/445,005
  misc_feature (1)..(209): Ceres CLONE ID no.540272
  misc_feature (1)..(209): Score of 69.0 for HMM of FIGURE 3 of USSN 12/445,005.
  misc_feature (112)..(164): Pfam Name: AP2 Pfam Description: AP2 domain
  misc_feature (1)..(209): Functional Homolog Of Ceres SEEDLINE ID no. ME02077
MTTAEETSNLDLIRQHLLGENIISDSSFFSNLLHHPMKLEAPSSPEFDFTSYISDNTSFFTFLEGYDLMADMKFVDSDNTIPSKEVKKCNISPEPLVSSKEKPKKLEYDKAKRYRGVRRRPWGKFAAEIRDPTRKGTRVWLGTFDSEIDAAKAYDCAAFKMRGQKAILNFPLEAGLSDPKPNSCGRKRRRESHDHELELPQVQVHHGVS

SEQ ID NO: 2235 - protein, 207 aa, Arabidopsis thaliana
  misc_feature (1)..(207): useful for making plants with increased tolerance to oxidative stress as described in USSN 12/445,005
  misc_feature (1)..(207): Public GI ID no.7576196
  misc_feature (1)..(207): Score of 63.5 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 2236 - protein, 207 aa, Arabidopsis thaliana; identical to SEQ ID NO: 2235
  misc_feature (1)..(207): useful for making plants with increased tolerance to oxidative stress as described in USSN 12/445,005
  misc_feature (1)..(207): Public GI ID no.79508406
  misc_feature (1)..(207): Score of 63.5 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077

SEQ ID NO: 2237 - protein, 318 aa, Oryza sativa subsp. japonica; identical to SEQ ID NO: 2172
  misc_feature (1)..(318): useful for making plants with increased tolerance to oxidative stress as described in USSN 12/445,005
  misc_feature (1)..(318): Public GI ID no.32490143
  misc_feature (1)..(318): Score of 134.6 for HMM of FIGURE 3 of USSN 12/445,005.
  misc_feature (138)..(190): Pfam Name: AP2 Pfam Description: AP2 domain
  misc_feature (1)..(318): Functional Homolog Of Ceres SEEDLINE ID no. ME02077

SEQ ID NO: 2238 - DNA, 781 bp, Arabidopsis thaliana
  misc_feature (1)..(781): useful for making plants with increased tolerance to oxidative stress as described in USSN 12/445,005
  misc_feature (1)..(781): Ceres CLONE ID no.1335966
atcatcacttgcagattctttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccgtattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttc

SEQ ID NO: 2239 - protein, 207 aa, Arabidopsis thaliana
  misc_feature (1)..(207): useful for making plants with increased tolerance to oxidative stress as described in USSN 12/445,005
  misc_feature (1)..(207): Ceres CLONE ID no.1335966
  misc_feature (1)..(207): Score of 59.3 for HMM of FIGURE 3 of USSN 12/445,005.
  misc_feature (108)..(160): Pfam Name: AP2 Pfam Description: AP2 domain
  misc_feature (1)..(207): Functional Homolog Of Ceres SEEDLINE ID no. ME02077
MASFEESSDLEAIQSHLLEDLLVCDGFMGDFDFDASFVSGLWCIEPHVPKQEPDSPVLDPYSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 2240 - DNA, 1056 bp, Zea mays
  misc_feature (1)..(1056): useful for making plants with increased tolerance to oxidative stress as described in USSN 12/445,005
  misc_feature (1)..(1056): Ceres CLONE ID no.998737
accgcagctctcaagcgagatcgaggcagtgcgcacgccgtgcaggcctctcctccactcaaccgcgcgtcatggccatgttgcgcgagcatctcgacctcatccgcgctcacctcctcgacgacaaccacgacgccgtcagctccgatgactcggcgccgtcccactcgccatcgccatccccatcgccgccggggcgtaggccgctgccagcgctttccgtctcgctgcccccgaggccggcagtcgtcctgcagcagcagcacatgagggcggcggcgccgccgttgcagattcctcagcaggagcagcactgctgcccggaacccgaggaggacgatttccggcggtaccgcggcgtgcggcagcggccgtggggcaagtacgcggccgagattcgggacccgtcgcggaagggcgcgcgcgtgtggctgggcacctatgacaccgccgtggaggccgctcgtgcctacgaccgcgccgcgttccgcctgcgcgggtccaaggccatcctcaacttccccaacgaggtcgcgttaagcaccgctgcatggtgggcgacgcctgctcctcctcctcagcccagcgcgaccgtggccggtaacaagagggcgaggtcgccgcaggagcaggacgctaggtgcatggttagggaggtgaagaaggagcggattcaggagcccgcaagcggaggggcggactacttctgggaggatgagtcgctgaagggggcgatctgcagcctgccgccgctctcaccgttgtcgccgcacccgcacctggccgtgccgcagctctacgtcagctgactgcctgacttgatgtcgtagcaagacagggacggtggtcttactcttacctgatgatagtcttctgagttctttgatatgctagaggagtatagctccaaatattctttcgttctttatttattcgttcagtcgcaagcaagcaaacgtgtcctggcgtagcatgactgcatgagaatactataatggacaatttttaaatataatatataataaataaaagataatttatatagtaacatgattg

SEQ ID NO: 2241 - protein, 245 aa, Zea mays
  misc_feature (1)..(245): useful for making plants with increased tolerance to oxidative stress as described in USSN 12/445,005
  misc_feature (1)..(245): Ceres CLONE ID no.998737
  misc_feature (1)..(245): Score of 124.9 for HMM of FIGURE 3 of USSN 12/445,005.
  misc_feature (92)..(144): Pfam Name: AP2 Pfam Description: AP2 domain
  misc_feature (1)..(245): Functional Homolog Of Ceres SEEDLINE ID no. ME02077
MAMLREHLDLIRAHLLDDNHDAVSSDDSAPSHSPSPSPSPPGRRPLPALSVSLPPRPAVVLQQQHMRAAAPPLQIPQQEQHCCPEPEEDDFRRYRGVRQRPWGKYAAEIRDPSRKGARVWLGTYDTAVEAARAYDRAAFRLRGSKAILNFPNEVALSTAAWWATPAPPPQPSATVAGNKRARSPQEQDARCMVREVKKERIQEPASGGADYFWEDESLKGAICSLPPLSPLSPHPHLAVPQLYVS

SEQ ID NO: 2242 - protein, 329 aa, Zea mays
  misc_feature (1)..(329): useful for making plants with increased tolerance to oxidative stress as described in USSN 12/445,005
  misc_feature (1)..(329): Public PUBLICCLONE ID no.100936085
  misc_feature (1)..(329): Score of 116.9 for HMM of FIGURE 3 of USSN 12/445,005.
  misc_feature (142)..(194): Pfam Name: AP2 Pfam Description: AP2 domain
  misc_feature (1)..(329): Functional Homolog Of Ceres SEEDLINE ID no. ME02077
  misc_feature (210)..(210): Xaa is any aa, unknown or other
MDFSGEIDDFSLQLIREQLLGGEASLPIVTNAAAYSASVVHHPTQAEFHQPAAFLPQPSHVAYVDLTNEYAADATVASAGGEAAFRAEPVMIRFGGEPSPVSDPSRRPLLTISLPPASHAWGPAAVPLEAPGAAALDANDFRKYRGVRQRPWGKFAAEIRDPKKRGSRVWLGTYDTAIEAARAYDRAAFRMRGAKAILNFPNEVGTRGAXFLAPPPPPPQAAATSQNKRKLMHDAEATAPAGAGAGAEPAKSVKAEASGSPASSLFPATTTTPASTVTTCFPSSDAGAGPEMFPVTPSSWTWEQLEGVFGILSPLSPHPQLGFPEVTVN

SEQ ID NO: 2243 - DNA, 660 bp, Populus balsamifera subsp. trichocarpa
  misc_feature (1)..(660): useful for making plants with increased tolerance to oxidative stress as described in USSN 12/445,005
  misc_feature (1)..(660): Ceres ANNOT ID no.1537977
atggcaaccccggaagaatcctcaacattagaactcataagacaacatcttcttggagacttcatctccacagacgagtttatcagtaatcttgagtccagtatagccagtgtctctgtcaaactagagagctccctttctgggtcagaacccaactccccaatatccgaccaaagttaccatagtaccccagaaacctatagctttgaaataaaacctgaaatcatagacttcacacctcctgagcccgtgttttcagataaaggagaaacagtaaggcattacaggggggtccgaagaaggccatggggcaagtttgcagcagagatccgtgaccctacccggaagggaagtcgggtttggttgggtacttttgacagtgatactgatgctgcaaaagcttatgactgtgctgcattcaaaatgaggggcaggaaagcaatcctgaattttccttcggaggctggactatccatcccgccgccagccacaggcaggaagagaagaagatcgaagggagaagaggtgctgccggaatctgttgatgtgtcaacggaaaattggaatttaaagtggagtggagaagtagaggagggtgtttcagatgaggagcaactgtcaccgttaacccaagaaaccatgttggcaaggctttcttaa

SEQ ID NO: 2244 - protein, 219 aa, Populus balsamifera subsp. trichocarpa
  misc_feature (1)..(219): useful for making plants with increased tolerance to oxidative stress as described in USSN 12/445,005
  misc_feature (1)..(219): Ceres ANNOT ID no.1537977
  misc_feature (1)..(219): Score of 126.7 for HMM of FIGURE 3 of USSN 12/445,005.
  misc_feature (93)..(145): Pfam Name: AP2 Pfam Description: AP2 domain
  misc_feature (1)..(219): Functional Homolog Of Ceres SEEDLINE ID no. ME02077
MATPEESSTLELIRQHLLGDFISTDEFISNLESSIASVSVKLESSLSGSEPNSPISDQSYHSTPETYSFEIKPEIIDFTPPEPVFSDKGETVRHYRGVRRRPWGKFAAEIRDPTRKGSRVWLGTFDSDTDAAKAYDCAAFKMRGRKAILNFPSEAGLSIPPPATGRKRRRSKGEEVLPESVDVSTENWNLKWSGEVEEGVSDEEQLSPLTQETMLARLS

SEQ ID NO: 2245 - protein, 328 aa, Oryza sativa subsp. japonica
  misc_feature (1)..(328): useful for making plants with increased tolerance to oxidative stress as described in USSN 12/445,005
  misc_feature (1)..(328): Public GI ID no.115459750
  misc_feature (1)..(328): Score of 113.4 for HMM of FIGURE 3 of USSN 12/445,005.
  misc_feature (137)..(189): Pfam Name: AP2 Pfam Description: AP2 domain
  misc_feature (1)..(328): Functional Homolog Of Ceres SEEDLINE ID no. ME02077
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGAELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 2246 - protein, 328 aa, Oryza sativa subsp. indica
  misc_feature (1)..(328): useful for making plants with increased tolerance to oxidative stress as described in USSN 12/445,005
  misc_feature (1)..(328): Public GI ID no.125549239
  misc_feature (1)..(328): Score of 113.6 for HMM of FIGURE 3 of USSN 12/445,005.
  misc_feature (137)..(189): Pfam Name: AP2 Pfam Description: AP2 domain
  misc_feature (1)..(328): Functional Homolog Of Ceres SEEDLINE ID no. ME02077
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGTELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 2247 - protein, 318 aa, Oryza sativa subsp. indica
  misc_feature (1)..(318): useful for making plants with increased tolerance to oxidative stress as described in USSN 12/445,005
  misc_feature (1)..(318): Public GI ID no.125549238
  misc_feature (1)..(318): Score of 130.6 for HMM of FIGURE 3 of USSN 12/445,005.
  misc_feature (138)..(190): Pfam Name: AP2 Pfam Description: AP2 domain
  misc_feature (1)..(318): Functional Homolog Of Ceres SEEDLINE ID no. ME02077
MDFPGDAEDFALEFIREHLLGGDAPVLPPAAVPAAAAYPPTSTMFLPQQQRGYAGLTPQEYVVDSAPAADQAAFRDDQPDPAADVMIMFGGERFPAVKPSSSSSPSLTVTVPPSSFGSWAPAAVPAAAATAAAVEDFRKYRGVRQRPWGKFAAEIRDPKRRGSRVWLGTYDTPVEAARAYDRAAFRMRGAKAILNFPNEVGTRGAELWATPPPTNKRKRQPEDDTAAADDVEVIGVANKAVKTEAPTSAYSSSSLSSMSRDTTATTSSAGTSTGSSEPTSFPVVTPSSWSWDQYWDGLPPLSPLSPHPALGFPQLTVS

SEQ ID NO: 2248 - DNA, 1375 bp, Triticum aestivum
  misc_feature (1)..(1375): useful for making plants with increased tolerance to oxidative stress as described in USSN 12/445,005
  misc_feature (1)..(1375): Ceres CLONE ID no.927860
acagacccacagacaaacttaccactggcaccgagtagcacttctctaccgtgccgccatctctctttctttctcacgattctcatcgactgaaaggcgaaccgtaataagcaccatggagttcgccggagaagccgacgacttcgctctcgacctcatccgcgagcacctgctcggcggcgacggtggtgtcctggcgacggctaaccatgagcagggccctttttgcgacgacgtcaccttccccgtgctgccaccttccgcggccgaaccgcaagcgtaccagcagcccatgttcttcccgcagcaggggcagcggcaggaacagacgcaaggttacatgggcctgacgcaccagtacgtgaactcatatccggctgccacggcggtgttccgtgcgccggagccggtgatgatacagttcggcggccagccgtctcctgtgagggcgctgtcgtccacgctgaccatctcggtgccgccccagggcacgttcggatgggcggggactgctgccgccgcagcgccagcgccagcaccggtcgaggacctccgcaagtaccgcggcgtccggcagcgaccgtggggcaagtacgcggcggagatccgcgacccaaagcgccggggctaccgcgagtggctcggcacctacgacacctccgtggaggccgcgcgtgcctacgaccgtgccgccttccggatgcgcggcgccaaggccattcttaactttccaaacgaggtcggcacccgcggcgccgagctgtgggcgcggccgcctgctggcccggcgtcccaggcagcaggcgcgacgaacaaacgtaagagatcacagggcgaggacgctgacgtcgaggtgaccggagtggtcataaacaaggccgtgagggccgaggcgccgtcgccgtcgtcggcccgggtgtcgtgggacacgccctcgtccttgtcgcgggggacagcgtcttcgacggtgacgtcggtggccacgacgccggagggagagtttcctccgacgccgtcaagctcgggctgggagcagtgctgggaggcgctgatgggaggcatgccgttgctgtcgcccctgtcgccacacccggcgttgggtttcccgcagcttagtgttagttaattaaaggatggttcattaagcgatagaatgtttccggtgtttgtaagaaaaacagagtaggcacccacacacagcacttgttgaacactagatttataattgaacaaagttattacatgcgtcttgctatccatgaaaatgttgtcaagctagtgtttgatctctattacatcagtgcaacaaccactgtaataactattcacccgttgttgttcatcggtttaaattggacagtcggcttttcttcac

SEQ ID NO: 2249 - protein, 336 aa, Triticum aestivum
  misc_feature (1)..(336): useful for making plants with increased tolerance to oxidative stress as described in USSN 12/445,005
  misc_feature (1)..(336): Ceres CLONE ID no.927860
  misc_feature (1)..(336): Score of 97.5 for HMM of FIGURE 3 of USSN 12/445,005.
  misc_feature (147)..(199): Pfam Name: AP2 Pfam Description: AP2 domain
  misc_feature (1)..(336): Functional Homolog Of Ceres SEEDLINE ID no. ME02077
MEFAGEADDFALDLIREHLLGGDGGVLATANHEQGPFCDDVTFPVLPPSAAEPQAYQQPMFFPQQGQRQEQTQGYMGLTHQYVNSYPAATAVFRAPEPVMIQFGGQPSPVRALSSTLTISVPPQGTFGWAGTAAAAAPAPAPVEDLRKYRGVRQRPWGKYAAEIRDPKRRGYREWLGTYDTSVEAARAYDRAAFRMRGAKAILNFPNEVGTRGAELWARPPAGPASQAAGATNKRKRSQGEDADVEVTGVVINKAVRAEAPSPSSARVSWDTPSSLSRGTASSTVTSVATTPEGEFPPTPSSSGWEQCWEALMGGMPLLSPLSPHPALGFPQLSVS

SEQ ID NO: 2250 - DNA, 823 bp, Glycine max
  misc_feature (1)..(823): useful for making plants with increased tolerance to oxidative stress as described in USSN 12/445,005
  misc_feature (1)..(823): Ceres CLONE ID no.681477
tcaacctcctactccttccaaaaattcttaaggatggccacagcagaagaaatttcaactttgaaactgttgcgccaatatctcttgggggatatttcagacccttttctcaccaatctcattccagtaaaacttgaagacccctcatcaggacttgatatgggttcaaacttctcagaacaaagcagcttctgcaagtttctggagtgctttgattttgaagcagaagtggtaggtctcacttctcatcataaggtccaaagctccattgcaacaagtccaccccagaatttcaattttccagaagaaccaatggtgtcaatgaaaaaggaagcaacatgttatgcaacaaggcattacagaggagtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcataaagccgtgttgaatttccctctagaggctggaatgtctcatccagagcccaacagcagtggcaggaaaaggagaagagagtacacaacagctgccacaagttcaaggcatgttatgtcatgagaaataattcagtgtgggagaaccatgtttttcttttggcattttttgccagttacacaagttaaagcaaggttttatagttacactacagttgagcatgatgagatctgttatttaaatccttgagttatggttaagggtgaaattgaattaaacccaaaaaaaaaaaaaaaaaaaaaaaaaaaaaaaa

SEQ ID NO: 2251 - protein, 199 aa, Glycine max
  misc_feature (1)..(199): useful for making plants with increased tolerance to oxidative stress as described in USSN 12/445,005
  misc_feature (1)..(199): Ceres CLONE ID no.681477
  misc_feature (1)..(199): Score of 96.1 for HMM of FIGURE 3 of USSN 12/445,005.
  misc_feature (107)..(159): Pfam Name: AP2 Pfam Description: AP2 domain
  misc_feature (1)..(199): Functional Homolog Of Ceres SEEDLINE ID no. ME02077
MATAEEISTLKLLRQYLLGDISDPFLTNLIPVKLEDPSSGLDMGSNFSEQSSFCKFLECFDFEAEVVGLTSHHKVQSSIATSPPQNFNFPEEPMVSMKKEATCYATRHYRGVRRRPWGKFAAEIRDPKKKGSRVWLGTFDTEIDAAKAYDCAAFRMRGHKAVLNFPLEAGMSHPEPNSSGRKRRREYTTAATSSRHVMS

SEQ ID NO: 2252 - protein, 268 aa, Arabidopsis thaliana
  misc_feature (1)..(268): useful for making plants with increased tolerance to oxidative stress as described in USSN 12/445,005
  misc_feature (1)..(268): Public GI ID no.21264420
  misc_feature (1)..(268): Score of 52.0 for HMM of FIGURE 3 of USSN 12/445,005.
  misc_feature (146)..(198): Pfam Name: AP2 Pfam Description: AP2 domain
  misc_feature (1)..(268): Functional Homolog Of Ceres SEEDLINE ID no. ME02077
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 2253 - protein, 273 aa, Oryza sativa subsp. japonica
  misc_feature (1)..(273): useful for making plants with increased tolerance to oxidative stress as described in USSN 12/445,005
  misc_feature (1)..(273): Public GI ID no.115483452
  misc_feature (1)..(273): Score of 113.8 for HMM of FIGURE 3 of USSN 12/445,005.
  misc_feature (88)..(140): Pfam Name: AP2 Pfam Description: AP2 domain
  misc_feature (1)..(273): Functional Homolog Of Ceres SEEDLINE ID no. ME02077
MAGFGLDQHLDLIRAHLLEDAHHHVLAPSPSPSPPGTGRVRPAPVSLPPRPPLLWAAASAAPRQQEECFELGGGYAGEGEGEEEDDFRRYRGVRQRPWGKYAAEIRDPARKGARVWLGTYDTAVEAARAYDRAAFQLRGSKAILNFPNEVAADAAVKWAPPVAPIPAAAMSAGRGKRVRSEEQYYLREVKKERLIMAPPENSSSSSSSAAAAAGDIWDELKGICSLPPLSPLSPHPHMAFPQLFVIDLAFGQILNSFVLLLLRTRDFAFDYAI

SEQ ID NO: 2254 - protein, 282 aa, Mesembryanthemum crystallinum
  misc_feature (1)..(282): useful for making plants with increased tolerance to oxidative stress as described in USSN 12/445,005
  misc_feature (1)..(282): Public GI ID no.7528276
  misc_feature (1)..(282): Score of 52.4 for HMM of FIGURE 3 of USSN 12/445,005.
  misc_feature (136)..(188): Pfam Name: AP2 Pfam Description: AP2 domain
  misc_feature (1)..(282): Functional Homolog Of Ceres SEEDLINE ID no. ME02077
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 2255 - protein, 198 aa, Gossypium hirsutum
  misc_feature (1)..(198): useful for making plants with increased tolerance to oxidative stress as described in USSN 12/445,005
  misc_feature (1)..(198): Public GI ID no.37730469
  misc_feature (1)..(198): Score of 82.7 for HMM of FIGURE 3 of USSN 12/445,005.
  misc_feature (69)..(121): Pfam Name: AP2 Pfam Description: AP2 domain
  misc_feature (1)..(198): Functional Homolog Of Ceres SEEDLINE ID no. ME02077
MPATFEESTTLEFIRQHLLGDFATVDAFINTLDFGLSHLQPQSHQLPEIFTHGVEPAPITKEPFCEEKRHYRGVRRRPWGKFAAEIRDPNRKGIRVWLGTYDSDVDAAKAYDCAAFKMRGQKAILNFPLEAGEGSQPPAVTTGRKRRREKRVWLPESDITSPGSSEMAWEVKEEEGELDDDDRNGLSLLTRKRVIVTC

SEQ ID NO: 2256 - DNA, 1444 bp, Triticum aestivum
  misc_feature (1)..(1444): useful for making plants with increased tolerance to oxidative stress as described in USSN 12/445,005
  misc_feature (1)..(1444): Ceres CLONE ID no.907605
acgcagctggacttgcattcgcacacacgcctccaaatccaacacgagctcagctcagctctctgtctgtctccctctccctctctcggccgccgacctcagctctgctccgatcgatcaaaccatggacttcggcggcgacatggacgacttctcgctccagtacatccacgagcagctgcggctccagctgctcggcgccgacccctgcggcctcctgcccctccccgcggcggacgacttcgccgcgcagccggacttcatccctgccgagttcctgccgcagccgctgcccgccttcgtcgacctgacggcgaccgactacgccgacgcggcggcgtatcgcgccgccgcggagccggtcattatacggttcggcggcgaggcgtcccccgtgtcggaccccgcccggaggccgtcgctgaccatctcgctgcccccggcctcgcacgcctgggcgcaggcgccggtgctggcggcagaggccgcggcggccgtggacgccaacgacttccggaagtaccgcggcgtgcgccagcggccgtggggcaagttcgcggcggagatccgggaccccaacaagcgcggctcgcgcgtgtggctcggcacctacgacacctccatcgaggccgcgcgagcgtacgaccgcgccgccttccgcatgcgcggcgccaaggccatcctcaacttccccaacgaggtcggctcccgcggcgccaccgacttcgtcgccccgccgccgtcgcaaaccgcgcgcgcggcgccgacgtcgcacaacaagcggaagcggcaagaggcggccgagccatgcgtcgaggtggtccgggatgccacgaaacacagcaaggccgacgcgtccgcgtcgccagcgtcgtcgctcacctcaacgccgacctcgacggtgacgtccggcaccaccaccccatcctcgtcggatgccggcggctactacgagatgtcgttcccgctggcgtcaccgactagctggacgtgggatcagctgctggccgaagggatgttcggcagcctgtcgccgcgccagcagctgggtagcttcccggaggtcaccgtgaactgagactggcggaactaccgggccgccggtacggtcgacgccaggaactgtagagcctgtgaaaagagtaagctaagcatggtgattacttaggtgtaaattaagctgccaataattagtggctcctagttctcgacggcctacgctttggactcatcttgggagcttggcctggagctgtgcactgtgtacaggattacaggagtgaggacgatagaatattaccagcgcatgcatgtcacgggtgatcaacgtaagcatcgacgacataggtagatgttgatatatacttacactgcatagatatgtatgtaatgtaaattacgtgaagatcaaagtgtgggtgcttgtctaaaaaaaaaaaaaaaa

SEQ ID NO: 2257 - protein, 317 aa, Triticum aestivum
  misc_feature (1)..(317): useful for making plants with increased tolerance to oxidative stress as described in USSN 12/445,005
  misc_feature (1)..(317): Ceres CLONE ID no.907605
  misc_feature (1)..(317): Score of 102.2 for HMM of FIGURE 3 of USSN 12/445,005.
  misc_feature (131)..(183): Pfam Name: AP2 Pfam Description: AP2 domain
  misc_feature (1)..(317): Functional Homolog Of Ceres SEEDLINE ID no. ME02077
MDFGGDMDDFSLQYIHEQLRLQLLGADPCGLLPLPAADDFAAQPDFIPAEFLPQPLPAFVDLTATDYADAAAYRAAAEPVIIRFGGEASPVSDPARRPSLTISLPPASHAWAQAPVLAAEAAAAVDANDFRKYRGVRQRPWGKFAAEIRDPNKRGSRVWLGTYDTSIEAARAYDRAAFRMRGAKAILNFPNEVGSRGATDFVAPPPSQTARAAPTSHNKRKRQEAAEPCVEVVRDATKHSKADASASPASSLTSTPTSTVTSGTTTPSSSDAGGYYEMSFPLASPTSWTWDQLLAEGMFGSLSPRQQLGSFPEVTVN

SEQ ID NO: 2258 - DNA, 1251 bp, Glycine max
  misc_feature (1)..(1251): useful for making plants with increased tolerance to oxidative stress as described in USSN 12/445,005
  misc_feature (1)..(1251): Ceres CLONE ID no.582684
gaatattcaatacctcctcttccaaaatatccacgtttcttttcccacacactatcttaaatcttaaaaacattttttttttcaaagcaattagaatttagaccacaaaaggaacaccgaagagatgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtccgtgtccgcctccggcggctgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaaaagagggggagaaaaaaattcaaagaagttatggaatttggaagatgatgaggaatgacgggggtgaggaactgaggatatgtaatttggctttgtgaatactaccaaatttgttatttgtttgttcaaaaaaaaaaaaaaaa

SEQ ID NO: 2259 - protein, 255 aa, Glycine max
  misc_feature (1)..(255): useful for making plants with increased tolerance to oxidative stress as described in USSN 12/445,005
  misc_feature (1)..(255): Ceres CLONE ID no.582684
  misc_feature (1)..(255): Score of 53.3 for HMM of FIGURE 3 of USSN 12/445,005.
  misc_feature (136)..(188): Pfam Name: AP2 Pfam Description: AP2 domain
  misc_feature (1)..(255): Functional Homolog Of Ceres SEEDLINE ID no. ME02077
MYGQSSSSSSSYESDLALLDSIRHHLLGESESIFGAPNFGSGRSSSFSSLDSCLSDNWGELPFKEDDTEDMVLYGVLRDAVNVGWVPSLDAGSPESVSSGFPAVKLEPDLMPALISPCPPPAAAAEEKKVVPAKGKHYRGVRQRPWGKFAAEIRDPAKNGARVWLGTFETAEDAALAYDRAAYRMRGSRALLNFPLRVNSGEPDPVRVKSKRSSSPESAAALPAKRKKVVVVGTVQEQVGSQVAECTRGEQLLVS

SEQ ID NO: 2260 - protein, 201 aa, Solanum lycopersicum
  misc_feature (1)..(201): useful for making plants with increased tolerance to oxidative stress as described in USSN 12/445,005
  misc_feature (1)..(201): Public GI ID no.28274834
  misc_feature (1)..(201): Score of 58.7 for HMM of FIGURE 3 of USSN 12/445,005.
  misc_feature (117)..(169): Pfam Name: AP2 Pfam Description: AP2 domain
  misc_feature (1)..(201): Functional Homolog Of Ceres SEEDLINE ID no. ME02077
MTKQDEGLTLELIRQHLLEDFTTTESFIDSLNSCFSDHISSSDDISPVFTSVKTEPSTSNSLSDSPNSSYPNEPNSPISRYFNLRSDFPEFKIDSDTILSPVFDSSAGSNEDNNKKKNYRGVRRRPWGKFAAEIRDPSRKGSRIWLGTFDTDIDAARAYDCAAFKMRGRKAILNFPLDAGKSGAPANVGRKRRRENKMELV

SEQ ID NO: 2261 - DNA, 1754 bp, Gossypium hirsutum
  misc_feature (1)..(1754): useful for making plants with increased tolerance to oxidative stress as described in USSN 12/445,005
  misc_feature (1)..(1754): Ceres CLONE ID no.1926437
aaaagattcagactcctaacttctcacatttcttctcttttattctttaattcattcatttttttcctaaaaaaaaacaaaacaaaaccaaccccaaattcctcaatcaattactcaagatttaacaggtttcgttatggagatgcatccgagtagcaacgagaccgatttagcaatgttggactcaattcggcgacacttactcggggagtcatcagacttccgattcgatgcttccgttgattgtaccactaccacggctccccccgtgttttgcagaagctcaagcttcaaccgcttgtacccatgtttggctgaaacctggggtgaccttcctcttaaagaaaacgattctgaagatatgctcgtttttgagttcctccgagatgctttaaccgtaggctgggcgccctccgataactcttctatcaaatatacgccgattaaaccggagccgcaggagattttagttgaggctccagctgcgaatacggttgttcccgcggtggttccgaccaaagcgaggcattacagaggagttaggcaaaggccgtgggggaagttcgcagctgagataagggacccggctaaaaatggggctcgggtttggttaggtacttttgaaacagctgaggatgcggctttggcttatgataaagcagcttataggatgcgcgggtccaaggctttgttgaatttcccattgagggtgaattccggggagcctgacccagtgagggtaacgtcaaagagagcatcacccgagccgtccaatttttcatcatccggctcagagcaggggttaccgaaaaggaggagaaaggtggctccctcagctccggttgtgggtgaagcctggttagatatgagttcagcagctgcagttgagtatgaaattggatcacgtactaacagcaatcaactattaatcagctaatggattaatgaaagaagcagggaaaatgagggtctgaaatatttgtaaacttgtgttggctttgtgcatacaaagaaattgatattatttcatggttgtttcgctaaatgagaaaattttattctttaataaaaaatgatgtaagcaatatggttgaaaatggacattccaatgcagcaagatactgtaaaaacctagttttgatgtaggaagaagcatacaatcaaaatgtagatgtaggcgttggtatctcagccatttgaagatgacaaatccagaccagcttggcgttaggcctataataaaaggtagctgctcttctttctaacatgtgtttattttaccaatattctagaacatatggcgtcaagctgaaggaacaaggacgcacgtacacgaacgttgcgcggttagaaaaggacagttgacttttgggcaaagatggaatagctttatcctctatccaaacactaattgcttttttgaccttatacattcaaactgtttgacttttcagacttttcttccgacttctaaccaccaggattctttgttcacaatgagaaaaatgttttcacattgagtttggaaaggagatatgtttgagagtataggtgggtgggaatttgattggttgttgttttctattgattttctacaactacataattcatttggatttcataaaataactttttgacgtcaacagcttgcttatgggaaaggaatactcctacatgggatttaatttagatgaaatttgatcaaagctaaaataaacatttaaatgttgaagcaaaaaaaaaaaaaaaaaaaa

SEQ ID NO: 2262 - protein, 266 aa, Gossypium hirsutum
  misc_feature (1)..(266): useful for making plants with increased tolerance to oxidative stress as described in USSN 12/445,005
  misc_feature (1)..(266): Ceres CLONE ID no.1926437
  misc_feature (1)..(266): Score of 61.4 for HMM of FIGURE 3 of USSN 12/445,005.
  misc_feature (130)..(182): Pfam Name: AP2 Pfam Description: AP2 domain
  misc_feature (1)..(266): Functional Homolog Of Ceres SEEDLINE ID no. ME02077
MEMHPSSNETDLAMLDSIRRHLLGESSDFRFDASVDCTTTTAPPVFCRSSSFNRLYPCLAETWGDLPLKENDSEDMLVFEFLRDALTVGWAPSDNSSIKYTPIKPEPQEILVEAPAANTVVPAVVPTKARHYRGVRQRPWGKFAAEIRDPAKNGARVWLGTFETAEDAALAYDKAAYRMRGSKALLNFPLRVNSGEPDPVRVTSKRASPEPSNFSSSGSEQGLPKRRRKVAPSAPVVGEAWLDMSSAAAVEYEIGSRTNSNQLLIS

SEQ ID NO: 2263 - DNA, 804 bp, Populus balsamifera subsp. trichocarpa
  misc_feature (1)..(804): useful for making plants with increased tolerance to oxidative stress as described in USSN 12/445,005
  misc_feature (1)..(804): Ceres ANNOT ID no.1447726
atgaacgaggttacctcattgtgcgagtttagtactctgtctcatcatcgtcagcatagaagtccaagctttagttctctcatttcttgcctaaccgagacatggggtgacttgccattaagagtggatgattctgaagatatggtcatttacaattccctcagagatgctgttcgttttggatggtcaccgttagacctaacttcacccactgccaccactgcaacagcaacaataacaagaactacaagtgtcgttaaggccgagccgggatatgagccggagccggaagccgagcccatgaaactggttcaagaagctggattgaatgaagctgctgtttctaagaaggtggtggctaaggggagacattatagaggagtgaggcaaagaccctgggggaagtttgcggctgagattagggacccggctaagaatggtgcaagagtgtggcttgggacttacgagaccgcggaggaagcgggtttggcttatgatagggcggcttatagaatgcgtggctcgaaggctttgcttaattttccacataagattgggtctaatgagccggacccagttagggtcacgactaagcgtcgagagccggagacgggtttgccggctgtggatagtggctcggctaagacgaggagaatcttggtggctaatggagatgagctggaaagggagaggggatctaaggtgtttcaggttgcacaccatataatgccacttggtgagcagttattggtcaatgggttgcggtgttggtggaggtctgtagtgactctttgttgtgaatag

SEQ ID NO: 2264 - protein, 267 aa, Populus balsamifera subsp. trichocarpa
  misc_feature (1)..(267): useful for making plants with increased tolerance to oxidative stress as described in USSN 12/445,005
  misc_feature (1)..(267): Ceres ANNOT ID no.1447726
  misc_feature (1)..(267): Score of 47.7 for HMM of FIGURE 3 of USSN 12/445,005.
  misc_feature (123)..(175): Pfam Name: AP2 Pfam Description: AP2 domain
  misc_feature (1)..(267): Functional Homolog Of Ceres SEEDLINE ID no. ME02077
MNEVTSLCEFSTLSHHRQHRSPSFSSLISCLTETWGDLPLRVDDSEDMVIYNSLRDAVRFGWSPLDLTSPTATTATATITRTTSVVKAEPGYEPEPEAEPMKLVQEAGLNEAAVSKKVVAKGRHYRGVRQRPWGKFAAEIRDPAKNGARVWLGTYETAEEAGLAYDRAAYRMRGSKALLNFPHKIGSNEPDPVRVTTKRREPETGLPAVDSGSAKTRRILVANGDELERERGSKVFQVAHHIMPLGEQLLVNGLRCWWRSVVTLCCE

SEQ ID NO: 2265 - protein, 318 aa, Oryza sativa subsp. japonica
  misc_feature (1)..(318): useful for making plants with increased tolerance to oxidative stress as described in USSN 12/445,005
  misc_feature (1)..(318): Public GI ID no.115459748
  misc_feature (1)..(318): Score of 55.3 for HMM of FIGURE 3 of USSN 12/445,005.
  misc_feature (151)..(203): Pfam Name: AP2 Pfam Description: AP2 domain
  misc_feature (1)..(318): Functional Homolog Of Ceres SEEDLINE ID no. ME02077
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2266 - protein, 317 aa, Oryza sativa subsp. indica
  misc_feature (1)..(317): useful for making plants with increased tolerance to oxidative stress as described in USSN 12/445,005
  misc_feature (1)..(317): Public GI ID no.116310255
  misc_feature (1)..(317): Score of 55.3 for HMM of FIGURE 3 of USSN 12/445,005.
  misc_feature (150)..(202): Pfam Name: AP2 Pfam Description: AP2 domain
  misc_feature (1)..(317): Functional Homolog Of Ceres SEEDLINE ID no. ME02077
MARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2267 - protein, 319 aa, Oryza sativa subsp. indica
  misc_feature (1)..(319): useful for making plants with increased tolerance to oxidative stress as described in USSN 12/445,005
  misc_feature (1)..(319): Public GI ID no.125549236
  misc_feature (1)..(319): Score of 51.2 for HMM of FIGURE 3 of USSN 12/445,005.
  misc_feature (152)..(204): Pfam Name: AP2 Pfam Description: AP2 domain
  misc_feature (1)..(319): Functional Homolog Of Ceres SEEDLINE ID no. ME02077
MARSMLRNHPEASVLDTIRQHLLEEPRGGGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2268 - protein, 293 aa, Oryza sativa subsp. japonica
  misc_feature (1)..(293): useful for making plants with increased tolerance to oxidative stress as described in USSN 12/445,005
  misc_feature (1)..(293): Public GI ID no.125591182
  misc_feature (1)..(293): Score of 49.2 for HMM of FIGURE 3 of USSN 12/445,005.
  misc_feature (126)..(178): Pfam Name: AP2 Pfam Description: AP2 domain
  misc_feature (1)..(293): Functional Homolog Of Ceres SEEDLINE ID no. ME02077
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSGGRGGGGDGGAREGGGGAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2269 - DNA, 1028 bp, Gossypium hirsutum
  misc_feature (1)..(1028): useful for making plants with increased tolerance to oxidative stress as described in USSN 12/445,005
  misc_feature (1)..(1028): Ceres CLONE ID no.1848864
cgcgcccccttttaagaatttccagtccacaaaattcaaatccttagcttttccttttccttttttttttgaaaaaatttcaaattttttattatggaagcaagcagtgaagtaacaagtgcgcttcaatatatcaagcaatatttactcggtgagttttctccagtgggattagggagtgtttcaagtgaaaatcagtggttacctcagtcgaaacctcgagtttcgagctctggatctgaatctcatttgagctccgattcgtcttttacagtatcaaattttaattgcctcgacgatgatgattatttttttcaattccctaccgatttccctggattccaatttgaatcaaaacctcaaattatcgatctgacgacacctaaatccctctcatcaaacgccggtgctttcgaatttgaagtcaaacctcagatcgctcaaatttcaacgacgaaacataaagtttcttcgaattcgagctctcagaatcggaaacggtcgctgaaaatctcgttgccgcataaaatggagcagattcagttcggtaaaacggatttagctcaggcggagccgaaagtctcaaattccgaagacaagaagcattatagaggagtccgacaaaggccgtgggggaagttcgcggccgaaatccgtgatccgacccgacgaggttctaggatgtggctaggaaccttcgaaacggccatcgaagccgcgaaggcttacgaccgagcagctttcaagctacgtggctcgaaagcgatccttaatttccctctcgaagccgggacgtcggatacacgcgccgacgactgggagaggaagcggagcagagatgacggcgaaagagaagagaggcaagtaaaggtagtgaagagagaaaaggacgatgaggtgacaagaacgagagagaacggcgaagtacctttaacgccgtccaattggaacggctttttgggttggaataacgaccaaaaagggttttttaacgtgccgctactctcgccgttaagctttccccaagt

SEQ ID NO: 2270 - protein, 311 aa, Gossypium hirsutum
  misc_feature (1)..(311): useful for making plants with increased tolerance to oxidative stress as described in USSN 12/445,005
  misc_feature (1)..(311): Ceres CLONE ID no.1848864
  misc_feature (1)..(311): Score of 367.8 for HMM of FIGURE 3 of USSN 12/445,005.
  misc_feature (170)..(222): Pfam Name: AP2 Pfam Description: AP2 domain
  misc_feature (1)..(311): Functional Homolog Of Ceres SEEDLINE ID no. ME02077
MEASSEVTSALQYIKQYLLGEFSPVGLGSVSSENQWLPQSKPRVSSSGSESHLSSDSSFTVSNFNCLDDDDYFFQFPTDFPGFQFESKPQIIDLTTPKSLSSNAGAFEFEVKPQIAQISTTKHKVSSNSSSQNRKRSLKISLPHKMEQIQFGKTDLAQAEPKVSNSEDKKHYRGVRQRPWGKFAAEIRDPTRRGSRMWLGTFETAIEAAKAYDRAAFKLRGSKAILNFPLEAGTSDTRADDWERKRSRDDGEREERQVKVVKREKDDEVTRTRENGEVPLTPSNWNGFLGWNNDQKGFFNVPLLSPLSFPQ

SEQ ID NO: 2271 - DNA, 1268 bp, Gossypium hirsutum
  misc_feature (1)..(1268): useful for making plants with increased tolerance to oxidative stress as described in USSN 12/445,005
  misc_feature (1)..(1268): Ceres CLONE ID no.1807978
aacgaacttccaaatcttctcttcttcaatttcaaatttccaatccacaaaattcaaatccttagcttctttttgaaaaattttcaattttttttttattatggaagcaagcagtgaagtaataagtgcgcttcaatatatcaagcaatatttactcggtgagttttctccagtggaattagggagtgtttcaagtggaaatcaatggttgcctgagtcgaaacctcgagtttcgacccctggatctgagtctcttttgagctccgattcgtctctgacagtatcaaattttaattgccttgacgatgatgatgatttctttcaattctctaccgatttccctggattccaatttgaatcaaaacctcaaattatcgatctcacgacacctaaatccctctcattaaacgccggtgctttcgaatttgaagtcaaacctcagatcgctcaaatttcaacgacgaaacataaagtttcttcgaattcgagctctcagaatcggaaacggtcgctgaaaatctcgttgccgcataaaatggagcagattcagttcggtaaatcggatttagctcaggcagagccaagagtctcaaattccgaagacaagaagcattatagaggagtccgacaaaggccgtgggggaagttcgcagccgaaatccgagatccgacccgacgaggttctaggatgtggttaggaaccttcgaaacggccatcgaagccgcgaaggcttacgaccgaaccgctttcaagctacgtggctcgaaagcgatccttaatttccctctcgaagccgggacgtcggatacaagcgccgacgacctggagaggaagcggagcagagatgacggcgaaagggaagagaggcaagtaaaggcagtgaagagagaaaaggacgatgaggtgacaaaaacgagagagaacggcgaaggacctttaacgccgtcaaattggaagacctttttggattgggataacgaccaaaaagggtttttttaacgtgccgttactctcgccgttaagctttccccaagttgtggttatatgaccactattttgtcagttttttaattgagtgacgtggatattttattaaattcgttttttttttcctaaaaaagttgtatatatagatagtgttattttttcagtggataattcattttcaatttacctttaaaaaattaagtatattcatgtaaaatatttattttaaaatttatgaaaaagttaatcctttattttacaaaaaaaaaaaaaaaaaaaa

SEQ ID NO: 2272 - protein, 299 aa, Gossypium hirsutum
  misc_feature (1)..(299): useful for making plants with increased tolerance to oxidative stress as described in USSN 12/445,005
  misc_feature (1)..(299): Ceres CLONE ID no.1807978
  misc_feature (1)..(299): Score of 308.1 for HMM of FIGURE 3 of USSN 12/445,005.
  misc_feature (170)..(222): Pfam Name: AP2 Pfam Description: AP2 domain
  misc_feature (1)..(299): Functional Homolog Of Ceres SEEDLINE ID no. ME02077
MEASSEVISALQYIKQYLLGEFSPVELGSVSSGNQWLPESKPRVSTPGSESLLSSDSSLTVSNFNCLDDDDDFFQFSTDFPGFQFESKPQIIDLTTPKSLSLNAGAFEFEVKPQIAQISTTKHKVSSNSSSQNRKRSLKISLPHKMEQIQFGKSDLAQAEPRVSNSEDKKHYRGVRQRPWGKFAAEIRDPTRRGSRMWLGTFETAIEAAKAYDRTAFKLRGSKAILNFPLEAGTSDTSADDLERKRSRDDGEREERQVKAVKREKDDEVTKTRENGEGPLTPSNWKTFLDWDNDQKGFF

SEQ ID NO: 2273 - DNA, 1182 bp, Gossypium hirsutum
  misc_feature (1)..(1182): useful for making plants with increased tolerance to oxidative stress as described in USSN 12/445,005
  misc_feature (1)..(1182): Ceres CLONE ID no.1933466
aggcaaaaaacctgaaaatcctttcttaatttaaacccgcaacaacaatcatttgtttctttcctttttctgttctctaaaatttctcaaacttttttcaatttgttggttatggaaacaagcagtgaaatatcaaccgcgcttcaatatatccaacactatttacttgatgaactttctcctgtgggattggggaatttttccaatgaaaatcgatggataaatgaggtaaaagcggaagtttctacctctcaacctgaatctctttactcacaaacttcgagctctggttcctctctcacagaggctaactttaattgccttgaaaatgatgatctcttcaaattttctcccaatttccgtggattccagccaaacggaagtgatgttttcgaatacgagtcgaaacctcaaattatagatctcataacacctaagtccttcccatccaatgccagttccttagaatttgaaaccaaacctaaaatcactgaactttcaacggcaaagcctcaagtttcctcgggttgtaactctaagattcgaaagccgtcgctaaaaatctcgttaccccataaggtggagtggattcaatttgacaaaccggatttaactcggcccaaaccgaataaatcaaattctgaagacaataggcactatagaggagtccgacaaaggccgtgggggaaattcgcggcggagatccgagatccgacgcgaagaggttctaggatatggttagggacctttgacacagccatcgaagccgctaaggcttacgaccgagccgcttttaagctacgtggctcaaaagccatccttaatttccctctcgaagccgggaagctggagtcaggtgccagtgacggagagaggaaacggagcagagataacagcgaaggagaagaaaaacgggcaaaggtggtgaagagagaaagcgaaaacgtgacgaaagcgagagacaacggtgatgcgcctttgacgccgtcaaattggacagcgttttgggatttggacaatgaaattaaggagatttttaacgtgccactattatcaccgttagggttttctcatgttatggttgtatgatgatgctagtgtttgaaatggagagcagtgacgtggatattttatgaaagacgtggaattctttttgggttgcaaaaaaaaaaaaaaaaaaaa

SEQ ID NO: 2274 - protein, 325 aa, Gossypium hirsutum
  misc_feature (1)..(325): useful for making plants with increased tolerance to oxidative stress as described in USSN 12/445,005
  misc_feature (1)..(325): Ceres CLONE ID no.1933466
  misc_feature (1)..(325): Score of 368.4 for HMM of FIGURE 3 of USSN 12/445,005.
  misc_feature (181)..(233): Pfam Name: AP2 Pfam Description: AP2 domain
  misc_feature (1)..(325): Functional Homolog Of Ceres SEEDLINE ID no. ME02077
METSSEISTALQYIQHYLLDELSPVGLGNFSNENRWINEVKAEVSTSQPESLYSQTSSSGSSLTEANFNCLENDDLFKFSPNFRGFQPNGSDVFEYESKPQIIDLITPKSFPSNASSLEFETKPKITELSTAKPQVSSGCNSKIRKPSLKISLPHKVEWIQFDKPDLTRPKPNKSNSEDNRHYRGVRQRPWGKFAAEIRDPTRRGSRIWLGTFDTAIEAAKAYDRAAFKLRGSKAILNFPLEAGKLESGASDGERKRSRDNSEGEEKRAKVVKRESENVTKARDNGDAPLTPSNWTAFWDLDNEIKEIFNVPLLSPLGFSHVMVV

SEQ ID NO: 2275 - DNA, 1129 bp, Gossypium hirsutum
  misc_feature (1)..(1129): useful for making plants with increased tolerance to oxidative stress as described in USSN 12/445,005
  misc_feature (1)..(1129): Ceres CLONE ID no.1834552
aagaatctccaattcaaacccacaaacaaaaaaaatccttatcttctcattttctctcttgttttcagtttttggatatggaaagtagcagtgaagtgtcgagcaggcttcaatatattgaacaatatttacttgatgaaaatcaatttcctcctgtgggattgtggagcttttcaaatgaaaatcaatggacaaattatccgaaatccgaggtttccacctctcaatctcactctctttactctcaaacttccacctctgattcctgtcttacagcatccaattttaatagccttgacgaagatgatttcttcaacttctctaccaatttcccaggtttcgagtctaaccaaagtgatgttttcgaatttgactccaaacctcaatttatccatctcaccacgcctaagcctctcgcttccgacgccactgcttgtgaattccaagtgaaatctcgatcttcttcgaattcgactcccaattctcagagtcgaaaaccttcgctgaaaatctcgttgccgcataaagtggagtggattcagttcgggaaaccggatttaaccgaggtaaagccgaagaattcaaataccgaagagagaagtaagcattacagaggagtccgacaaaggccgtggggaaagttcgcagccgagatccgagatcctaaccgaaaaggttcacgggtctggttgggaacttttgacgccgccatagaagccgcaaaggcttacgaccgagccgcctttaagttacgtggctcaaaagcgattcttaacttccctctcgaagctgggaagttggatgtaatcgccgctgacggagagaggaaacggagcagagacgacggcgctggggatgagagagaagttaaagccgtgaagagagtaaatgatgatgtgactaaagcgagagataacggcgatgcgcctttaacgccgtcaaattggacatcatttttggattgcgataacgacacgaaggggttatttaacatgccattgttgtcgccgttaggcttgcaccaagttatagtcatctagcgacgataagtcgataatgtatataaattgtttttatttgttttttctttcaattcacttattgaataaatcgatccatggtttttttt

SEQ ID NO: 2276 - protein, 320 aa, Gossypium hirsutum
  misc_feature (1)..(320): useful for making plants with increased tolerance to oxidative stress as described in USSN 12/445,005
  misc_feature (1)..(320): Ceres CLONE ID no.1834552
  misc_feature (1)..(320): Score of 370.9 for HMM of FIGURE 3 of USSN 12/445,005.
  misc_feature (176)..(228): Pfam Name: AP2 Pfam Description: AP2 domain
  misc_feature (1)..(320): Functional Homolog Of Ceres SEEDLINE ID no. ME02077
MESSSEVSSRLQYIEQYLLDENQFPPVGLWSFSNENQWTNYPKSEVSTSQSHSLYSQTSTSDSCLTASNFNSLDEDDFFNFSTNFPGFESNQSDVFEFDSKPQFIHLTTPKPLASDATACEFQVKSRSSSNSTPNSQSRKPSLKISLPHKVEWIQFGKPDLTEVKPKNSNTEERSKHYRGVRQRPWGKFAAEIRDPNRKGSRVWLGTFDAAIEAAKAYDRAAFKLRGSKAILNFPLEAGKLDVIAADGERKRSRDDGAGDEREVKAVKRVNDDVTKARDNGDAPLTPSNWTSFLDCDNDTKGLFNMPLLSPLGLHQVIVI

SEQ ID NO: 2277 - DNA, 688 bp, Glycine max
  misc_feature (1)..(688): useful for making plants with increased tolerance to oxidative stress as described in USSN 12/445,005
  misc_feature (1)..(688): Ceres CLONE ID no.1614474
acaacacaaccctcttctctctttaccctcttaacgcaccaagcgaagcgaaaagcgctttctaacttaagtgatggcgaacgcagctgaagtttcagccttgaaccgcatcaaactgcatcttttgggtgaactctctccactggccactcccctaaactattttgatgaatcaaaccctagcccctctgaatcttccaattcccaatcttcttctgtttctcttaaccactacttcactgacctcttcgaattcgactccaaaccccaaataatcgacctccaaactcccaaaacactaacttcagctcagaagaaacctcaattgaatcggaaaccgtcgctgctaatcgctgttccaaagaagaccgagtggatccagttcgggagcccggatccgaacccggtgatggctgcgccggagaacctgccgcagaagaatcactacagaggtgtccggcagcggccctggggcaaattcgccgccgagatccgcgacccgaacaagcgcggctctagggtttggctcggaaccttcgacaccgccgtcgaagccgccaaggcctacgaccgagccgccttcagactccgcggctccaaggccatcctcaacttccccctcgaaagtagcgccgtggcggagaccgtctccgtcgccgccgcccgaagcaacgtcgagagaaagcgc

SEQ ID NO: 2278 - protein, 205 aa, Glycine max
  misc_feature (1)..(205): useful for making plants with increased tolerance to oxidative stress as described in USSN 12/445,005
  misc_feature (1)..(205): Ceres CLONE ID no.1614474
  misc_feature (1)..(205): Score of 255.2 for HMM of FIGURE 3 of USSN 12/445,005.
  misc_feature (123)..(175): Pfam Name: AP2 Pfam Description: AP2 domain
  misc_feature (1)..(205): Functional Homolog Of Ceres SEEDLINE ID no. ME02077
MANAAEVSALNRIKLHLLGELSPLATPLNYFDESNPSPSESSNSQSSSVSLNHYFTDLFEFDSKPQIIDLQTPKTLTSAQKKPQLNRKPSLLIAVPKKTEWIQFGSPDPNPVMAAPENLPQKNHYRGVRQRPWGKFAAEIRDPNKRGSRVWLGTFDTAVEAAKAYDRAAFRLRGSKAILNFPLESSAVAETVSVAAARSNVERKR

SEQ ID NO: 2279 - protein, 278 aa, Vitis aestivalis
  misc_feature (1)..(278): useful for making plants with increased tolerance to oxidative stress as described in USSN 12/445,005
  misc_feature (1)..(278): Public GI ID no.40060531
  misc_feature (1)..(278): Score of 274.1 for HMM of FIGURE 3 of USSN 12/445,005.
  misc_feature (118)..(170): Pfam Name: AP2 Pfam Description: AP2 domain
  misc_feature (1)..(278): Functional Homolog Of Ceres SEEDLINE ID no. ME02077
MGEEASSLQLIHHLLLSDFDSMETFVSHVSHSLRSSASDSSVSTDDIIQVSEYPKLHEDESNAFLFDYSTSSPSAVFQFQTESPKPSRLSHRRPPVSISLPPPPISHTSSSLDSGERRHYRGVRRRPWGKFAAEIRDPNRRGSRVWLGTFETAIEAARAYDRAAFKMRGSKAVLNFPLEAGNWSDSDPPATSIRKRERESESEEREQPEIKVLKQEEASPDSDSPVVAEAANVLEASPLTPSSWRTVWEERDMDGAFHMPPLTPLSPHPWIGYSRLIS

SEQ ID NO: 2280 - DNA, 864 bp, Populus balsamifera subsp. trichocarpa
  misc_feature (1)..(864): useful for making plants with increased tolerance to oxidative stress as described in USSN 12/445,005
  misc_feature (1)..(864): Ceres ANNOT ID no.1438401
atggcatcttttgatcatgaagcttcaacattggaactcattaggcaacacctcttgactgactttgcttccatggacagcttcatctccaatcttgatgatctttgcagcacttccaccaccagtactactgatgactactacatcaagtctgaatcaacagaatttgatccctttgatcaaccacaattcaagctgcaaactcaatctagcattgaatccaagcctcaatattcctcaccaaagtcttcaacttctctaagccagagaaaaccatccatgatcaaggacatagccatacctccaccagcaaccttgaacatgaacccacaagtagcacagccagtggtgaacaagacagatttgtctagtgaacaagataggcattacaggggtgttaggcgtaggccttggggaaaatatgcagcggagatccgtgaccctaacaaaaaaggagctcgtgtatggcttggaacatttgatactgccattgaagctgccaaagcttatgatagcgctgctttcaggttacgaggaagcaaagcgatcttgaatttccctcttgaagctggcaagtcgaattctcaacaacctgaacaattcttggaaacttcttgcaagaaaagaaagtttgaaggaataaagagtagcgtggaaggtactaattctatcactaataaggtggtgaagagggagacttcttcaccggaaagtgaggtcaaagcggttgcttcgggtccattaacgccgtcaagttggaaggggttttgggatggtgaaaccatggggatatttagtgtgccaccattatcgccgttatctccacatccttcatttggatattcaaggctcatggttgtttga

SEQ ID NO: 2281 - protein, 287 aa, Populus balsamifera subsp. trichocarpa
  misc_feature (1)..(287): useful for making plants with increased tolerance to oxidative stress as described in USSN 12/445,005
  misc_feature (1)..(287): Ceres ANNOT ID no.1438401
  misc_feature (1)..(287): Score of 320.6 for HMM of FIGURE 3 of USSN 12/445,005.
  misc_feature (128)..(180): Pfam Name: AP2 Pfam Description: AP2 domain
  misc_feature (1)..(287): Functional Homolog Of Ceres SEEDLINE ID no. ME02077
MASFDHEASTLELIRQHLLTDFASMDSFISNLDDLCSTSTTSTTDDYYIKSESTEFDPFDQPQFKLQTQSSIESKPQYSSPKSSTSLSQRKPSMIKDIAIPPPATLNMNPQVAQPVVNKTDLSSEQDRHYRGVRRRPWGKYAAEIRDPNKKGARVWLGTFDTAIEAAKAYDSAAFRLRGSKAILNFPLEAGKSNSQQPEQFLETSCKKRKFEGIKSSVEGTNSITNKVVKRETSSPESEVKAVASGPLTPSSWKGFWDGETMGIFSVPPLSPLSPHPSFGYSRLMVV

SEQ ID NO: 2282 - DNA, 881 bp, Gossypium hirsutum
  misc_feature (1)..(881): useful for making plants with increased tolerance to oxidative stress as described in USSN 12/445,005
  misc_feature (1)..(881): Ceres CLONE ID no.1847074
aaaatcaactctttttcctacaaatgacatcttctgaagaaacattagccttggaactcattcgaaaacatctttgcttccatggattcttttcttgccagtcttcatcatatagtggaaaccccacaattctctcaacttcatagccccaatcagatgaaacattctactctaagccaacgccgtcctgctataaacgtcgccattcccgcaccgaaagtgaacgtaagcgacgagcagaggcattacaggggtgttaggagacgaccttggggtaaatatgcagctgaaattagagaccccaacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcaacccactctgaattaagtaaagcttgtataaaaagaaaaagagaggaagaagaagaagaagggagagtggagagtaaagtagtgaaaagagaggagaagggaagtgtgacgccgggagtatgtttaacgccgtcaaattggacggggttttgggatagtgaagatatgaagggaatattcagtatccctcccttatctccgttatctccgtttgggtattccgggcttgcggttatgtgaaagtgaaacgcttttgatgggtttttggacgccgttaactaaaatcaggaatggttggctgacgtggctagttcaagttgtatcattagtgtacattgccttttgttttatttataacattctttttcttcttttatttggttttttagtgaataccaaatttctttcttgaatttcaaaaaaaaaaaaaaaaaaaa

SEQ ID NO: 2283 - protein, 200 aa, Gossypium hirsutum
  misc_feature (1)..(200): useful for making plants with increased tolerance to oxidative stress as described in USSN 12/445,005
  misc_feature (1)..(200): Ceres CLONE ID no.1847074
  misc_feature (1)..(200): Score of 211.9 for HMM of FIGURE 3 of USSN 12/445,005.
  misc_feature (54)..(106): Pfam Name: AP2 Pfam Description: AP2 domain
  misc_feature (1)..(200): Functional Homolog Of Ceres SEEDLINE ID no. ME02077
MDSFLASLHHIVETPQFSQLHSPNQMKHSTLSQRRPAINVAIPAPKVNVSDEQRHYRGVRRRPWGKYAAEIRDPNRKGARVWLGTFDTAIEAAKAYDEAAFKLRGSKAILNFPLEAGKSSSTHSELSKACIKRKREEEEEEGRVESKVVKREEKGSVTPGVCLTPSNWTGFWDSEDMKGIFSIPPLSPLSPFGYSGLAVM

SEQ ID NO: 2284 - DNA, 954 bp, Gossypium hirsutum
  misc_feature (1)..(954): useful for making plants with increased tolerance to oxidative stress as described in USSN 12/445,005
  misc_feature (1)..(954): Ceres CLONE ID no.1855621
aaaatcaactctttttcctacaaatgacatcttctgaagaaacattagccttggaactcattcgaaaacatcttcttactgactttgcttccatggattcttttcttgccagtcttcatcatatagtggaaaccccacaattctctcaacttcatagccccaatcagatgaaacattctactctaagccaacgccgtcctgctataaacgtcgccattcccgcaccgaaagtgaacgtaagcgacgagcagaggcattacaggggtgttaggagacgaccttggggtaaatatgcagctgaaattagagaccccaacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcaacccactctgaattaagtaaagcttgtataaaaagaaaaagagaggaagaagaagaagaagggagagtggagagtaaagtagtgaaaagagaggagaagggaagtgtgacgccgggagtatgtttaacgccgtcaaattggacggggttttgggatagtgaagatatgaagggaatattcagtatccctcccttatctccgttatctccgtttgggtattccgggcttgcggttatgtgaaagtgaaacgcttttgatgggtttttggacgccgttaactaaaatcaggaatggttggctgacgtggctagttcaagttgtatcattagtgtacattgccttttgttttatttataacattctttttcttcttttatttggttttttagtgaataccaaatttctttcttgaattttatatcaatatcatttttttcataatacatgaacctactacataataaatctaaatttatgttaaaaaaaaaaaaaaaaaaaa

SEQ ID NO: 2285 - protein, 223 aa, Gossypium hirsutum
  misc_feature (1)..(223): useful for making plants with increased tolerance to oxidative stress as described in USSN 12/445,005
  misc_feature (1)..(223): Ceres CLONE ID no.1855621
  misc_feature (1)..(223): Score of 270.7 for HMM of FIGURE 3 of USSN 12/445,005.
  misc_feature (77)..(129): Pfam Name: AP2 Pfam Description: AP2 domain
  misc_feature (1)..(223): Functional Homolog Of Ceres SEEDLINE ID no. ME02077
MTSSEETLALELIRKHLLTDFASMDSFLASLHHIVETPQFSQLHSPNQMKHSTLSQRRPAINVAIPAPKVNVSDEQRHYRGVRRRPWGKYAAEIRDPNRKGARVWLGTFDTAIEAAKAYDEAAFKLRGSKAILNFPLEAGKSSSTHSELSKACIKRKREEEEEEGRVESKVVKREEKGSVTPGVCLTPSNWTGFWDSEDMKGIFSIPPLSPLSPFGYSGLAVM

SEQ ID NO: 2286 - DNA, 867 bp, Populus balsamifera subsp. trichocarpa
  misc_feature (1)..(867): useful for making plants with increased tolerance to oxidative stress as described in USSN 12/445,005
  misc_feature (1)..(867): Ceres ANNOT ID no.1484557
atggcatcttttgatgaagcttcagctttggaactcattagggagcacctcttgactgactttgcttccatggacagcttaatcaccaatcttgatgatctttgcagtacttccagctcctgtattactactgactacatcaagactgaatcaacagaattcgacccctttaatcaatcagagcacccacaacctaagctgcagagtcaatctagcatcgaatccaagccccaatcctcaccaaagtctccaagcactctaagccagagaaaaccatccatgatcaagaacatcgcaattcctccaccagcaaccttgaacatgaccccacaagtagtacagccagtggtgatcaaggcagatgtttcaagtgaacaagaaaggcattacaggggcgttaggcgtaggccatggggcaaatatgcagctgagatccgtgaccctaacaaaaaaggagctcgtgtatggcttggaacatttgatacagccattgaagctgcaaaagcttatgacagtgctgctttcaggctacgtggaagtaaagcaatcttgaatttccctcttgaagctggaaagtctaattctcagcaacctgaacaattcttggaaacttcaagcaagaaaagaaagattgaagaaatagagagtagtatggaaagtactggttctgtgatcactaataaggtggcgaagagggaaagttcttcgccggaaactgaggtcaaagcagcggctacggaaccattaacgccgtcaagttggaaggggttctgggatggtgaagtcatggggatatttaatgtgccaccattgtcaccgttatctccccatccttcatttgggtattcaaggctgatggttgtttga

SEQ ID NO: 2287 - protein, 288 aa, Populus balsamifera subsp. trichocarpa
  misc_feature (1)..(288): useful for making plants with increased tolerance to oxidative stress as described in USSN 12/445,005
  misc_feature (1)..(288): Ceres ANNOT ID no.1484557
  misc_feature (1)..(288): Score of 328.6 for HMM of FIGURE 3 of USSN 12/445,005.
  misc_feature (128)..(180): Pfam Name: AP2 Pfam Description: AP2 domain
  misc_feature (1)..(288): Functional Homolog Of Ceres SEEDLINE ID no. ME02077
MASFDEASALELIREHLLTDFASMDSLITNLDDLCSTSSSCITTDYIKTESTEFDPFNQSEHPQPKLQSQSSIESKPQSSPKSPSTLSQRKPSMIKNIAIPPPATLNMTPQVVQPVVIKADVSSEQERHYRGVRRRPWGKYAAEIRDPNKKGARVWLGTFDTAIEAAKAYDSAAFRLRGSKAILNFPLEAGKSNSQQPEQFLETSSKKRKIEEIESSMESTGSVITNKVAKRESSSPETEVKAAATEPLTPSSWKGFWDGEVMGIFNVPPLSPLSPHPSFGYSRLMVV

SEQ ID NO: 2288 - DNA, 1002 bp, Gossypium hirsutum
  misc_feature (1)..(1002): useful for making plants with increased tolerance to oxidative stress as described in USSN 12/445,005
  misc_feature (1)..(1002): Ceres CLONE ID no.1846882
atatacgaacccaccacacactctctgttccactcaaatccatcaccttctcctccaacttcacttccattttattaattttagcttcccaaaaatggcttctttcggagaagcaccatctgatttagaactcataaagcaacacctctttaatgattttccttcaatggaaacctttctttcacctcctccaacaccacagtttcataaacaatccaccctaagccaacgtcgtccttctattaacgtcacaattccaccatcgaaagttaacataacctccgcagccacgaaagccatcgaggaacatgacgagaaaaggcattacaggggtgtaagaagacgaccatggggtaagttcgcagccgaaattagagaccctaatcgaaaaggttctagaatttggctcggaactttcgaaaccgccatcgaagccgctaaagcttatgatagagctgcttttaagctacgtggaagtaaagccattttgaatttccctctcgaaatcggaaactcgaactcaactgaattccaaccctcgaataaaagaaaaagagaagaagaagaagaagagaggaggaaagtggtgaaaaaggaggaggtaacggaaaacgtaacgacaacggggatatgtttaacgccgtcaaattggaaagggttttgggatagtgaagatatgaagggaatatttagtattcctccattatcacctttatctccgtttggttattccatttcaggactcgccgttatgtaatgatgtggtgtcgtttactaaataaggaaaggttggttgacgtgacggcttaatcatctactataaacggaaaagttaacggccgtcaagaaatagattaacgaagaggtgtgtgttttggattagtatgagtattattagcatatataagctagagaatgccaaagcctaaggttttttatttaattaaaattgtatttgtttctttatttgtttatttaatgaaattattattttatttttac

SEQ ID NO: 2289 - protein, 220 aa, Gossypium hirsutum
  misc_feature (1)..(220): useful for making plants with increased tolerance to oxidative stress as described in USSN 12/445,005
  misc_feature (1)..(220): Ceres CLONE ID no.1846882
  misc_feature (1)..(220): Score of 261.6 for HMM of FIGURE 3 of USSN 12/445,005.
  misc_feature (76)..(128): Pfam Name: AP2 Pfam Description: AP2 domain
  misc_feature (1)..(220): Functional Homolog Of Ceres SEEDLINE ID no. ME02077
MASFGEAPSDLELIKQHLFNDFPSMETFLSPPPTPQFHKQSTLSQRRPSINVTIPPSKVNITSAATKAIEEHDEKRHYRGVRRRPWGKFAAEIRDPNRKGSRIWLGTFETAIEAAKAYDRAAFKLRGSKAILNFPLEIGNSNSTEFQPSNKRKREEEEEERRKVVKKEEVTENVTTTGICLTPSNWKGFWDSEDMKGIFSIPPLSPLSPFGYSISGLAVM

SEQ ID NO: 2290 - DNA, 670 bp, Gossypium hirsutum
  misc_feature (1)..(670): useful for making plants with increased tolerance to oxidative stress as described in USSN 12/445,005
  misc_feature (1)..(670): Ceres CLONE ID no.1854513
actcaaatccatcaccttctcctccaacttcacttccattttattaattttagcttcccaagaatggcttctttcggagaaacatcatctgctttagaactcataaatcaacaccttaatgattttgcttcaatggaaacctttctttcacctcctccaacaccccagtttcataaacaatccaccctaagccaacgtcgaccttctattaacgtcacaattccaccatcgaaagttgaaataacctccaccgccacgaaagccatcgaggaacatgacgagaaaaggcattacaggggtgtaagaagacgaccatggggaaagttcgcagccgaaattagagaccctaatcgaaaaggttctagaatttggctcggaactttcgaaaccgctatcgaagccgctaaagcttatgatagagctgcttttaagctacgtggaagtaaagcaattttgaatttccctctcgaaatcggaaactcgaactcaactgaatcccaaccctcgaataaaagaaaaagagaagaagaagaacaagagaggaaagtagtgaaaaaggaagagataacggaaaacgtaacgacgacgggagtatgtttgacgccgtcaaattggagagggttttgggatagtgaagatatgaagggaatatttagtattcctccattat

SEQ ID NO: 2291 - protein, 202 aa, Gossypium hirsutum
  misc_feature (1)..(202): useful for making plants with increased tolerance to oxidative stress as described in USSN 12/445,005
  misc_feature (1)..(202): Ceres CLONE ID no.1854513
  misc_feature (1)..(202): Score of 223.1 for HMM of FIGURE 3 of USSN 12/445,005.
  misc_feature (75)..(127): Pfam Name: AP2 Pfam Description: AP2 domain
  misc_feature (1)..(202): Functional Homolog Of Ceres SEEDLINE ID no. ME02077
MASFGETSSALELINQHLNDFASMETFLSPPPTPQFHKQSTLSQRRPSINVTIPPSKVEITSTATKAIEEHDEKRHYRGVRRRPWGKFAAEIRDPNRKGSRIWLGTFETAIEAAKAYDRAAFKLRGSKAILNFPLEIGNSNSTESQPSNKRKREEEEQERKVVKKEEITENVTTTGVCLTPSNWRGFWDSEDMKGIFSIPPL

SEQ ID NO: 2292 - protein, 221 aa, Arabidopsis thaliana
  misc_feature (1)..(221): useful for making plants with increased tolerance to oxidative stress as described in USSN 12/445,005
  misc_feature (1)..(221): Public GI ID no.18423250
  misc_feature (1)..(221): Score of 215.3 for HMM of FIGURE 3 of USSN 12/445,005.
  misc_feature (70)..(122): Pfam Name: AP2 Pfam Description: AP2 domain
  misc_feature (1)..(221): Functional Homolog Of Ceres SEEDLINE ID no. ME02077
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 2293 - protein, 221 aa, Arabidopsis thaliana
  misc_feature (1)..(221): useful for making plants with increased tolerance to oxidative stress as described in USSN 12/445,005
  misc_feature (1)..(221): Public GI ID no.21592411
  misc_feature (1)..(221): Score of 215.3 for HMM of FIGURE 3 of USSN 12/445,005.
  misc_feature (70)..(122): Pfam Name: AP2 Pfam Description: AP2 domain
  misc_feature (1)..(221): Functional Homolog Of Ceres SEEDLINE ID no. ME02077
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISHKAVKREEAQVQADACPLTPSSWKGFWDGADSKDMGIFSVPLLSPCPSLGHSQLVVT

SEQ ID NO: 2294 - DNA, 833 bp, Arabidopsis thaliana
  misc_feature (1)..(833): useful for making plants with increased tolerance to oxidative stress as described in USSN 12/445,005
  misc_feature (1)..(833): Ceres CLONE ID no.2347
ataatcaaaaccacaaagaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccataaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctaccc

SEQ ID NO: 2295 - protein, 221 aa, Arabidopsis thaliana; identical to SEQ ID NO: 2293
  misc_feature (1)..(221): useful for making plants with increased tolerance to oxidative stress as described in USSN 12/445,005
  misc_feature (1)..(221): Ceres CLONE ID no.2347
  misc_feature (1)..(221): Score of 215.3 for HMM of FIGURE 3 of USSN 12/445,005.
  misc_feature (70)..(122): Pfam Name: AP2 Pfam Description: AP2 domain
  misc_feature (1)..(221): Functional Homolog Of Ceres SEEDLINE ID no. ME02077

SEQ ID NO: 2296 - DNA, 893 bp, Brassica napus
  misc_feature (1)..(893): useful for making plants with increased tolerance to oxidative stress as described in USSN 12/445,005
  misc_feature (1)..(893): Ceres CLONE ID no.1080500
aacacaatcaaaaccataaaccaacgactccaagtctctcatatatggcatcttcacaagaccaatcagctttggacctcatcactcaacacctccttaccgatttcccttccttagagactttcgtctctagcatccatcagagcaccacctccactcttagccaacgcaagccatctcttgccaccatttcagttcctactactgcaccggtggttcaagaggatgatcataggcattacaggggcgtgaggcgtaggccgtggggtaagtatgcggctgagatcagagacccaaacaagaaaggcgttcgtgtctggttaggtacttttgacacggccgtggaggctgcaagaggttacgacagggctgcttttaaactaagaggaagcaaagccattcttaacttcccactagaagcaggcaagcaccaggactctggagacaacaagaacaagaagactgtggctttgaaagctaagaggaagagaccagaaacagaggatgaaaaccatgagagaaacctgatcagtcataaagctgtgaaaagggaagagacggaagctcagggtgaggcttgtccgttaacaccatcaagttggatggggttttgggacgcagtagacggtatagggatgggactattctctgtgcctcctttatctccttacccatcgctaggacattctcaactcggagttaagtaagcttatggatgtaggtgacatccgcaactttggattatatatcatcggcaagcgaacacacaaacaagacaataattatcttaaggattgtattaaagattcctcacggagtgaattagtttgtagattggttgattgtaaatggtttgttatattcattcgttcttctcaaaaaaaaaaaaaaaa

SEQ ID NO: 2297 - protein, 220 aa, Brassica napus
  misc_feature (1)..(220): useful for making plants with increased tolerance to oxidative stress as described in USSN 12/445,005
  misc_feature (1)..(220): Ceres CLONE ID no.1080500
  misc_feature (1)..(220): Score of 240.3 for HMM of FIGURE 3 of USSN 12/445,005.
  misc_feature (64)..(116): Pfam Name: AP2 Pfam Description: AP2 domain
  misc_feature (1)..(220): Functional Homolog Of Ceres SEEDLINE ID no. ME02077
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHQDSGDNKNKKTVALKAKRKRPETEDENHERNLISHKAVKREETEAQGEACPLTPSSWMGFWDAVDGIGMGLFSVPPLSPYPSLGHSQLGVK

SEQ ID NO: 2298 - DNA, 957 bp, Gossypium hirsutum
  misc_feature (1)..(957): useful for making plants with increased tolerance to oxidative stress as described in USSN 12/445,005
  misc_feature (1)..(957): Ceres CLONE ID no.1849534
ctcaaatccatcagttttccctttttttagtctccaacttccatttctcttatccggattgatatcataaataccaaaatggcatgttctgatgaaacatcagcccagttagaacttatcaggcaacatctctttactgattttgcttccatggaaactccaccacccttctatcaactctcaaattccgagtcatctcatgtttatagcccgacccggttaaaacaatcgagtctcagccaacgtcgtccttctattaacgttatgatcccacccacaagttttaacataagcccaaacccggttccagattcggctgcggtggcggttgaatcatacgagaaaagtcattatagaggtgttagaagacgaccatgggggaagtttgcggctgaaattagagaccctaacaagaaaggggcaagggtttggcttggaacatttgacaccgccatagaagcggcaaaagcatatgatagagctgcctttaagctacgcggtagcaaagctatactgaattttcctcatgaagcaggaaaatcaaatttctcagagtcaggaaaaaggaggagaagtgtagaggaaggagaaggagaaaagagagtgagcctgctggagtgcaaagcagggagaagagaggaggaggtaacggtggcggaatgtggaacgccgtcgaatcagacggggatcggggataatgaagatataaatgaaatattcggtggcccactcttatcacccttatcatcgtttccatggtttgggtattccaggcttgaggttatgtaaaagcttagcaaggaatgtggctgtgtttactttttttaagtgtttggtaattagtagggatgggatgcctaaagcctaagcattttcagatcaaattgcatttgttctttcttctgtttactttaataaataaaattgtcttctcctcaaaaaaaaaaaaaaaaaaaa

SEQ ID NO: 2299 - protein, 236 aa, Gossypium hirsutum
  misc_feature (1)..(236): useful for making plants with increased tolerance to oxidative stress as described in USSN 12/445,005
  misc_feature (1)..(236): Ceres CLONE ID no.1849534
  misc_feature (1)..(236): Score of 213.6 for HMM of FIGURE 3 of USSN 12/445,005.
  misc_feature (90)..(142): Pfam Name: AP2 Pfam Description: AP2 domain
  misc_feature (1)..(236): Functional Homolog Of Ceres SEEDLINE ID no. ME02077
MACSDETSAQLELIRQHLFTDFASMETPPPFYQLSNSESSHVYSPTRLKQSSLSQRRPSINVMIPPTSFNISPNPVPDSAAVAVESYEKSHYRGVRRRPWGKFAAEIRDPNKKGARVWLGTFDTAIEAAKAYDRAAFKLRGSKAILNFPHEAGKSNFSESGKRRRSVEEGEGEKRVSLLECKAGRREEEVTVAECGTPSNQTGIGDNEDINEIFGGPLLSPLSSFPWFGYSRLEVM

SEQ ID NO: 2300 - DNA, 865 bp, Brassica napus
  misc_feature (1)..(865): useful for making plants with increased tolerance to oxidative stress as described in USSN 12/445,005
  misc_feature (1)..(865): Ceres CLONE ID no.965028
  misc_feature (539)..(539): r is g or a
gcacaacacaatcaaaaccataaaccaacgactccaagtctcatatatggcttcttcacaagaccaatcagctttggacctcatcactcaacacctccttaccgatttcccttcattggagactttcgtctctagcatccatcagagcaccacctccactcttagccaacgcaagccatctcttgccaccatttcagttcctactactgcaccggtggttcaagaggatgatcataggcattacaggggcgtgaggcgtaggccgtggggtaagtatgcggctgagatcagagacccaaacaagaaaggcgttcgtgtctggttaggtacttttgacacggccgtggaggctgcaagaggttacgacagggctgcttttaaactaagaggaagcaaagccattcttaacttcccactagaagcaggcaagcacgaggacaacaacactgtggctttgaaatctaagaggaagagaccagaaacacaggatgaaaaccatggcagaaacctgatcagccataaagctgtgataagggaaragacggaagctcagggtgaggcttgtccgttaacaccatcaagttggatggggttttgggatggagtagacggtatagggacgggactattctctgtgcctcctttatctccttacccatcgctaggacattctcaactcggagttaagtaagcttatggatgtaggtgacatccgcaactttggattttatatcatcggcaagcgaacacacaaagaatcttaaagattgtattaaagattcctcatggagtgaattcgtttcttgatttgttgattgtaaatggtttgttatattcattcgttcttctcagtgcaattatctct

SEQ ID NO: 2301 - protein, 214 aa, Brassica napus
  misc_feature (1)..(214): useful for making plants with increased tolerance to oxidative stress as described in USSN 12/445,005
  misc_feature (1)..(214): Ceres CLONE ID no.965028
  misc_feature (1)..(214): Score of 222.6 for HMM of FIGURE 3 of USSN 12/445,005.
  misc_feature (64)..(116): Pfam Name: AP2 Pfam Description: AP2 domain
  misc_feature (1)..(214): Functional Homolog Of Ceres SEEDLINE ID no. ME02077
  misc_feature (165)..(165): Xaa is any aa, unknown or other
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHEDNNTVALKSKRKRPETQDENHGRNLISHKAVIREXTEAQGEACPLTPSSWMGFWDGVDGIGTGLFSVPPLSPYPSLGHSQLGVK

SEQ ID NO: 2302 - DNA, 1353 bp, Glycine max
  misc_feature (1)..(1353): useful for making plants with increased tolerance to oxidative stress as described in USSN 12/445,005
  misc_feature (1)..(1353): Ceres CLONE ID no.464504
  misc_feature (1227)..(1227): y is t/u or c
  misc_feature (1228)..(1228): m is a or c
gactcaaccaattccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggttcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatctttagtgtgcctcctttgtcaccactatctccactaatggttgtttgagattttgtggaacttttgctctttcaatgatgttttgaggtaaccaaactaaggggagagagagagatgatgctggtgattgtcctctctgatttaggttgctaatttgcctaaatcaaaatggtagtactaattaatctactaatagattaatttgcaagtgaatatatatatggatttgtataatgtaaatataggatagymctatgaagcaagatctttttgtttgttgaaaaaaaaaacaaaaaacccatgcttatcttcttcctttaggtaaaaaaatgtactgtacttgaagcaatattgaaatttgtttattcgtttattgg

SEQ ID NO: 2303 - protein, 281 aa, Glycine max
  misc_feature (1)..(281): useful for making plants with increased tolerance to oxidative stress as described in USSN 12/445,005
  misc_feature (1)..(281): Ceres CLONE ID no.464504
  misc_feature (1)..(281): Score of 162.4 for HMM of FIGURE 3 of USSN 12/445,005.
  misc_feature (124)..(176): Pfam Name: AP2 Pfam Description: AP2 domain
  misc_feature (1)..(281): Functional Homolog Of Ceres SEEDLINE ID no. ME02077
MQSSISQSDIFITDYLVPQEVPFQFQFQDMSKNDNNMPMNHTNNNLQMPQITSFSKPPRSSSNLSNRKPSLKNITIPSITSGLATAMSQTTATTTTIATTMYNNNQVSSSSFSSDETNNTKDDKHYRGVRRRPWGKYAAEIRDPNRKGSRVWLGTFDTAIEAAKAYDKAAFKMRGSKAILNFPLEIGSDQSKEESSSSSSSVSSSSIVIKVGVKREREEESERKNNYEKSEFNNNSNSNKHVKKEECPLTPSCWKGFWDTDVMGTIFSVPPLSPLSPLMVV

SEQ ID NO: 2304 - protein, 164 aa, Solanum lycopersicum
  misc_feature (1)..(164): useful for making plants with increased tolerance to oxidative stress as described in USSN 12/445,005
  misc_feature (1)..(164): Public GI ID no.12231294
  misc_feature (1)..(164): Score of 134.2 for HMM of FIGURE 3 of USSN 12/445,005.
  misc_feature (8)..(60): Pfam Name: AP2 Pfam Description: AP2 domain
  misc_feature (1)..(164): Functional Homolog Of Ceres SEEDLINE ID no. ME02077
MVENSEKKRYRGVRQRPWGKFAAEIRDPTRKGTRVWLGTFDTAMDAAMAYDRAAFRLRGSKAILNFPLEVSNFKQENHEIEKNVVNLNSNTNSCGKRVRREMENDDGIVMKKEVKREQMVATPLTPSNWSSIWDCGNGKGIFEVPPLSPLSPHSNFGYSQLLVS

SEQ ID NO: 2305 - protein, 241 aa, Arabidopsis thaliana
  misc_feature (1)..(241): useful for making plants with increased tolerance to oxidative stress as described in USSN 12/445,005
  misc_feature (1)..(241): Public GI ID no.15240297
  misc_feature (1)..(241): Score of 208.4 for HMM of FIGURE 3 of USSN 12/445,005.
  misc_feature (86)..(138): Pfam Name: AP2 Pfam Description: AP2 domain
  misc_feature (1)..(241): Functional Homolog Of Ceres SEEDLINE ID no. ME02077
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 2306 - protein, 241 aa, Arabidopsis thaliana
  misc_feature (1)..(241): useful for making plants with increased tolerance to oxidative stress as described in USSN 12/445,005
  misc_feature (1)..(241): Public GI ID no.13430474
  misc_feature (1)..(241): Score of 203.6 for HMM of FIGURE 3 of USSN 12/445,005.
  misc_feature (86)..(138): Pfam Name: AP2 Pfam Description: AP2 domain
  misc_feature (1)..(241): Functional Homolog Of Ceres SEEDLINE ID no. ME02077
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTSSSWMGFWDVGAGDGIFSIPPLSPTSPNFSVISVT

SEQ ID NO: 2307 - protein, 241 aa, Arabidopsis thaliana
  misc_feature (1)..(241): useful for making plants with increased tolerance to oxidative stress as described in USSN 12/445,005
  misc_feature (1)..(241): Public GI ID no.21617964
  misc_feature (1)..(241): Score of 209.2 for HMM of FIGURE 3 of USSN 12/445,005.
  misc_feature (86)..(138): Pfam Name: AP2 Pfam Description: AP2 domain
  misc_feature (1)..(241): Functional Homolog Of Ceres SEEDLINE ID no. ME02077
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 2308 - DNA, 714 bp, Populus balsamifera subsp. trichocarpa
  misc_feature (1)..(714): useful for making plants with increased tolerance to oxidative stress as described in USSN 12/445,005
  misc_feature (1)..(714): Ceres ANNOT ID no.1438399
atggcaaccccagaagaatcctccacgttagaactcataagacaacatcttctcggagacttcacctccacagatgagttcatcagtaatcttgagtgcactgtagccagtatatctgttaaactagagaactccctatctgggtctgaatccaactccccagtatcagaccaaagttactatagcacccaagaaacctgtagctttgaaataaaatctgaaatcatagatttgacacctcctgaacccatgttttcagattcaagtaatcagtccccaccacctgaactcgtaaagatgacagatagagaagagacaatattaaggcattacagaggggtccgaagaaggccatggggaaagtttgcggcggagatccgtgacccaaccaggaagggtagtcgggtttggttaggtacttttgacagtgatatcgatgccgcaagagcttatgactgtgctgcattcaaaatgaggggcaggaaagcaatcctgaattttcctttggaggctggactgtccagctcgcctccggccacgggcaggaagaggagaagagtgaagagagaggaggtgctgccagaatctgttgatgtctcgccggaaaattgggatgtagagtggagtggagaggaagtggagggcttttctgacgaggagcaactgtcaccgttatctcgaaagccagttttgctttacgtgtcagtagattag

SEQ ID NO: 2309 - protein, 237 aa, Populus balsamifera subsp. trichocarpa
  misc_feature (1)..(237): useful for making plants with increased tolerance to oxidative stress as described in USSN 12/445,005
  misc_feature (1)..(237): Ceres ANNOT ID no.1438399
  misc_feature (1)..(237): Score of 147.3 for HMM of FIGURE 3 of USSN 12/445,005.
  misc_feature (109)..(161): Pfam Name: AP2 Pfam Description: AP2 domain
  misc_feature (1)..(237): Functional Homolog Of Ceres SEEDLINE ID no. ME02077
MATPEESSTLELIRQHLLGDFTSTDEFISNLECTVASISVKLENSLSGSESNSPVSDQSYYSTQETCSFEIKSEIIDLTPPEPMFSDSSNQSPPPELVKMTDREETILRHYRGVRRRPWGKFAAEIRDPTRKGSRVWLGTFDSDIDAARAYDCAAFKMRGRKAILNFPLEAGLSSSPPATGRKRRRVKREEVLPESVDVSPENWDVEWSGEEVEGFSDEEQLSPLSRKPVLLYVSVD

SEQ ID NO: 2310 - DNA, 705 bp, Populus balsamifera subsp. trichocarpa
  misc_feature (1)..(705): useful for making plants with increased tolerance to oxidative stress as described in USSN 12/445,005
  misc_feature (1)..(705): Ceres ANNOT ID no.1484559
atggcaaccccggaagaatcctcaacattagaactcataagacaacatcttcttggagacttcatctccacagacgagtttatcagtaatcttgagtccagtatagccagtgtctctgtcaaactagagagctccctttctgggtcagaacccaactccccaatatccgaccaaagttaccatagtaccccagaaacctatagctttgaaataaaacctgaaatcatagacttcacacctcctgagcccgtgttttcaggttcaagtaatcagtacccaccacctgagcctgtaaagatgacagataaaggagaaacagtaaggcattacaggggggtccgaagaaggccatggggcaagtttgcagcagagatccgtgaccctacccggaagggaagtcgggtttggttgggtacttttgacagtgatactgatgctgcaaaagcttatgactgtgctgcattcaaaatgaggggcaggaaagcaatcctgaattttccttcggaggctggactatccatcccgccgccagccacaggcaggaagagaagaagatcgaagggagaagaggtgctgccggaatctgttgatgtgtcaacggaaaattggaatttaaagtggagtggagaagtagaggagggtgtttcagatgaggagcaactgtcaccgttaacccaagaaaccatgttggcaaggctttcttaa

SEQ ID NO: 2311 - protein, 234 aa, Populus balsamifera subsp. trichocarpa
  misc_feature (1)..(234): useful for making plants with increased tolerance to oxidative stress as described in USSN 12/445,005
  misc_feature (1)..(234): Ceres ANNOT ID no.1484559
  misc_feature (1)..(234): Score of 137.2 for HMM of FIGURE 3 of USSN 12/445,005.
  misc_feature (108)..(160): Pfam Name: AP2 Pfam Description: AP2 domain
  misc_feature (1)..(234): Functional Homolog Of Ceres SEEDLINE ID no. ME02077
MATPEESSTLELIRQHLLGDFISTDEFISNLESSIASVSVKLESSLSGSEPNSPISDQSYHSTPETYSFEIKPEIIDFTPPEPVFSGSSNQYPPPEPVKMTDKGETVRHYRGVRRRPWGKFAAEIRDPTRKGSRVWLGTFDSDTDAAKAYDCAAFKMRGRKAILNFPSEAGLSIPPPATGRKRRRSKGEEVLPESVDVSTENWNLKWSGEVEEGVSDEEQLSPLTQETMLARLS

SEQ ID NO: 2312 - DNA, 1305 bp, Glycine max
  misc_feature (1)..(1305): useful for making plants with increased tolerance to oxidative stress as described in USSN 12/445,005
  misc_feature (1)..(1305): Ceres CLONE ID no.548557
aaccaattccaaattctcaactttcctaactttagcaaccatccaagaagttgatcagttccttgtctctccttgaattataaaaccattcacagtcttgaacccaatttcactctttgcacctcaaacaccttataagcctcaatttcacaaccaaaaatgcaaagttcaatctcacaatctgagatttgcatcactgattaccttctaccccaagaagttccatctcaatttcaatttccagatatgagcaacaataacataccaatgaaccataccaaccttcaaatgcctcaaatcacatctttctccaagcctccaaggtcctcatcaaatctaagcaaccgcaaaccgtccttgagaaacatcacaatcccttccataacctcaggtcttacaacaactatgtcacaaacaacaacaacaacaacaatagctacaaccatgtataacaacaatcaagttacttcttcttcagatgaaaccaacaacatcaaagagaacaagcactatagaggggttagaagaaggccatggggcaagtatgctgcagaaatccgtgaccctaatagaaaaggctcaagggtgtggcttggaacctttgacacagccatagaagctgccaaggcttatgacaaagctgctttcaagatgagagggagcaaagccatattgaatttccctttggagattggagagtcagaggaatcagtctcaagctgcatcaaggttggtgtgaagagggaaagagaggaagagagtaaaagcaacaactatgagaaaagtgagtttaacaacaataataatagtaataagcatgtgaagaaagaagagtgttctcccaaagctgtttgccctttgactccatcatgttggaaaggcttttgggacactgatgttatgggaactatctttagtgtgcctcctttgtcaccactatctccactaatggttgtttgagattgtggactttcgctatttcaatgatggtttgaggtaaccaaattaaggagagatgatgctggggattgtcctctctgatttaggttggtaatttgcgtaaatcaaaatggtagtactaattaatctactaatagattaatttgcaagtgaagatatatgggtttgtataatgtaaatataggatagtatgaagcaagatttttttgtttgttaaaaaaaaaaaaagctctcatgcttatcttcttcccttagttatgtttcatttggtcaagaaatgtactgtacttgaagcaacattgaaatttgtttattcgtttattggagaaaaaaaaaaaaaaaaaa

SEQ ID NO: 2313 - protein, 266 aa, Glycine max
  misc_feature (1)..(266): useful for making plants with increased tolerance to oxidative stress as described in USSN 12/445,005
  misc_feature (1)..(266): Ceres CLONE ID no.548557
  misc_feature (1)..(266): Score of 175.3 for HMM of FIGURE 3 of USSN 12/445,005.
  misc_feature (116)..(168): Pfam Name: AP2 Pfam Description: AP2 domain
  misc_feature (1)..(266): Functional Homolog Of Ceres SEEDLINE ID no. ME02077
MQSSISQSEICITDYLLPQEVPSQFQFPDMSNNNIPMNHTNLQMPQITSFSKPPRSSSNLSNRKPSLRNITIPSITSGLTTTMSQTTTTTTIATTMYNNNQVTSSSDETNNIKENKHYRGVRRRPWGKYAAEIRDPNRKGSRVWLGTFDTAIEAAKAYDKAAFKMRGSKAILNFPLEIGESEESVSSCIKVGVKREREEESKSNNYEKSEFNNNNNSNKHVKKEECSPKAVCPLTPSCWKGFWDTDVMGTIFSVPPLSPLSPLMVV

SEQ ID NO: 2314 - protein, 300 aa, Arabidopsis thaliana
  misc_feature (1)..(300): useful for making plants with increased tolerance to oxidative stress as described in USSN 12/445,005
  misc_feature (1)..(300): Public GI ID no.18422770
  misc_feature (1)..(300): Score of 435.5 for HMM of FIGURE 3 of USSN 12/445,005.
  misc_feature (154)..(206): Pfam Name: AP2 Pfam Description: AP2 domain
  misc_feature (1)..(300): Functional Homolog Of Ceres SEEDLINE ID no. ME02077
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 2315 - protein, 300 aa, Arabidopsis thaliana; identical to SEQ ID NO: 2314
  misc_feature (1)..(300): useful for making plants with increased tolerance to oxidative stress as described in USSN 12/445,005
  misc_feature (1)..(300): Public GI ID no.8809606
  misc_feature (1)..(300): Score of 435.5 for HMM of FIGURE 3 of USSN 12/445,005.
  misc_feature (154)..(206): Pfam Name: AP2 Pfam Description: AP2 domain
  misc_feature (1)..(300): Functional Homolog Of Ceres SEEDLINE ID no. ME02077

SEQ ID NO: 2316 - protein, 296 aa, Brassica oleracea
  misc_feature (1)..(296): useful for making plants with increased tolerance to oxidative stress as described in USSN 12/445,005
  misc_feature (1)..(296): Public GI ID no.89257455
  misc_feature (1)..(296): Score of 450.3 for HMM of FIGURE 3 of USSN 12/445,005.
  misc_feature (150)..(202): Pfam Name: AP2 Pfam Description: AP2 domain
  misc_feature (1)..(296): Functional Homolog Of Ceres SEEDLINE ID no. ME02077
MANPSEASALRFIEKHLLDELSPVATDRWMIHESAATESSSDTSPTIFGSPAAPIEFSEFENKPEIIDLSTPRFVDLISSPFEFDSEVSLSDFDLKPSYQTGNQFEPEIKTQSNRKPPLKISVPTKTEWIQFDPQPEVTKPKQAIAEEKKHYRGVRQRPWGKFAAEIRDPNKRGSRIWLGTFDTAIEAARAYDQAAFRLRGSKAILNFPLEVGKWKTRYNADGEKKRKRDDELEDVTVVEKVLKTEQNVNGKETFPLVKSDLTELYDWDLTGFLNFPLLSPLSPRPSFNYSELTVV

SEQ ID NO: 2317 - protein, 307 aa, Brassica oleracea
  misc_feature (1)..(307): useful for making plants with increased tolerance to oxidative stress as described in USSN 12/445,005
  misc_feature (1)..(307): Public GI ID no.89257468
  misc_feature (1)..(307): Score of 399.1 for HMM of FIGURE 3 of USSN 12/445,005.
  misc_feature (165)..(217): Pfam Name: AP2 Pfam Description: AP2 domain
  misc_feature (1)..(307): Functional Homolog Of Ceres SEEDLINE ID no. ME02077
MANPSEVSSALWFIEKHLLDVVSPVAKDRWMIHESAAKDSSFDSSPMIFGSSSSSSAPIDCSESEIKPEVIDLSTPRFMDLISTPSEFNTGVSVSVSDFDFKPTFQTVNQFEPEFKTQIPCASDDSHSNRKPPLKISVPTKTEWIQFNPQPEVTKPVQPDAEEQRHYRGVRQRPWGKFASEIRDPNKRGSRIWLGTFDTAIEAARAYDEAAFRLRGSKAILNFPLEVGKWKSRKEADGEKKRKRDEIEDDHVAVVEKVLKTEQSVNGKEAFNLTEFCDWDVMGLLNFPLLSPLSPHPSFGYSQLTVV

SEQ ID NO: 2318 - DNA, 1038 bp, Populus balsamifera subsp. trichocarpa
  misc_feature (1)..(1038): useful for making plants with increased tolerance to oxidative stress as described in USSN 12/445,005
  misc_feature (1)..(1038): Ceres ANNOT ID no.1486129
atgtcaacagaagtatcaacagccttagagttcattaagcaccacttgcttggcgatcttctttcacctattgctacctcctcctcagcttctttttgtcaattttctactaacactgaaatttctacttatgagactacaggctgctgctcacaggcttcgacttctgactcttccactgcatttccttattttttagattctcctggccctgatttcttcgtattctcttccgattttagccctgctcaagataacaagaccaatatcttcgagtttgaagctaaacctgaaatcattgatctcttaacgccaaaacccctcgattcaacctcccacctcaattcccaaccaagcagcagcagcagcagcagcaatagcagtaacttgttcgaatttgtgaaaccacaaattatttctcatccagtcaacaatttcttctatgaagaatcaaagcctcgagttgaaccaactcggaaaccgtcattgaaaatatcgctgcccagcagaaaatccgaatggattcagttttctaacacgaacccgcaacccgtggatgataattctggtgttgctgtagaagaaaaaaagcattacagaggagtccgacacaggccatggggcaagtacgcagcagagatacgggacccgaaccggagaggttcacgtgtgtggctaggaaccttcgatacagctctcgaagctgccagagcctatgatcgagctgccttcaagctgcgcgggtcgaaagcgattctcaattttccattagaagctgggaggtgtgatgtacgcgccaacgaagaaggtgaaaggaaaagacttagagagggtgacgcggaagagagagaggatgttaagagggttatgcgagtggttaagagagaggaacccgagagggatgttccgctgacgccgtcatgttgtacggctgtgtgggatatatgtggcgattcaaagggtgtatttaacgtgcccccattgtctccgttatctccccacccgtcgttgggatttccacagctactggttatttga

SEQ ID NO: 2319 - protein, 345 aa, Populus balsamifera subsp. trichocarpa
  misc_feature (1)..(345): useful for making plants with increased tolerance to oxidative stress as described in USSN 12/445,005
  misc_feature (1)..(345): Ceres ANNOT ID no.1486129
  misc_feature (1)..(345): Score of 420.8 for HMM of FIGURE 3 of USSN 12/445,005.
  misc_feature (197)..(249): Pfam Name: AP2 Pfam Description: AP2 domain
  misc_feature (1)..(345): Functional Homolog Of Ceres SEEDLINE ID no. ME02077
MSTEVSTALEFIKHHLLGDLLSPIATSSSASFCQFSTNTEISTYETTGCCSQASTSDSSTAFPYFLDSPGPDFFVFSSDFSPAQDNKTNIFEFEAKPEIIDLLTPKPLDSTSHLNSQPSSSSSSSNSSNLFEFVKPQIISHPVNNFFYEESKPRVEPTRKPSLKISLPSRKSEWIQFSNTNPQPVDDNSGVAVEEKKHYRGVRHRPWGKYAAEIRDPNRRGSRVWLGTFDTALEAARAYDRAAFKLRGSKAILNFPLEAGRCDVRANEEGERKRLREGDAEEREDVKRVMRVVKREEPERDVPLTPSCCTAVWDICGDSKGVFNVPPLSPLSPHPSLGFPQLLVI

SEQ ID NO: 2320 - DNA, 1068 bp, Populus balsamifera subsp. trichocarpa
  misc_feature (1)..(1068): useful for making plants with increased tolerance to oxidative stress as described in USSN 12/445,005
  misc_feature (1)..(1068): Ceres ANNOT ID no.1446832
atggaaacggatcaaactcagcaagtatcttcagccttagagtccatcaagcaacatttgcttggcgatcttctttcacctgttgctacctcctccgcttctttttatcaattttctacaaattctgcaacctctacttccctacagtgtgagactactagctgctcaagttctgacttttccacggcactccctgattttttcggttctcttctcgagttcacttccgttttgagtccctcgcaagagaacaacaccaatatcttcgaatttgaacctaaacctgaaatcattgatctctttacgccaacgccactcaactcaacctcccacatcaatttccaatcaagcagcagcagcaccggcagcagcggcggcagtaacttcttcgagtttgaatccaaacctcaaattcatcagaatttcgagtttgagtcgaaaccacaaatcgtttctcagcgaagcaacagtttcttctatgaagaaccaaagcctcaggttcaaacagctcggaaacgctctttgaaaatatcgctgcctagcaaaaaacccgaatggatccagttttcttctaacccaaacccgcaaaccgtggaggataattctggtgttgctgctcaagagataaggcattacagaggagtccgacgcaggccatggggcaagtacgcagcggagatccgggacccgaaccggagaggttcacgagtgtggctaggaaccttcgatacagaccttgaagccgctaaagcctatgatcgagctgccttcaagctgcgtgggtcgaaagcgattctcaatttcccattagaagccgggaggtgtgaggaggaaagtgaaaggaaaagaagtagagagggtggcgtggaagagagagaggatgtgaagagggtaatgacggtggttaagagggaggaacctgaaactgagggggatatcccgttgacgccgtcaagttggacggctttttgggatggtggtgatacgaaggatgtcttcaatgtgcccccgctgtctccgttatctcctcacccgccattgggattcccacagctaacggttatttga

SEQ ID NO: 2321 - protein, 355 aa, Populus balsamifera subsp. trichocarpa
  misc_feature (1)..(355): useful for making plants with increased tolerance to oxidative stress as described in USSN 12/445,005
  misc_feature (1)..(355): Ceres ANNOT ID no.1446832
  misc_feature (1)..(355): Score of 380.6 for HMM of FIGURE 3 of USSN 12/445,005.
  misc_feature (210)..(262): Pfam Name: AP2 Pfam Description: AP2 domain
  misc_feature (1)..(355): Functional Homolog Of Ceres SEEDLINE ID no. ME02077
METDQTQQVSSALESIKQHLLGDLLSPVATSSASFYQFSTNSATSTSLQCETTSCSSSDFSTALPDFFGSLLEFTSVLSPSQENNTNIFEFEPKPEIIDLFTPTPLNSTSHINFQSSSSSTGSSGGSNFFEFESKPQIHQNFEFESKPQIVSQRSNSFFYEEPKPQVQTARKRSLKISLPSKKPEWIQFSSNPNPQTVEDNSGVAAQEIRHYRGVRRRPWGKYAAEIRDPNRRGSRVWLGTFDTDLEAAKAYDRAAFKLRGSKAILNFPLEAGRCEEESERKRSREGGVEEREDVKRVMTVVKREEPETEGDIPLTPSSWTAFWDGGDTKDVFNVPPLSPLSPHPPLGFPQLTVI

SEQ ID NO: 2322 - protein, 341 aa, Vitis aestivalis
  misc_feature (1)..(341): useful for making plants with increased tolerance to oxidative stress as described in USSN 12/445,005
  misc_feature (1)..(341): Public GI ID no.40060533
  misc_feature (1)..(341): Score of 375.4 for HMM of FIGURE 3 of USSN 12/445,005.
  misc_feature (190)..(242): Pfam Name: AP2 Pfam Description: AP2 domain
  misc_feature (1)..(341): Functional Homolog Of Ceres SEEDLINE ID no. ME02077
MATAVEVSALQLIRQHLLGELSPKNIVVTDLTVGEEWSNGLNSEVSTSQSDSSFCFQAASCDSPVTISELFGSTDLSADFFGFVPSSTSEQSQSNFFEFETKPQIIDLTSPKGLNSSHFFEFETKPQIKDTTKTKSLDSSSQSTGKDRKPSLKISVPRPTKEIEWLEFAEPKQAATVEPAQNISHPEEKKHYRGVRQRPWGKFAAEIRDPKRRGSRVWLGTYETAIEAAKAYDRAAFQMRGSKAILNFPLEAGKSAETSTDYGRKRCREAEPEVTEMEANPPAKKEKLPEANTITRVQNDTPLTPSFWDFDLDSVGCLINVPPISPLSPHPKFGFPQLMVI

SEQ ID NO: 2323 - protein, 235 aa, Capsicum annuum
  misc_feature (1)..(235): useful for making plants with increased tolerance to oxidative stress as described in USSN 12/445,005
  misc_feature (1)..(235): Public GI ID no.76097531
  misc_feature (1)..(235): Score of 454.4 for HMM of FIGURE 3 of USSN 12/445,005.
  misc_feature (122)..(174): Pfam Name: AP2 Pfam Description: AP2 domain
  misc_feature (1)..(235): Functional Homolog Of Ceres SEEDLINE ID no. ME02077
MGSPQENCSFDMIRQHLDDISLMEYYCPENTLYSQSCESLDQTSVSFETSSNLDDISSFFSSSKTDFGCFEFETKPITSAATSISSNSPKKRSFNERKPSLNIAVPVKPVVVQKVEVVREKKHYRGVRQRPWGKFAAEIRDPNRKGTRVWLGTFDTAVDAAKAYDRAAFKLRGSKAILNFPLEVANFKQQNSTVEVPQQVNSSGSKRAREKEELAINEKKKKKKKNLAAPRPSPI

SEQ ID NO: 2324 - protein, 276 aa, Capsicum annuum
  misc_feature (1)..(276): useful for making plants with increased tolerance to oxidative stress as described in USSN 12/445,005
  misc_feature (1)..(276): Public GI ID no.60459379
  misc_feature (1)..(276): Score of 387.0 for HMM of FIGURE 3 of USSN 12/445,005.
  misc_feature (125)..(177): Pfam Name: AP2 Pfam Description: AP2 domain
  misc_feature (1)..(276): Functional Homolog Of Ceres SEEDLINE ID no. ME02077
MDTSSLDLIRQHLLDDDVVFMENYCTSSETTSTLYSQSSSSSESLESFVSELKTESNFSFYPESSNLEFCSFFNNNSKMEFNPSEFQVKPQKKKSFNERKPLLNISIPSVKKTDESKTGENSEKKRYRGVRQRPWGKFAAEIRDPNRKGTRVWLGTFDTAVDAAMAYDRAAFKLRGSKAILNFPLEVSNFRQENNEIEKKVNLNSCGKRAREEIENEDQVVMKKEVKREQMVATPLTPSSWAPIWDCGNAKGIFEVPPLSPLSPHPSFGFSQLLVS

SEQ ID NO: 2325 - protein, 244 aa, Solanum lycopersicum
  misc_feature (1)..(244): useful for making plants with increased tolerance to oxidative stress as described in USSN 12/445,005
  misc_feature (1)..(244): Public GI ID no.45642990
  misc_feature (1)..(244): Score of 388.5 for HMM of FIGURE 3 of USSN 12/445,005.
  misc_feature (103)..(155): Pfam Name: AP2 Pfam Description: AP2 domain
  misc_feature (1)..(244): Functional Homolog Of Ceres SEEDLINE ID no. ME02077
MGSPQETCTSLDLIRQHLFDESLDQTCFSFETTQTSNLDDIASFFNATSKTEYDGFFEFEAKRHVIHSNSPKQSNLRERKPSLNVAIPAKPVVVVENVEIEKKHYRGVRQRPWGKFAAEIRDPNRKGTRVWLGTFDTAVDAAKAYDRAAFKLRGSKAILNFPLEVANFKQQNDETKTETKSSGSKRVRGETEELVIKKERKIEEERVLPTAAAPLTPSSWSTIWDEKGIFEVPPLSPLSQLVMI

SEQ ID NO: 2326 - protein, 281 aa, Arabidopsis thaliana
  misc_feature (1)..(281): useful for making plants with increased tolerance to oxidative stress as described in USSN 12/445,005
  misc_feature (1)..(281): Public GI ID no.3298498
  misc_feature (1)..(281): Score of 677.1 for HMM of FIGURE 3 of USSN 12/445,005.
  misc_feature (135)..(187): Pfam Name: AP2 Pfam Description: AP2 domain
  misc_feature (1)..(281): Functional Homolog Of Ceres SEEDLINE ID no. ME02077
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDWDLTEFLSMPLLSPLSPHPPFGYPQLTVV

SEQ ID NO: 2327 - DNA, 805 bp, Arabidopsis thaliana
  misc_feature (1)..(805): useful for making plants with increased tolerance to oxidative stress as described in USSN 12/445,005
  misc_feature (1)..(805): Ceres CLONE ID no.268310
gtcaaatcaaatccttcttcctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttcatcaaaccggtttcgagttttctgaatttgaaaccaaaccggaaataatcgatctcgtcactcccaaaccggagatttctgatttcgaggtgaaatctgaaatttcaattgaatcgaacgattccttcacgttccaatcgaatcctcctcgtgtcactgttcaatccaatcgaaaaccgccgttgaagatcgcaccaccgaaccgaaccaagtggattcaattcgcaaccggaaatcctaaaccggaacttcccgaaccggttgtagcagcagaagagaagaggcattacagaggagtgaggatgaggccgtggggaaaattcgcggcggagatccgagatccgactcgtcgtggaactcgggtttggcttgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaaacggaagagagacagcgaggaggaggaagtgaaggtggtgaagaaagtgctaaagaaggaggagagttacgccgttagcgacggagagaatgttgagtcaggtttgacggcgatagatgactgg

SEQ ID NO: 2328 - protein, 253 aa, Arabidopsis thaliana
  misc_feature (1)..(253): useful for making plants with increased tolerance to oxidative stress as described in USSN 12/445,005
  misc_feature (1)..(253): Ceres CLONE ID no.268310
  misc_feature (1)..(253): Score of 564.6 for HMM of FIGURE 3 of USSN 12/445,005.
  misc_feature (135)..(187): Pfam Name: AP2 Pfam Description: AP2 domain
  misc_feature (1)..(253): Functional Homolog Of Ceres SEEDLINE ID no. ME02077
MATPNEVSALFLIKKYLLDELSPLPTTATTNRWMNDFTSFHQTGFEFSEFETKPEIIDLVTPKPEISDFEVKSEISIESNDSFTFQSNPPRVTVQSNRKPPLKIAPPNRTKWIQFATGNPKPELPEPVVAAEEKRHYRGVRMRPWGKFAAEIRDPTRRGTRVWLGTFETAIEAARAYDKEAFRLRGSKAILNFPLEVDKWNPRAEDGRGLYKRKRDSEEEEVKVVKKVLKKEESYAVSDGENVESGLTAIDDW

SEQ ID NO: 2329 - protein, 282 aa, Arabidopsis thaliana; identical to SEQ ID NO: 2212
  misc_feature (1)..(282): useful for making plants with increased tolerance to oxidative stress as described in USSN 12/445,005
  misc_feature (1)..(282): Public GI ID no.18414895
  misc_feature (1)..(282): Score of 643.8 for HMM of FIGURE 3 of USSN 12/445,005.
  misc_feature (135)..(187): Pfam Name: AP2 Pfam Description: AP2 domain
  misc_feature (1)..(282): Functional Homolog Of Ceres SEEDLINE ID no. ME02077

SEQ ID NO: 2330 - protein, 282 aa, Arabidopsis thaliana
  misc_feature (1)..(282): useful for making plants with increased tolerance to oxidative stress as described in USSN 12/445,005
  misc_feature (1)..(282): Public GI ID no.17473792
  misc_feature (1)..(282): Score of 640.9 for HMM of FIGURE 3 of USSN 12/445,005.
  misc_feature (135)..(187): Pfam Name: AP2 Pfam Description: AP2 domain
  misc_feature (1)..(282): Functional Homolog Of Ceres SEEDLINE ID no. ME02077
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTMVEKVLKTEESYDVSGGENVESGLTAIDDWDLTEFLSMPLLSPLSPHPPFGYPQLTVV

SEQ ID NO: 2331 - protein, 291 aa, Nicotiana tabacum; identical to SEQ ID NO: 2174
  misc_feature (1)..(291): useful for making plants with increased tolerance to oxidative stress as described in USSN 12/445,005
  misc_feature (1)..(291): Public GI ID no.57012758
  misc_feature (1)..(291): Score of 584.2 for HMM of FIGURE 3 of USSN 12/445,005.
  misc_feature (143)..(195): Pfam Name: AP2 Pfam Description: AP2 domain
  misc_feature (1)..(291): Functional Homolog Of Ceres SEEDLINE ID no. ME02077

SEQ ID NO: 2332 - protein, 282 aa, Nicotiana sylvestris; identical to SEQ ID NO: 2173
  misc_feature (1)..(282): useful for making plants with increased tolerance to oxidative stress as described in USSN 12/445,005
  misc_feature (1)..(282): Public GI ID no.57012874
  misc_feature (1)..(282): Score of 664.3 for HMM of FIGURE 3 of USSN 12/445,005.
  misc_feature (136)..(188): Pfam Name: AP2 Pfam Description: AP2 domain
  misc_feature (1)..(282): Functional Homolog Of Ceres SEEDLINE ID no. ME02077

SEQ ID NO: 2333 - protein, 437 aa, Medicago truncatula
  misc_feature (1)..(437): useful for making plants with increased tolerance to oxidative stress as described in USSN 12/445,005
  misc_feature (1)..(437): Public GI ID no.92871428
  misc_feature (1)..(437): Score of 188.3 for HMM of FIGURE 5 of USSN 12/445,005.
  misc_feature (25)..(424): Pfam Name: Aa_trans Pfam Description: Transmembrane amino acid transporter protein
  misc_feature (1)..(437): Functional Homolog Of Ceres SEEDLINE ID no. ME06123
MVLNPTLPSKKVQSIQKCVDNGPDRQGKWWYSTFHTVTAMIGAGVLSLPYAMAYLGWGPGILMLLLSWCLTLNTMWQMIQLHECVPGTRFDRYIDLGRHAFGPKLGAWIVLPQQLIVQVGCDTVYMVIGGKCLKNFVEMAFISCTQIKQTYWIMIFGGIHFFLSQLPNFNSVSGVSLAASVMSLSYSTIAWVACLSRGRIDNVNYAYKQISKTDLLFRVFSALGQISFAFSGQAVTLEIQATIPSTPEKPSKIPMWKGAICAYLINAICYFPVATLGYWAFGQDVDDNILMSLERPSWLVASANLMVFINVLGSYQVYAMPVFDLIEGTMVRRLNFPPSVALRLVARSAYVAFTLLFGVSFPFFGDLLGFFGGFGFAPTSYFLPSIMWLIIKKPRRFSINWFINWVAICIGVCIMLASTIGGLRNIIVDSSTYSFYT

SEQ ID NO: 2334 - DNA, 1404 bp, Populus balsamifera subsp. trichocarpa
  misc_feature (1)..(1404): useful for making plants with increased tolerance to oxidative stress as described in USSN 12/445,005
  misc_feature (1)..(1404): Ceres ANNOT ID no.1473784
atgaatcaaatgcagccagtaaaggatatctcaagcattgagaatgcaaagaatgacaatgcgaagaaagacatgaatgactggcttcccatcaccaagtctaggaatgcaaagtggtggtattctgcctttcacaatgttacagccatggttggtgctggggtcctgggcctcccatatgccatgtctcaacttggatggggtcccggtgctgctgtattgatcctgtcatgggttatcactctatatacactatggcagatggtggagatgcatgaaatggtgcctggaaagagatttgataggtatcatgagttagggcagcatgcatttggtgaaaaacttgggctttgggtggtggttccccagcaactaatggtggaagtgggttcgagtatagtgtatatgatcactggagggaaatctctgaagaaggctcatgatactatctggcctaactacaaagaaatcaaacttacctatttcatcatgatcttttcctcggttcactttgtcatctctcatctccccagtttcaactccatcaccgttgtctctcttgccgctgccgtcatgtccttgagttactcgactattgcgtgggtggtttcatggcacaaaggggttcaaccagatgtgcagtatacctcaagggcttcaacaaataccgggcagatgttcgacagcttcagtgctctaggagatatagcttttgccttcgcagggcacagtgtggcgttggagatccaggcaacaatcccttccacaccagggaagccttccaagaaaccaatgtggaaaggagtggttgttgcttatcttgttgtcgctttgtgttacttacctgttagtttcgtaggttactgggtgtttggaaacaaagttgaggacaacatactcttatcactagagaagcctcgttggcttgttgccgtcgctaatttgtttgttgtcattcatgtcattggaagctatcaggtttttgcaatgccggtgtttgatatgatggaagcattcctagtcttgaaaatgaatttccaaccgggattgaccatgttcatcgcaatgacattcccattttttggtgggcttctaagtttctttggaggatttgcctttgctcccacctcatactatgtaaggcaccatgttatacatatctatgcttatctttcttgcttcaataaacaatatgcaaagctcaaaatgccgcaattgtttgcaatctctttgcagctcccctgcgtcatttggcttgctatatataaaccaaagaaattcagcttgtcatggctcgcaaattggatatgcattatccttggcgttgtattgatggtattagcccccattggagcattaaggcagataatactacaagccagggacttccagttttactcttga

SEQ ID NO: 2335 - protein, 464 aa, Populus balsamifera subsp. trichocarpa
  misc_feature (1)..(464): useful for making plants with increased tolerance to oxidative stress as described in USSN 12/445,005
  misc_feature (1)..(464): Ceres ANNOT ID no.1473784
  misc_feature (1)..(464): Score of 191.5 for HMM of FIGURE 5 of USSN 12/445,005.
  misc_feature (32)..(451): Pfam Name: Aa_trans Pfam Description: Transmembrane amino acid transporter protein
  misc_feature (1)..(464): Functional Homolog Of Ceres SEEDLINE ID no. ME06123
MQPVKDISSIENAKNDNAKKDMNDWLPITKSRNAKWWYSAFHNVTAMVGAGVLGLPYAMSQLGWGPGAAVLILSWVITLYTLWQMVEMHEMVPGKRFDRYHELGQHAFGEKLGLWVVVPQQLMVEVGSSIVYMITGGKSLKKAHDTIWPNYKEIKLTYFIMIFSSVHFVISHLPSFNSITVVSLAAAVMSLSYSTIAWVVSWHKGVQPDVQYTSRASTNTGQMFDSFSALGDIAFAFAGHSVALEIQATIPSTPGKPSKKPMWKGVVVAYLVVALCYLPVSFVGYWVFGNKVEDNILLSLEKPRWLVAVANLFVVIHVIGSYQVFAMPVFDMMEAFLVLKMNFQPGLTMFIAMTFPFFGGLLSFFGGFAFAPTSYYVRHHVIHIYAYLSCFNKQYAKLKMPQLFAISLQLPCVIWLAIYKPKKFSLSWLANWICIILGVVLMVLAPIGALRQIILQARDFQFYS

SEQ ID NO: 2336 - protein, 450 aa, Arabidopsis thaliana
  misc_feature (1)..(450): useful for making plants with increased tolerance to oxidative stress as described in USSN 12/445,005
  misc_feature (1)..(450): Public GI ID no.7239491
  misc_feature (1)..(450): Score of 128.7 for HMM of FIGURE 5 of USSN 12/445,005.
  misc_feature (37)..(437): Pfam Name: Aa_trans Pfam Description: Transmembrane amino acid transporter protein
  misc_feature (1)..(450): Functional Homolog Of Ceres SEEDLINE ID no. ME06123
MPKYLDQNDEENKGRSTDNNNHRQMDYNDWLPVTASREAKWYYSAFHNVTAMVGAGVLGLPFAMSQLGWGPGLVAIIMSWAITFYSLWQMVQLHEAVPGKRLDRYPELGQEAFGPKLGYWIVMPQQLLVQIASDIVYNVTGGKSLKKFVELLFPNLEHIRQTYYILGFAALQLVLSQSPDFNSIKIVSLLAALMSFLYSMIASVASIAKGTEHRPSTYGVRGDTVASMVFDAFNGIGTIAFAFAGHSVVLEIQATIPSTPEVPSKKPMWKGVVVAYIIVIICYLFVAISGYWAFGAHVEDDVLISLERPAWLIAAANFMVFIHVIGSYQVFAMIVFDTIESYLVKTLKFTPSTTLRLVARSTYVALICLVAVCIPFFGGLLGFFGGLVFSSTSYFLPCIIWLIMKRPKRFSAHWWCSWVAIVTGISIAILAPIGGMRHIILSARTYKLFS

SEQ ID NO: 2337 - protein, 437 aa, Medicago truncatula
  misc_feature (1)..(437): useful for making plants with increased tolerance to oxidative stress as described in USSN 12/445,005
  misc_feature (1)..(437): Public GI ID no.92871429
  misc_feature (1)..(437): Score of 186.7 for HMM of FIGURE 5 of USSN 12/445,005.
  misc_feature (25)..(424): Pfam Name: Aa_trans Pfam Description: Transmembrane amino acid transporter protein
  misc_feature (1)..(437): Functional Homolog Of Ceres SEEDLINE ID no. ME06123
MVSTPSLPSKETQSEQKEVENGPARRAKWWYSTFHTVTAMIGAGVLSLPYAMAYLGWGPGILMLLLSWCLTLNTMWQMIQLHECVPGTRFDRYIDLGRHAFGPKLGAWIVLPQQLIVQVGCDIVYMVIGGKCLKQFVEIACTDCTQIKQSYWIMIFGGIHFFLSQLPNFNSVACVSLAAAVMSLSYSTIAWVACLPRGRIDNVSYAYKPISKTDLLFRVFNALGQISFAFAGHAVTLEIQATIPSTPEKPSKIAMWNGAICAYFINAICYFPVAIIGYWTFGQDVNDNILMSLEKPSWLIASANLMVFIHVVGSYQVYAMPVFDLIERMMMRRLNFPPGVALRLVARSAYVAFTLFFGVTFPFFGDLLGFFGGFGFAPTSYFLPSIMWMIIKKPKKFSINWFINWAGIYIGVCIMLASTVGGLRNIIADSSTYSFYT

SEQ ID NO: 2338 - DNA, 1251 bp, Populus balsamifera subsp. trichocarpa
  misc_feature (1)..(1251): useful for making plants with increased tolerance to oxidative stress as described in USSN 12/445,005
  misc_feature (1)..(1251): Ceres ANNOT ID no.1516369
atgccatccaatgagtcacagaacgatgaagcagcaagagaaaaggccataaatgattggcttccagtcacttcctcgaggaatgccaaatggtggtactcaaccttccacaatgtcactgccatggttggtgctggtgttcttagtctcccctatgccatggctcaacttggatggggaccaggtgttgccatactttttttatcatgggtgatcacgttatacactctatggcaaatggttgaaatgcatgagatggttcctggtaagcgatttgatagataccatgagctagggcaacatgcgtttggagagaagctgggtctctggattgttgtgccacagcaactagttgtacaagttggagtaaacatagtctatatggttaccggaggaaaatcattgaagaagttccatgatttggtttgctccgactgcaaagacatcaggctaacgtacttcatcatgattttcgcttcgcttcagtttgttctggctcatcttcccaatctcaactccattagtgttatctctctggctgcagcagtcatgtccttgagttactccacaattgcctggggagccacccttaataagggtgttcagcctgatgtcgactacagctataaagcgagcactaaaaccggagctgtctttgactttttctctgccttgggtgatatagcttttgcatatgccggtcacaatgtgatcttggagatccaagcaacaattccctctactccagagaagccttccaagaaacccatgtggagaggagccttccttgcatatgttgtcgtcgccatctgctacttcccagttgccttgattggatactggttttttggaaacagcgtggaagacaacattcttatctcactcgagaaaccagcttggcttattgcaactgctaacatgtttgttgtcattcatgttattggaagttatcagatatatgctatggcagtgttcgacatgttggaaactgcattggtgaagaaactccatttttctccttctttcatgcttcgctttgttactcgcacggtatatgttgggttcacaatgattgttggtatatgtattccattcttcggtggcctgctttcgttcttcggaggatttgcttttgccccaacaacatactttgtctgcattgtgcttggaattttgctgatgatattgtcacccattggtgccctaagacatatcatccttacagccaaagactacgagttcttctcatga

SEQ ID NO: 2339 - protein, 416 aa, Populus balsamifera subsp. trichocarpa
  misc_feature (1)..(416): useful for making plants with increased tolerance to oxidative stress as described in USSN 12/445,005
  misc_feature (1)..(416): Ceres ANNOT ID no.1516369
  misc_feature (1)..(416): Score of 152.1 for HMM of FIGURE 5 of USSN 12/445,005.
  misc_feature (27)..(384): Pfam Name: Aa_trans Pfam Description: Transmembrane amino acid transporter protein
  misc_feature (27)..(403): Pfam Name: Aa_trans Pfam Description: Transmembrane amino acid transporter protein
  misc_feature (1)..(416): Functional Homolog Of Ceres SEEDLINE ID no. ME06123
MPSNESQNDEAAREKAINDWLPVTSSRNAKWWYSTFHNVTAMVGAGVLSLPYAMAQLGWGPGVAILFLSWVITLYTLWQMVEMHEMVPGKRFDRYHELGQHAFGEKLGLWIVVPQQLVVQVGVNIVYMVTGGKSLKKFHDLVCSDCKDIRLTYFIMIFASLQFVLAHLPNLNSISVISLAAAVMSLSYSTIAWGATLNKGVQPDVDYSYKASTKTGAVFDFFSALGDIAFAYAGHNVILEIQATIPSTPEKPSKKPMWRGAFLAYVVVAICYFPVALIGYWFFGNSVEDNILISLEKPAWLIATANMFVVIHVIGSYQIYAMAVFDMLETALVKKLHFSPSFMLRFVTRTVYVGFTMIVGICIPFFGGLLSFFGGFAFAPTTYFVCIVLGILLMILSPIGALRHIILTAKDYEFFS

SEQ ID NO: 2340 - protein, 425 aa, Oryza sativa subsp. indica
  misc_feature (1)..(425): useful for making plants with increased tolerance to oxidative stress as described in USSN 12/445,005
  misc_feature (1)..(425): Public GI ID no.125548592
  misc_feature (1)..(425): Score of 124.3 for HMM of FIGURE 5 of USSN 12/445,005.
  misc_feature (22)..(412): Pfam Name: Aa_trans Pfam Description: Transmembrane amino acid transporter protein
  misc_feature (1)..(425): Functional Homolog Of Ceres SEEDLINE ID no. ME06123
MVTSSVLPKVVDDAGEGEANPRRAKWWYATFHSVTAMVGAGVLSLPYAMAHLGWGPGTAALVVSWGMTLYTLRLLIELHECVPGVRFDRYRDLGAHALGPRLGPWLVVPQQLIVQLGCDVVYMVIGGKCLMKFAESVSSWSRAPQLHHQSYWICIFGASQFLLSQLPSLDSITAVSLAAAAMSVGYSTISWAACLARGTPAAAEGGGGGGELRVAFAYAGHGVVLEIQATIPSTPTKPSRGAMWKGAVAAYLVTALCYFPVAIAGYWAFGRDVSDNVLVALRRPPWLVAAANMMVVVHVLGSYQVYAMPIFETLETILITRIRLPPGALLRLVARSAYVAFTLFVAVTFPFFGDLLGFFGGFGFTPTSYFLPCILWLKIKKPPRFSASWFANWGCIVVGVLLMIASTIGGLRSIIQDASTFQFYS

SEQ ID NO: 2341 - DNA, 1155 bp, Populus balsamifera subsp. trichocarpa
  misc_feature (1)..(1155): useful for making plants with increased tolerance to oxidative stress as described in USSN 12/445,005
  misc_feature (1)..(1155): Ceres ANNOT ID no.1517322
atggtttcaacttctccttccaaggaagatcagtccatgagcaaatggacggaaggcgaccctgctcgccgagccaaatggtggtactcaactttccactctgtcacagccatgatcggtgcaggtgttctcagtctgccctatgccatggcttacttaggctggggtccagggataatggtcttagcgttatcctggtgcatgaccttgaacacaatgtggcaaatgatccaactccatgaatgtgttcccgggactcgctttgatcgctacatcgacctaggtcgacatgccttcgggccgaaattgggaccatggattgtcctacctcagcaactgattgttcaagttggttgtgatattgtgtacatggtcacaggaggaaagtgtttaaagaagttcatggagatgacctgcgcctcttgcacaccaataaggcagtcttactggattttgatctttggtggcattcatttcttcttgtcccagcttcctaatttcaattctgttgctggcgtttcactagctgcagcagtcatgtcactcagttattcaaccatagcatgggcaggttctttggctcatggccagattgataatgtgagctatgcttacaaaagcaccagcgcagctgactacatgtttcgtgtcttcaatgcactgggagaaatttcttttgcatttgctggccatgcagttgttcttgaaatccaagctacaattccatcaactcctgagaagccttccaaaataccaatgtggaaaggtgcactgggtgcttactttatcaatgcaatttgctattttcctgttgccattatagggtattgggcatttggacaagatgttgatgataatgtgcttactgatctcaaaagacccgcatggctcatcgcctccgctaatttaatggtggtagttcatgtcattggtagctaccaggtctatgctatgcctgtttttgacatgctagagaggatgatgatgaaaagactcaatttcccaccaggaattgcactaagactcctaactcgctctacttacgttgcatttacactatttgttggagtcaccttcccattctttggagatcttcttggtttctttggtggatttggttttgcccccacttcatattttgtaagcctctcttag

SEQ ID NO: 2342 - protein, 384 aa, Populus balsamifera subsp. trichocarpa
  misc_feature (1)..(384): useful for making plants with increased tolerance to oxidative stress as described in USSN 12/445,005
  misc_feature (1)..(384): Ceres ANNOT ID no.1517322
  misc_feature (1)..(384): Score of 155.0 for HMM of FIGURE 5 of USSN 12/445,005.
  misc_feature (23)..(380): Pfam Name: Aa_trans Pfam Description: Transmembrane amino acid transporter protein
  misc_feature (1)..(384): Functional Homolog Of Ceres SEEDLINE ID no. ME06123
MVSTSPSKEDQSMSKWTEGDPARRAKWWYSTFHSVTAMIGAGVLSLPYAMAYLGWGPGIMVLALSWCMTLNTMWQMIQLHECVPGTRFDRYIDLGRHAFGPKLGPWIVLPQQLIVQVGCDIVYMVTGGKCLKKFMEMTCASCTPIRQSYWILIFGGIHFFLSQLPNFNSVAGVSLAAAVMSLSYSTIAWAGSLAHGQIDNVSYAYKSTSAADYMFRVFNALGEISFAFAGHAVVLEIQATIPSTPEKPSKIPMWKGALGAYFINAICYFPVAIIGYWAFGQDVDDNVLTDLKRPAWLIASANLMVVVHVIGSYQVYAMPVFDMLERMMMKRLNFPPGIALRLLTRSTYVAFTLFVGVTFPFFGDLLGFFGGFGFAPTSYFVSLS

SEQ ID NO: 2343 - DNA, 1953 bp, Populus balsamifera subsp. trichocarpa
  misc_feature (1)..(1953): useful for making plants with increased tolerance to oxidative stress as described in USSN 12/445,005
  misc_feature (1)..(1953): Ceres ANNOT ID no.1459650
atggcttacaacgagtcacggaatgatgcagcagcaaaagagaaggccatagatgattggcttccaatcacttcctctaggaaagccaaatggtggtactcaaccttccacaatgttactgccatggttggtgctggtgtccttagcctcccctatgccatggctcaacttggatggggaccaggaatcgccatacttgttttgtcatgggtgatcacgttgtacactctgtggcaaatggtcgaaatgcatgagatggtgcctggcaagcgatttgacaggtaccatgagctagggcaacatgtgtttggagacaagctgggtctctggattgttgtgccacagcaactaattgttcaagttggagtaaatattgtctacatggttactggaggaaaatcattgaagaagttccatgatgtggtttgccccaactgcaaagacatcaggctaacatacttcatcatgattttcgcctcagttcagatggtactggctcatcttcccaatctcaactccattagtgtaatctcgctggctgcagcagtcatgtccttaagttactctacaattgcttgggctgtcacgcttaacaagggggttcagcctgatgtcgactacagctacaaagcaagaactagaacaggagctttctttgactttatcactgccttgggtgatgtagcttttgcatatgctggtcacaatgtggtcttggagattcaagcaacaatcccttcttctccagagaagccttccaagaaacccatgtggagaggagctttccttgcatatctcgtcgtcgccttctgctacttcccagttgccttgattggatactggtgttatggcaacagcgtggacgacaacattctaatctcactgcagaaaccatcttggcttattgcagctgctaacatgtttgttgtcattcatgttattggaagctaccagatatatgcaattgcagtgttcgacttgctggaaactgcattgcttccaggccactctatttttctatcagcaagcaagctacctgttctgaatacctctgtaagtctgcatctgcaactttgggtgctaaatcttttcttcgacttggttgcttcagggctcacaatgtttgttgctcccctgcgtcatgtggctttccatctacaaaccgaagaggttcggcttctcttggacagcaaattgggtctgcgttatacttggcgttctcttgatgatactgtcacccattggtgccctaaggcatatcatccttacagccaaggactacgaattcttctcatgaacatctttccaaaagcgatcacaagggcagggcaaatttggagagagggtatcaacaattattttgctggttgtgccctcagcaggaaactcgaatttaacaattctggaatttatgttagggtttctcttcataaccatcaacatgatatgcaaatccatcattgcctaggtctttctttctgtataagttacaatctgaagccatcatccatcgtctcaagctgggagatttactatctcaataggcaactctatgaatcgacagatcaaaatggtgaaatggatgggtttttgttgcgcttgcaaaatgaactgaaagaagctgttgttaaagaggaacccagtctgcatatctatccaagcaaagatgtggacatgatcttgaattatgatgaagaagatttgaaagaagaaatccccagcactccaacagacaaatctctaaaactctacttggagccatctgattcaacatccaaattgcgtgtaaatggctattcttttgggaaaccgtcagaacatgtgacaccctttggacgatgtactgataagtttgtggtcaaattcaacattgataacctttcagatgtggagaacgatgatgatgagcatggccatgggaaacttgaggatgaaattattaagagggcttaa

SEQ ID NO: 2344 - protein, 650 aa, Populus balsamifera subsp. trichocarpa
  misc_feature (1)..(650): useful for making plants with increased tolerance to oxidative stress as described in USSN 12/445,005
  misc_feature (1)..(650): Ceres ANNOT ID no.1459650
  misc_feature (1)..(650): Score of 123.6 for HMM of FIGURE 5 of USSN 12/445,005.
  misc_feature (27)..(330): Pfam Name: Aa_trans Pfam Description: Transmembrane amino acid transporter protein
  misc_feature (1)..(650): Functional Homolog Of Ceres SEEDLINE ID no. ME06123
MAYNESRNDAAAKEKAIDDWLPITSSRKAKWWYSTFHNVTAMVGAGVLSLPYAMAQLGWGPGIAILVLSWVITLYTLWQMVEMHEMVPGKRFDRYHELGQHVFGDKLGLWIVVPQQLIVQVGVNIVYMVTGGKSLKKFHDVVCPNCKDIRLTYFIMIFASVQMVLAHLPNLNSISVISLAAAVMSLSYSTIAWAVTLNKGVQPDVDYSYKARTRTGAFFDFITALGDVAFAYAGHNVVLEIQATIPSSPEKPSKKPMWRGAFLAYLVVAFCYFPVALIGYWCYGNSVDDNILISLQKPSWLIAAANMFVVIHVIGSYQIYAIAVFDLLETALLPGHSIFLSASKLPVLNTSVSLHLQLWVLNLFFDLVASGLTMFVAPLRHVAFHLQTEEVRLLLDSKLGLRYTWRSLDDTVTHWCPKAYHPYSQGLRILLMNIFPKAITRAGQIWREGINNYFAGCALSRKLEFNNSGIYVRVSLHNHQHDMQIHHCLGLSFCISYNLKPSSIVSSWEIYYLNRQLYESTDQNGEMDGFLLRLQNELKEAVVKEEPSLHIYPSKDVDMILNYDEEDLKEEIPSTPTDKSLKLYLEPSDSTSKLRVNGYSFGKPSEHVTPFGRCTDKFVVKFNIDNLSDVENDDDEHGHGKLEDEIIKRA

SEQ ID NO: 2345 - protein, 414 aa, Oryza sativa subsp. japonica
  misc_feature (1)..(414): useful for making plants with increased tolerance to oxidative stress as described in USSN 12/445,005
  misc_feature (1)..(414): Public GI ID no.125593423
  misc_feature (1)..(414): Score of 136.9 for HMM of FIGURE 5 of USSN 12/445,005.
  misc_feature (38)..(401): Pfam Name: Aa_trans Pfam Description: Transmembrane amino acid transporter protein
  misc_feature (1)..(414): Functional Homolog Of Ceres SEEDLINE ID no. ME06123
MSATEVMEECTETARERREEERLRNVNLDDWLPITSSRTAKWYYSAFHNVTAMVGAGVLGLPFAMSQLGWPTGVAAIASSFAITLYTLWQLVGTDIVYMVTGGQTLKKFVELACDGRCADIRLTFYIMMFASAQFVLSQCPNFNSISAVSAAAAAMSLCYSMIAFFASVLKAHPAAAAAVDYGFKGTTAAGRVFGAFNALGAVSFAFAGHNVVLEIQATIPSTPERPSKRPMWRGVVVAYAVVALCYFTVAFGGYHAFGNAVAPNVLISLEKPRWLVAAANLMVVVHVIGAYQVYAMPVFDMIETVLAKKLHLRPGLPLRVTARSAYVALTMFIGITFPFFDGLLGFFGGFGFAPTTYFIPCIIWLIMRKPAKYSLSWLMNWCFIIIGMLLMLVSPIGGLRQIILDASKYKFYS

SEQ ID NO: 2346 - DNA, 2245 bp, Panicum virgatum
  misc_feature (1)..(2245): useful for making plants with increased tolerance to oxidative stress as described in USSN 12/445,005
  misc_feature (1)..(2245): Ceres CLONE ID no.1796001
acagctctactacctctcctaccccctcctccacctctgtggtctctagctacctccctctccattgctcaagtcgccgcggcatccattgccatggcagtccagccgtccatggagacgcaagcgcccgggaattcttctccacccaaggatggcaggagcgccgaggagaaggctgtggaggactggctcccgatcaacgcgtcgcggaacgccaagtggtggtactcggcgttccacaatgtcacggccatggtcggcgctggcgtgctcggcctcccctacgccatgtccgagctcggctggggcgccggcatcgccgtgctggtcctgtcgtgggtcatcactctgtacacgctgtggcagatggtggagatgcacgagatggtgccgggccggcggttcgaccggtaccacgagctcgggcagtacgccttcggcgagaagttgggcctctggatcgtcgtgccgcagcagctgatcgtggaggtgggcgtgaacatcgtgtacatggtcaccgggggcacctcgctcaagaagttccacgacaccgtctgcgaagactgcaagagcatcaagctcacctacttcatcatgatcttcgcctccgtccacttcgtgctctcccagctccccaacttcaactccatctccggcgtctccctcgccgccgccgtcatgtcgctcagttactccacgatcgcgtggggcgcgtcggtggacaaggggaagctggaggacgtggactacagcctgcgggcgacgacgacgccggggaaggtgttcggcttcctaggggcgctggggaccgtggcgttcgcgtacgcggggcacaacgtggtgctggagatccaggccaccatcccgtcgacgccggagaagccatccaagaaacccatgtggaggggcgtcgtcgtcgcctacatcgtcgtcgcggtgtgctacttccccgtctcgctcgtcggctactgggccttcggcaacagagttgacagcgacatcctcatcacgctctccaggccaaagtggctcatcgccctcgccaacttgatggtcgtcatccatgtcatcggcagctaccagatttacgcgatgccggtgttcgacatgatagagacggtgctggtgaagagactaaaattccctccaggcctgacgctccggctgattgctcggactgtctatgtcgcgttcacaatgttcatagcaatcaccttccctttctttgatggactgctcagtttctttggtggatttgcattcgcaccgactacctatttccttccgtgcattatgtggcttgcaatctacaaaccgaaaaggttcagcctatcatggttcactaactggatttgcattgttcttggagtgctgctgatggtactggcgccaattggaggactccggaatatcattctgaatgcaaagacatacaaattctaccagtaaacatgattagctaacacaaacaccttgttttgacctacagttaacaggactgcagaatgtctcggatcatcatcagctgaaaccagttctggatttgatacagcgtgacactacaatttttttggcaccacaaaaaactcgtattaagtggtgcaaggaaaccgactactgtgtctaatatgagccttttggaaagaaaaaatgggaatgccatggcatcaatacaaatttggaacatgtttcagttgatgacgcctcttgacatgtcctgttagtgttaaactaggaatttgagctgagttaaacatataatattcttgggcaatttttgcttttatgcgcatagactagggagaacaaatcctggtggtttgtttttcttccatccaaagttcactaatgttttggagttggaagtttgaaatagtgccaagaatatgttatttgggacttgagatttggccttttcatttcatttcattcctactactacatagtaatgtttcttctactcagctatccattggcttcatacttggactatcctacggaagacagcttagtggatttggttgcagctgttttgcccttgtggtcaaagagtgttttacccaggaatatgatggtggtcagtcttcggattgatagctattagcatgcatgtactcttttgtttcttttttattttctatcctccaagatcttgtatcatcttgatgtaaattggaaattaataatatttttcttataataaaacacaccaatctttctttcttaaaaaaaaaaaaaaaaaaaa

SEQ ID NO: 2347 - protein, 451 aa, Panicum virgatum
  misc_feature (1)..(451): useful for making plants with increased tolerance to oxidative stress as described in USSN 12/445,005
  misc_feature (1)..(451): Ceres CLONE ID no.1796001
  misc_feature (1)..(451): Score of 295.3 for HMM of FIGURE 5 of USSN 12/445,005.
  misc_feature (39)..(438): Pfam Name: Aa_trans Pfam Description: Transmembrane amino acid transporter protein
  misc_feature (39)..(438): Pfam Name: Aa_trans Pfam Description: Transmembrane amino acid transporter protein
  misc_feature (1)..(451): Functional Homolog Of Ceres SEEDLINE ID no. ME06123
MAVQPSMETQAPGNSSPPKDGRSAEEKAVEDWLPINASRNAKWWYSAFHNVTAMVGAGVLGLPYAMSELGWGAGIAVLVLSWVITLYTLWQMVEMHEMVPGRRFDRYHELGQYAFGEKLGLWIVVPQQLIVEVGVNIVYMVTGGTSLKKFHDTVCEDCKSIKLTYFIMIFASVHFVLSQLPNFNSISGVSLAAAVMSLSYSTIAWGASVDKGKLEDVDYSLRATTTPGKVFGFLGALGTVAFAYAGHNVVLEIQATIPSTPEKPSKKPMWRGVVVAYIVVAVCYFPVSLVGYWAFGNRVDSDILITLSRPKWLIALANLMVVIHVIGSYQIYAMPVFDMIETVLVKRLKFPPGLTLRLIARTVYVAFTMFIAITFPFFDGLLSFFGGFAFAPTTYFLPCIMWLAIYKPKRFSLSWFTNWICIVLGVLLMVLAPIGGLRNIILNAKTYKFYQ

SEQ ID NO: 2348 - protein, 447 aa, Oryza sativa subsp. japonica
  misc_feature (1)..(447): useful for making plants with increased tolerance to oxidative stress as described in USSN 12/445,005
  misc_feature (1)..(447): Public GI ID no.115474609
  misc_feature (1)..(447): Score of 294.3 for HMM of FIGURE 5 of USSN 12/445,005.
  misc_feature (33)..(434): Pfam Name: Aa_trans Pfam Description: Transmembrane amino acid transporter protein
  misc_feature (1)..(447): Functional Homolog Of Ceres SEEDLINE ID no. ME06123
MGTQVADNYPPAKDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 2349 - DNA, 1695 bp, Triticum aestivum
  misc_feature (1)..(1695): useful for making plants with increased tolerance to oxidative stress as described in USSN 12/445,005
  misc_feature (1)..(1695): Ceres CLONE ID no.684177
atatctctctctttcgctctctctctctgcacatcctcctctcgcacatctccctctgtttactctccattgctcaaggcaaggccggccggcagaacatggggacgcaggcagcggagaacttcgaaccgccggccaaggatgtcaggacggatgagcagaagaagatcgacgactggctcccgatcacgtcgtcgaggaacgccaagtggtggtactcggccttccacaatgtcaccgccatggtgggcgcgggggtgctcagcctcccctacgccatgtccgagctcggctggggccctggcatcgcggtgctgatcatctcgtgggtgatcacgctctacacgctgtggcagatggtggagatgcacgagatggtgcccgggaagcggttcgacaggtaccacgagctcgggcagcacgccttcggcgacaagctggggctgtggatcgtggtgccgcagcagctgatcgtggaggtgggcgtaaacatcgtgtacatggtgaccggcgggaggtcgctcaagaagttccacgacgtgatctgcgacggcaagtgcaaggacatcaagctcaccttcttcatcatgatcttcgcgtcggtgcacttcgtgctctcgcagctcccaaacttgaactccatctccggcgtgtccctggccgccgccgtcatgtcgctgtcctactcgaccatcgcgtggggcgcgtcggtggacaaggggaagatggtggacgtggactacaacctccgcgccaccacgacgccggggaaggtgttcggcttcttcggggcgctgggcgaggtggcgttcgcgtacgccggccacaacgtggtgctggagatccaggccaccatcccgtccacgccggagaagccgtccaagaagcccatgtggaagggcgtggtggtggcctacatcgtcgtcgcgctctgctacttccccgtcgccctcatcggctactgggccttcggcaacagcgtcgacgacaacatcctcatcaccctcaacaagcccacctggctcatcgccaccgccaacatgatggttgtcatccatgtcatcggaagctaccagatttacgcgatgccggtgttcgacatgatcgagacggtgctggtgaagaagctcaagttccctcccggcctcacgctccgcttgattgcccggaccctctatgttgcgttcaccatgttcgtcgccatcaccttccctttcttcggtggcctgctcggattcttcggcgggttcgcctttgcgccgaccacatacttcctcccctgtatcatgtggctcgccatctacaagcccaaaagattcagcctctcatggttcaccaactgggtctgcatcgtccttggggtgtgcctgatgatcctgtcgccaatcggagggctcagacagatcatcttggattccaagacatacaagttctactcatagacttcatccacgacgcattttgtgtagtgaaaactgcaagagatcttttacgatgtctactacaaactctcttgtcttgcaaaggaaaaaagaaaggaacatcatagtaccacggttacagatgggatggtacttggtagatgcatatggtcagagaaaacttggtttagtcaaagcaaaagggttgtgtttgtggttaatcatgtacgtaatatatatggtgtgtggatttgacacaaaaaaaaaaaaaaaa

SEQ ID NO: 2350 - protein, 447 aa, Triticum aestivum
  misc_feature (1)..(447): useful for making plants with increased tolerance to oxidative stress as described in USSN 12/445,005
  misc_feature (1)..(447): Ceres CLONE ID no.684177
  misc_feature (1)..(447): Score of 295.1 for HMM of FIGURE 5 of USSN 12/445,005.
  misc_feature (34)..(434): Pfam Name: Aa_trans Pfam Description: Transmembrane amino acid transporter protein
  misc_feature (34)..(434): Pfam Name: Aa_trans Pfam Description: Transmembrane amino acid transporter protein
  misc_feature (1)..(447): Functional Homolog Of Ceres SEEDLINE ID no. ME06123
MGTQAAENFEPPAKDVRTDEQKKIDDWLPITSSRNAKWWYSAFHNVTAMVGAGVLSLPYAMSELGWGPGIAVLIISWVITLYTLWQMVEMHEMVPGKRFDRYHELGQHAFGDKLGLWIVVPQQLIVEVGVNIVYMVTGGRSLKKFHDVICDGKCKDIKLTFFIMIFASVHFVLSQLPNLNSISGVSLAAAVMSLSYSTIAWGASVDKGKMVDVDYNLRATTTPGKVFGFFGALGEVAFAYAGHNVVLEIQATIPSTPEKPSKKPMWKGVVVAYIVVALCYFPVALIGYWAFGNSVDDNILITLNKPTWLIATANMMVVIHVIGSYQIYAMPVFDMIETVLVKKLKFPPGLTLRLIARTLYVAFTMFVAITFPFFGGLLGFFGGFAFAPTTYFLPCIMWLAIYKPKRFSLSWFTNWVCIVLGVCLMILSPIGGLRQIILDSKTYKFYS

SEQ ID NO: 2351 - protein, 441 aa, Oryza sativa subsp. indica
  misc_feature (1)..(441): useful for making plants with increased tolerance to oxidative stress as described in USSN 12/445,005
  misc_feature (1)..(441): Public GI ID no.30409136
  misc_feature (1)..(441): Score of 286.6 for HMM of FIGURE 5 of USSN 12/445,005.
  misc_feature (27)..(428): Pfam Name: Aa_trans Pfam Description: Transmembrane amino acid transporter protein
  misc_feature (1)..(441): Functional Homolog Of Ceres SEEDLINE ID no. ME06123
MAKQWWQDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 2352 - DNA, 1776 bp, Gossypium hirsutum
  misc_feature (1)..(1776): useful for making plants with increased tolerance to oxidative stress as described in USSN 12/445,005
  misc_feature (1)..(1776): Ceres CLONE ID no.1952071
actgggaacaaatataaaggcgacccagaatgctccattattccttcttttcagtttcaggtgcacagtgaaacacaaggctttcactttttgcattttcaaatgatggatgagcggcctgagacagagttgatatccattccagcaacgccgcgagtgtcaacaccggagatacaaacgccgtcggggcagaggtcgccgaggccagccgggcagaagtcgtcgacagcatggactccaacgtcgtttatatctcccaggtttttgagtccgatagggactccaatgaagaaggttttgatcaatatgaaaggttacttggaagaagtgggtcatctcactaagcttaaccctcaagatgcttggcttcccatcactgaatcacgcaatgggaacgctattacgccgcgtttcataacctgaatgctggggttgggttccaagctttggtcttgcctgttgcttttgcttttctaggctggagttggggtatattgtcgttaactattgcctactgttggcaactttacaccttatggattctggttcagttgcatgaagctgtcccaggaaagagatacaatagatatgtggagctcgcacaagctgcttttggagaaagattaggtgtttggcttgctctcttccctacagtttatttatcagcgggaactgcgacagctttgattctcataggaggggagaccatgaaactgttcttccaggttgtctgtggtcctctctgttcatcaaatcctctgacgacggttgagtggtatctggtgttcacgtcattgtgcattgtcctgtctcagctccccaatcttaattcaattgcagggctctctcttgtaggagccatcacagccatcacttactccactatggtgtgggtgctctctgttagccaacaaaggccacccacaatctcttatgaacctctctcactgccatcctcttctgcagctctcttctcagtcatgaatgcacttggaatcgtagccttcgcattcagaggccataatttagttttagagatccaggcaacaatgccatcaacattcaaaaatccagctcatgtgcccatgtggagaggagccaaggttgcttatttcttcattgccatgtgccttttccctgttgccattggaggcttttgggcttacggaaaccttatgccttcaggagggattctgaatgcactttatgcatttcacagtcacagcattccaaggggactccttgccctcacttttcttcttgtggtattcaactgtctcagcagtttccaaatatattcaatgccggctttcgacagctttgaggctggatatactagccgtacgaatcgcccttgctcgatctgggttcgttctggttttcgtgttttctacggatttgtgtccttcttcataggggtggcactcccattcctttcaagccttgctggactgttaggaggactcacccttccagttacatttgcttatccttgtttcatgtgggttctaataaaaaggcctccgaaatacagcttcaactggtacttcaattggatcctgggttggttgggtgttgccttcagcctggccttctctattggtggcatttggagcatagtgaacaatggactcaagttgaagttcttcaagcccaattaagaagaaaaaaaaaaagacacttccttatatatataaaatctatatatgtactattgtgatgcaaagttcaaatcgaatgatatatagtttcctccaaaaaaaaaaaaaaaaaaaa

SEQ ID NO: 2353 - protein, 317 aa, Gossypium hirsutum
  misc_feature (1)..(317): useful for making plants with increased tolerance to oxidative stress as described in USSN 12/445,005
  misc_feature (1)..(317): Ceres CLONE ID no.1952071
  misc_feature (1)..(317): Score of 370.4 for HMM of FIGURE 5 of USSN 12/445,005.
  misc_feature (23)..(306): Pfam Name: Aa_trans Pfam Description: Transmembrane amino acid transporter protein
  misc_feature (1)..(317): Functional Homolog Of Ceres SEEDLINE ID no. ME06123
MKLFFQVVCGPLCSSNPLTTVEWYLVFTSLCIVLSQLPNLNSIAGLSLVGAITAITYSTMVWVLSVSQQRPPTISYEPLSLPSSSAALFSVMNALGIVAFAFRGHNLVLEIQATMPSTFKNPAHVPMWRGAKVAYFFIAMCLFPVAIGGFWAYGNLMPSGGILNALYAFHSHSIPRGLLALTFLLVVFNCLSSFQIYSMPAFDSFEAGYTSRTNRPCSIWVRSGFRVFYGFVSFFIGVALPFLSSLAGLLGGLTLPVTFAYPCFMWVLIKRPPKYSFNWYFNWILGWLGVAFSLAFSIGGIWSIVNNGLKLKFFKPN

SEQ ID NO: 2354 - protein, 444 aa, Oryza sativa subsp. indica
  misc_feature (1)..(444): useful for making plants with increased tolerance to oxidative stress as described in USSN 12/445,005
  misc_feature (1)..(444): Public GI ID no.125536241
  misc_feature (1)..(444): Score of 247.5 for HMM of FIGURE 5 of USSN 12/445,005.
  misc_feature (27)..(431): Pfam Name: Aa_trans Pfam Description: Transmembrane amino acid transporter protein
  misc_feature (1)..(444): Functional Homolog Of Ceres SEEDLINE ID no. ME06123
MAPPSAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLVVEVGVCIVYMVTGGKSLKKFHDLVAPPSAPPIRTSYFIVIFGCLHLVLSQLPNFNSITGVSLAAAVMSLSYSTIAWAASLHHRNHNNGAAAVDYSLTAATPAGRTFNFLSALGDVAFAYAGHNVVLEIQATIPSTPERPSKGPMWRGVVLAYGVVAVCYLPVAFAGYYVFGNAVDDNVLITLERPAWLIAAANMFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 2355 - protein, 453 aa, Arabidopsis thaliana
  misc_feature (1)..(453): useful for making plants with increased tolerance to oxidative stress as described in USSN 12/445,005
  misc_feature (1)..(453): Public GI ID no.22330117
  misc_feature (1)..(453): Score of 251.0 for HMM of FIGURE 5 of USSN 12/445,005.
  misc_feature (41)..(440): Pfam Name: Aa_trans Pfam Description: Transmembrane amino acid transporter protein
  misc_feature (1)..(453): Functional Homolog Of Ceres SEEDLINE ID no. ME06123
MYIQMTDGVPPPPEQSSLDHRIDELERQKEIDDWLPITSSRNAKWWYSTFHNVTAMVGAGVLGLPFFMAQLGWGPGIAVLILSWIITLYTLWQMVEMHEMVPGKRFDRYHELGQFAFGERLGLYIIVPQQIIVEVGVCIVYMVTGGQSLKKFHEIACQDCSPIRLSFFIMIFASSHFVLSHLPNFNSISGVSLVAAVMSLSYSTIAWTATAAKGVQEDVQYGYKSGTTASTVLSFFTGLGGIAFAYAGHNVVLEIQATIPSTPSNPSKGPMWRGVVVAYVVVALCYFPVALVGYGVFGNAVLDNVLMSLETPVWAIATANLFVVMHVIGSYQIFAMPVFDMVETFLVKKLNFKPSTVLRFIVRNVYVALTMFIGIMIPFFGGLLAFFGGFAFAPTSYFLPCIMWLLIYKPKRFSLSWWTNWVCIVLGVVLMILSSIGGLRQIIIQSKDYSFFS

SEQ ID NO: 2356 - protein, 809 aa, Arabidopsis thaliana
  misc_feature (1)..(809): useful for making plants with increased tolerance to oxidative stress as described in USSN 12/445,005
  misc_feature (1)..(809): Public GI ID no.12597815
  misc_feature (1)..(809): Score of 258.5 for HMM of FIGURE 5 of USSN 12/445,005.
  misc_feature (134)..(184): Pfam Name: Peroxin-3 Pfam Description: Peroxin-3
  misc_feature (397)..(796): Pfam Name: Aa_trans Pfam Description: Transmembrane amino acid transporter protein
  misc_feature (1)..(809): Functional Homolog Of Ceres SEEDLINE ID no. ME06123
MGEGKMEHRRKVLVTAGCLGSGYLLYKLYNSHTRRLADLERELAHERENDEIIKTQLSSVLIKTDPLDFSSYGFSNGPVLFVLLFRMKAHFESIQMIVDSTTLPHAMQFLSIRISEEIDVSHVMDRLNQGKGMLSPPEKLQLWDELKILSFTRMVLSLWSVTMLSLYIRVQVNILGRHLYVDTARALGSSHLLEEVDLIDRDDEQKFLSSADFLVTNAMPSLISDMQGSAEEVLKGKQLKDVITTRVLQETVMQIVDVFMSTGSPHHWVDYLMMPQDTKLSRTTSDSSDEAVSKFHQLMVETREVLISTEFTNIVEISLKCFTDVLVEEMETQTEAGGLATGKPLAKVLPQIEKTMNVITAEPSKNRFLQIIRDLPEIDELERQKEIDDWLPITSSRNAKWWYSTFHNVTAMVGAGVLGLPFFMAQLGWGPGIAVLILSWIITLYTLWQMVEMHEMVPGKRFDRYHELGQFAFGERLGLYIIVPQQIIVEVGVCIVYMVTGGQSLKKFHEIACQDCSPIRLSFFIMIFASSHFVLSHLPNFNSISGVSLVAAVMSLSYSTIAWTATAAKGVQEDVQYGYKSGTTASTVLSFFTGLGGIAFAYAGHNVVLEIQATIPSTPSNPSKGPMWRGVVVAYVVVALCYFPVALVGYGVFGNAVLDNVLMSLETPVWAIATANLFVVMHVIGSYQIFAMPVFDMVETFLVKKLNFKPSTVLRFIVRNVYVALTMFIGIMIPFFGGLLAFFGGFAFAPTSYFLPCIMWLLIYKPKRFSLSWWTNWVCIVLGVVLMILSSIGGLRQIIIQSKDYSFFS

SEQ ID NO: 2357 - protein, 446 aa, Oryza sativa subsp. japonica
  misc_feature (1)..(446): useful for making plants with increased tolerance to oxidative stress as described in USSN 12/445,005
  misc_feature (1)..(446): Public GI ID no.115488002
  misc_feature (1)..(446): Score of 248.8 for HMM of FIGURE 5 of USSN 12/445,005.
  misc_feature (27)..(433): Pfam Name: Aa_trans Pfam Description: Transmembrane amino acid transporter protein
  misc_feature (1)..(446): Functional Homolog Of Ceres SEEDLINE ID no. ME06123
MAPPSAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLVVEVGVCIVYMVTGGKSLKKFHDLVAPPSAPPIRTSYFIVIFGCLHLVLSQLPNFNSISGVSLAAAVMSLSYSTIAWAASLHHHNHNNGAAAGGVDYSLTEATPAGRTFNFLSALGDVAFAYAGHNVVLEIQATIPSTAERPSKGPMWRGVVLAYGVVAVCYLPVAFAGYYVFGNAVDDNVLITLERPAWLIAAANMFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 2358 - protein, 552 aa, Oryza sativa subsp. japonica
  misc_feature (1)..(552): useful for making plants with increased tolerance to oxidative stress as described in USSN 12/445,005
  misc_feature (1)..(552): Public GI ID no.125579355
  misc_feature (1)..(552): Score of 637.6 for HMM of FIGURE 5 of USSN 12/445,005.
  misc_feature (418)..(540): Pfam Name: Aa_trans Pfam Description: Transmembrane amino acid transporter protein
  misc_feature (1)..(552): Functional Homolog Of Ceres SEEDLINE ID no. ME06123
MAMAVEGAGAGVVVSEPEVVSIPPTPRGMSTPDGTATPPPAAGRGAATPARRVVEGLRGYLEEVGHLTRLNPQDAWLPITESRSGNARYAAFHTLNAGLGFQALLLPLAFPALGWSGTFPLLASSVSSSSLLLALAISLSFFLSFSFRCELMQMRCGFSEKCNSFTFGFTARMRSWGIISLTVAYFWQLYTLWILVKLHEAVPGRRYNRYVELAQAAFAQVIIASGYTKLRTCNVAKILSADLIHLTGEKLGMWLSLFPTIYLSAGSATALILVGGETMKLFYQIVCGPICSPSPISTIEWYLVFTSLAIVLSQLPNLNSIAGVSLIGGTTAITYCTMSWVLSVSQPQPPTVSYEPQAYTSLGSSLFSTLNALGIIAFAFRGHNLALEIQVPQGGMLTALYAFHSHDIPRGLLAATFLLVVFNCLSSFQIYSMPVFDSFEAAYTGRTNRPCSVWVRSGFRVFYGFLSLFISVALPFLSSLAGLLGGLTLPVTFAYPCFMWICIKKPERFSSGWYLNWGLGLLGTAFSLALCVGGVWSIISSGMKFKFFKPPS

SEQ ID NO: 2359 - protein, 462 aa, Nicotiana sylvestris
  misc_feature (1)..(462): useful for making plants with increased tolerance to oxidative stress as described in USSN 12/445,005
  misc_feature (1)..(462): Public GI ID no.976402
  misc_feature (1)..(462): Score of 202.5 for HMM of FIGURE 5 of USSN 12/445,005.
  misc_feature (32)..(435): Pfam Name: Aa_trans Pfam Description: Transmembrane amino acid transporter protein
  misc_feature (1)..(462): Functional Homolog Of Ceres SEEDLINE ID no. ME06123
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 2360 - DNA, 1350 bp, Populus balsamifera subsp. trichocarpa
  misc_feature (1)..(1350): useful for making plants with increased tolerance to oxidative stress as described in USSN 12/445,005
  misc_feature (1)..(1350): Ceres ANNOT ID no.1493584
atgggtactcaagttcctgataatcaaaaacctgatgtccccgaggaattatcagaagcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcagatatatgcaattccagtatttgacatgctagaaacattgctggtaaagaagttgcatttcaggccttccagaaagcttcgattcattacacgcaatatatatgttgcgtttacaatgttcgttggcatctgcttccctttctttggtggtcttctgggattcttcggaggatttgcttttgccccaacaacttactttctaccttgtatcatgtggctggccatctacaaaccaaagaggttcagcttatcatggatcaccaactggatctgcattatacttggctttttattgatgattttgtcacctattggagggttgcggactatcatactaaatgccaagggctacaaatttttctcttga

SEQ ID NO: 2361 - protein, 449 aa, Populus balsamifera subsp. trichocarpa
  misc_feature (1)..(449): useful for making plants with increased tolerance to oxidative stress as described in USSN 12/445,005
  misc_feature (1)..(449): Ceres ANNOT ID no.1493584
  misc_feature (1)..(449): Score of 239.0 for HMM of FIGURE 5 of USSN 12/445,005.
  misc_feature (37)..(436): Pfam Name: Aa_trans Pfam Description: Transmembrane amino acid transporter protein
  misc_feature (1)..(449): Functional Homolog Of Ceres SEEDLINE ID no. ME06123
MGTQVPDNQKPDVPEELSEADRRKKEIDDWLPITSSRNAKWWYSAFHNVTAMVGAGVLSLPYAMANLGWGPGTVILVLSWTITLYTLWQMVEMHEMVPGKRFDRYHELGQHAFGEKLGLYIVVPQQLICEVGVDIVYMVTGGKSLQKIHNLVCKDCAPIKLTYFIMIFASVHFVLSHLPNFNSISGVSLAAAVMSLSYSTIAWSASVHKGVQPDVDYGYKASTTSGTVFNFFSALGDVAFAYAGHNVVLEIQATIPSKPGKPSKGPMWKGVVVAYIVVALCYFPVALIGYYMFGNKVEDNILISLEKPTWLIVAANMFVVIHVIGSYQIYAIPVFDMLETLLVKKLHFRPSRKLRFITRNIYVAFTMFVGICFPFFGGLLGFFGGFAFAPTTYFLPCIMWLAIYKPKRFSLSWITNWICIILGFLLMILSPIGGLRTIILNAKGYKFFS

SEQ ID NO: 2362 - DNA, 2007 bp, Zea mays
  misc_feature (1)..(2007): useful for making plants with increased tolerance to oxidative stress as described in USSN 12/445,005
  misc_feature (1)..(2007): Ceres CLONE ID no.1571117
aactatgacccctgctgcctttccatcttcctcgatctccctagctcgctctccaatctcccatttctctctctctctctctcgtcttcgccatccaccatccatcccgtcgtcgtgatagatggcggcagtccagccgtccgtggagatgacgacgcagcaagggccgccagccgccagctattctccggccagggatggcggcggcggcaggagcgccgaggatgaggagaaggagaaggcggcggcgatcgacaactggcttcccatcagcgcgacgcggaatgccaagtggtggtactccgccttccacaacgtcacggccatggtcggcgccggcgtgctcggcctcccctacgccatgtcccagctcggctggggtgccggcatcacgatcatgctcctgtcgtgggtgatcacgctgtacacgctgtggcagatggtggagatgcacgagatggtgccggggaagcggttcgaccggtaccacgagctggggcagcacgcgttcggggaccgcctgggcctgtggatcgtggtgccgcagcagctggtcgtcgaggtgggggtgaacatcgtgtacatggtgaccggcggcacgtcgctgcagaagttccacgacgtgctggtgtgcggcgacgcggcgtgcgagggcgggcgcaagatcaggctcacctacttcatcatgatcttcgcgtcctgccacttcgtgctggcgcagctgcccaacttcgactccatctccggcgtgtccctggccgccgccgtcatgtcgctcagctactccaccatcgcgtggggcgcgtccgtgagcaaagggcgggtccccgacgtggactacggcctcagggccaccacgccgccgggcaaggtgttcgggttcctgggcgcgctcgggaccgtggcgttcgcctacgcgggccacaacgtggtgctggagatccaggccactatcccgtccactcccgagaagccgtccaagaagcccatgtggaagggcgtcgtcgtcgcctacctcgtcgtcgcgctctgctacttccccgtctcgttcgtcggctactgggccttcggcgacagcgtcgacggcgacatcctcgtcacccttaacagacccaggtggctcatcgccctcgccaacatgatggtcgtcatccatgtcattggcagctaccagatctatgcgatgcccgtgttcgacatgatagagacggtgctggtgaagaagctgcgcttccctccaggcctcacgctccgtctcattgcccgtactgtctacgttgcgttcacaatgttcatagccatcacgtttcccttcttcgacgggctgctcagcttcttcggcggattcgcgttcgcgcccacaacctatttccttccatgcatcatgtggctcgcaatctacaagcccaaacggttcagcctctcatggttcaccaactggatctgcatcatccttggagtgcttctgatggtgctggcgccgattggagggctccggcagatcattatcagcgccaagacatacaagttttaccagtaaacattgcacaattatcgtgcaaaaaacaacgcaaaccccttgcttcaccagtaactgacagacaagtcttgttaggccatatataccatgttacgatcagctgacacaggttctggattttgttccatgagggcttccaactccttgtttaatttggcacgacaaaaagctcgcaccgggtgctctaatcggcggccgattacagcgtccagtgcgagttctttgccgtgccaaaattgaaagggggtcggctcggatgccggggcatgcatacaggacctagaacccgtttcggttgatgagaatgttcctggcatgtaatgcttcccttgttggttgtggtctaacctaggagtttgctttgagtggatctttgtacaattgtacgtgtatatgatgtttttttcccttcttcatacttgtttacattattcaggggaattggatcttaaaaaaaaaaaaaaaaa

SEQ ID NO: 2363 - protein, 463 aa, Zea mays
  misc_feature (1)..(463): useful for making plants with increased tolerance to oxidative stress as described in USSN 12/445,005
  misc_feature (1)..(463): Ceres CLONE ID no.1571117
  misc_feature (1)..(463): Score of 267.2 for HMM of FIGURE 5 of USSN 12/445,005.
  misc_feature (45)..(450): Pfam Name: Aa_trans Pfam Description: Transmembrane amino acid transporter protein
  misc_feature (1)..(463): Functional Homolog Of Ceres SEEDLINE ID no. ME06123
MTTQQGPPAASYSPARDGGGGRSAEDEEKEKAAAIDNWLPISATRNAKWWYSAFHNVTAMVGAGVLGLPYAMSQLGWGAGITIMLLSWVITLYTLWQMVEMHEMVPGKRFDRYHELGQHAFGDRLGLWIVVPQQLVVEVGVNIVYMVTGGTSLQKFHDVLVCGDAACEGGRKIRLTYFIMIFASCHFVLAQLPNFDSISGVSLAAAVMSLSYSTIAWGASVSKGRVPDVDYGLRATTPPGKVFGFLGALGTVAFAYAGHNVVLEIQATIPSTPEKPSKKPMWKGVVVAYLVVALCYFPVSFVGYWAFGDSVDGDILVTLNRPRWLIALANMMVVIHVIGSYQIYAMPVFDMIETVLVKKLRFPPGLTLRLIARTVYVAFTMFIAITFPFFDGLLSFFGGFAFAPTTYFLPCIMWLAIYKPKRFSLSWFTNWICIILGVLLMVLAPIGGLRQIIISAKTYKFYQ

SEQ ID NO: 2364 - DNA, 1685 bp, Triticum aestivum
  misc_feature (1)..(1685): useful for making plants with increased tolerance to oxidative stress as described in USSN 12/445,005
  misc_feature (1)..(1685): Ceres CLONE ID no.786667
gctataggttcattccctcgggaatatacggcggcacttgactagtatctatccatccgtctcctctgaggtacctcgagagatcccgttcgccggagcggagatccgatcggaccggatcggatcgcgtcgccatggccatgaacacgagcaaggcggcgacgtcggacaagcagctgcaggacatcgacgactggctgcccatcacctcctcccggaacgccaagtggtggtactcggccttccacaatgtcaccgccatggtcggcgccggcgtcctcagcctgccctacgccatgtccgagctcggatggggtcctggcgtggcggcgatgatcctctcatgggcgatcacgctgtacacgctgtggcagatggtggagatgcacgagtgcgtgcccggcaagcgcttcgaccgctaccacgagctgggccagcacgccttcggccagaagctgggactctggatcgtcgtcccgcaacagctcgtcgtcgaggtcggcgtctgcatcgtctacatggtcaccggcggcaagtcgctcaagaaggtccacgacctgctccgcccggagcacagccacccgatccggaccagctacttcatctgcatcttcggctccgcccacttcctcctctcccagctgcccaacttcaactccatcaccggcgtctccctcgccgccgctgtcatgtcgctcagctactccaccatcgcctgggcggcctcgctgcacaaagccggcaaggccgggcccggccatgtggttgactacagcatgacggcgtcgacgacccccggaaagaccttcaacttcctgagcgcgctcggggacgtggccttcgcctacgccggtcacaacgtggtgctggagatccaggccaccatcccctccaccccagagaagccgtccaagaagcccatgtggcggggcgtcgttctcgcctacatcgtcgtcgccatctgctacctccccgtcgccttcctcggctactatgtcttcggcaacgccgtcgacgacaacatcctcatcaccctcgagaagccccgctggctcatcgccgccgccaacatgttcgtcgtcatccacgtcatcggcagctaccagatctatgcaatgccggtcttcgacatgctcgagaccttcctggtgaagaagctaaggtttaagcccgggtggccacttcgtctcatcgcacgctcgctctacgttgcattcaccatgctcgtcggcatcgccatccccttcttcggtgggctactaggcttctttggtggttttgcatttgccccaacaacctacttccttccctgcattatgtggctggcaatcaagaagccagcgaggttcagcatgtcctggtgcatcaactggatatgcataatcatcggcgtgcttctgtctgtgttggcgcccatcggaggcctccgttccatcatcatcaactacaagacctaccaattcttctcatgatctgctgcaaacgtgcatgcagcagtccagctagctacttagatgcagcgtattatatgcatagtgtgtgttaccttgtcatgtttaaattaggccaaagaaatattcgtgtgtttgtggatgttgctcgatcgctttgtgatattgaaatcaatgcctaagtggaggcgttctcttagatatatatgtgaaatgccaaaaaaaaaaaaaaaa

SEQ ID NO: 2365 - protein, 445 aa, Triticum aestivum
  misc_feature (1)..(445): useful for making plants with increased tolerance to oxidative stress as described in USSN 12/445,005
  misc_feature (1)..(445): Ceres CLONE ID no.786667
  misc_feature (1)..(445): Score of 248.7 for HMM of FIGURE 5 of USSN 12/445,005.
  misc_feature (28)..(432): Pfam Name: Aa_trans Pfam Description: Transmembrane amino acid transporter protein
  misc_feature (1)..(445): Functional Homolog Of Ceres SEEDLINE ID no. ME06123
MAMNTSKAATSDKQLQDIDDWLPITSSRNAKWWYSAFHNVTAMVGAGVLSLPYAMSELGWGPGVAAMILSWAITLYTLWQMVEMHECVPGKRFDRYHELGQHAFGQKLGLWIVVPQQLVVEVGVCIVYMVTGGKSLKKVHDLLRPEHSHPIRTSYFICIFGSAHFLLSQLPNFNSITGVSLAAAVMSLSYSTIAWAASLHKAGKAGPGHVVDYSMTASTTPGKTFNFLSALGDVAFAYAGHNVVLEIQATIPSTPEKPSKKPMWRGVVLAYIVVAICYLPVAFLGYYVFGNAVDDNILITLEKPRWLIAAANMFVVIHVIGSYQIYAMPVFDMLETFLVKKLRFKPGWPLRLIARSLYVAFTMLVGIAIPFFGGLLGFFGGFAFAPTTYFLPCIMWLAIKKPARFSMSWCINWICIIIGVLLSVLAPIGGLRSIIINYKTYQFFS

SEQ ID NO: 2366 - protein, 451 aa, Arabidopsis thaliana
  misc_feature (1)..(451): useful for making plants with increased tolerance to oxidative stress as described in USSN 12/445,005
  misc_feature (1)..(451): Public GI ID no.15219896
  misc_feature (1)..(451): Score of 231.8 for HMM of FIGURE 5 of USSN 12/445,005.
  misc_feature (34)..(435): Pfam Name: Aa_trans Pfam Description: Transmembrane amino acid transporter protein
  misc_feature (1)..(451): Functional Homolog Of Ceres SEEDLINE ID no. ME06123
MKGIPSSSNQILNQDLVEDQSFELEDWLPITASRNANWYYSAFHNVTAIVGAGVLGLPYAMSELGWGPGVVVLILSWVITLYTFWQMIEMHEMFEGKRFDRYHELGQAAFGKKLGLYIVVPLQLLVETSACIVYMVTGGESLKKIHQLSVGDYECRKLKVRHFILIFASSQFVLSLLKNFNSISGVSLVAAVMSMSYSTIAWVASLTKGVANNVEYGYKRRNNTSVPLAFLGALGEMAFAYAGHNVVLEIQATIPSTPENPSKRPMWKGAIVAYIIVAFCYFPVALVGFWTFGNNVEENILKTLRGPKGLIIVANIFVIIHLMGSYQVYAMPVFDMIESVMIKKWHFSPTRVLRFTIRWTFVAATMGIAVALPHFSALLSFFGGFIFAPTTYFIPCIIWLILKKPKRFSLSWCINWICIILGVLVMIIAPIGGLAKLMNALKQPDSSCKST

SEQ ID NO: 2367 - DNA, 1748 bp, Triticum aestivum
  misc_feature (1)..(1748): useful for making plants with increased tolerance to oxidative stress as described in USSN 12/445,005
  misc_feature (1)..(1748): Ceres CLONE ID no.914964
acctgcgagctccatctccatctccttgtttctctccaccttctccttggtgtgactccggccgcccattggcgaagggaagctccgtgccgccggaagagaagccaggcgccatggggacgcaggcctcgccggacaactacacgccgcccaaggatgagaggactgcacgggagaaggcgatcgatgactggcttcctatcacgtcgtcgaggaaagcaaagtggtggtactcggccttccacaatgtcaccgccatggttggcgctggggtgctcagcctcccctacgccatgtctgaactcggttggggtcctggcatcgcggtgatgaccttgtcgtggatcatcacggtgtacacgctgtggcagatggtggagatgcatgagatagtccctgggaagcgtttcgatcggtaccatgagctcgggcagcacgccttcggtgataagctcggcctctggatcgtggtgccacagcagcttgtcgtcgaggtcagcttgaacattgtgtacatggttaccggcggcaactctctcaagaagttccacgacgtgatctgtgacggcaagtgcaaggacataaagctcacttacttcatcatgatcttcgcctctgtccacttcgtcctctcccagctcccaaacttcaactccatctctggcatctccctcgctgcagccgtcatgtcactcagctactcaacaattgcttggggcgcctcgttggacaaggggagggcggagaacgtggactacagcctgcgggcatcgacgacagcagggcaggtgttcggtttcttgggggggctcggcgacgtggccttctcctactctggccacaatgtcgtgctagaaatccaggctaccatcccatcgacgccgggcaacccgtccaagaagccaatgtggaagggtgtggtggtcgcctacatcatcatcgccgcctgctacatgccggtggcatttatcggctactgggcgtttggcaacagtgtcgacgacaacatcctcatcaccctcaacaagcccaagtggctcatcgccatggccaacatgatggtcgtcgttcatctcatcggtagctaccagatttacgcgatgccagtgttcgacatgatggagacgtttctggtgaggaagctggaattcgcaccaggcattatgctccgtctgatcacccggaccatctatgttgccttcaccatgttcgtcggcatgaccttcccgttcttcggtggcctcatcgggttcttcggcgggctggccttcgcgccgacgacctatttcctgccctgcatcatgtggctcatcatctgcaagcccaggagattcagcctctcatggttcaccaactggatttgcatcgtccttggtgtcattctgatgatcatcgcgcccatcggagggctcaggcagatcatcatttctgccaagacatacaagttctactcatagatcactacaagtgccgttcatcatcatcgcctcgcgattggcgattctactgccagatttttatttttattttctgtccctgcaaagaagaaagatcatggtatcacggcttgtcgcagatgtcggacggtctgcttagtttagaccggaggagggctgtgttgggggtaaatcgtgaaggggtccagcccgcttgcagcgccgggagttttcatgtatgtactcgtattattttgcagagcactagctatgaaaataggcgcaaggattcatataaaaaaaaaaaaaaaa

SEQ ID NO: 2368 - protein, 447 aa, Triticum aestivum
  misc_feature (1)..(447): useful for making plants with increased tolerance to oxidative stress as described in USSN 12/445,005
  misc_feature (1)..(447): Ceres CLONE ID no.914964
  misc_feature (1)..(447): Score of 265.4 for HMM of FIGURE 5 of USSN 12/445,005.
  misc_feature (34)..(434): Pfam Name: Aa_trans Pfam Description: Transmembrane amino acid transporter protein
  misc_feature (1)..(447): Functional Homolog Of Ceres SEEDLINE ID no. ME06123
MGTQASPDNYTPPKDERTAREKAIDDWLPITSSRKAKWWYSAFHNVTAMVGAGVLSLPYAMSELGWGPGIAVMTLSWIITVYTLWQMVEMHEIVPGKRFDRYHELGQHAFGDKLGLWIVVPQQLVVEVSLNIVYMVTGGNSLKKFHDVICDGKCKDIKLTYFIMIFASVHFVLSQLPNFNSISGISLAAAVMSLSYSTIAWGASLDKGRAENVDYSLRASTTAGQVFGFLGGLGDVAFSYSGHNVVLEIQATIPSTPGNPSKKPMWKGVVVAYIIIAACYMPVAFIGYWAFGNSVDDNILITLNKPKWLIAMANMMVVVHLIGSYQIYAMPVFDMMETFLVRKLEFAPGIMLRLITRTIYVAFTMFVGMTFPFFGGLIGFFGGLAFAPTTYFLPCIMWLIICKPRRFSLSWFTNWICIVLGVILMIIAPIGGLRQIIISAKTYKFYS

SEQ ID NO: 2369 - DNA, 1539 bp, Populus balsamifera subsp. trichocarpa
  misc_feature (1)..(1539): useful for making plants with increased tolerance to oxidative stress as described in USSN 12/445,005
  misc_feature (1)..(1539): Ceres ANNOT ID no.1440705
atgggtactcaagttcctgataatcaaaaacctgatgtccccgaggaattatcagaagcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcagatatatgcaattccagtatttgacatgctagaaacattgctggtaaagaagttgcatttcaggccttccagaaagcttcgattcattacacgcaatatatatgttgcgtttacaatgttcgttggcatctgcttccctttctttggtggtcttctgggattcttcggaggatttgcttttgccccaacaacttactttctaccttgtatcatgtggctggccatctacaaaccaaagaggttcagcttatcatggatcaccaactggtgtctggatttgaggactaaccttgtctcggattctttgtttcctatgaaacgccatggaaggaattctggagtcactttaatatcatcaacattttgcataggtcttggaggtcatgattcctcgctgtcattctcacaactcatctctcgtggttttggaagagcttactcgtgcaatgtagacatcttagttcgatttccactctacaatttctctgaaccatgcttcaagattgttgtatggtatagggaattttctcaccaaaagctactgttgaagagttaa

SEQ ID NO: 2370 - protein, 512 aa, Populus balsamifera subsp. trichocarpa
  misc_feature (1)..(512): useful for making plants with increased tolerance to oxidative stress as described in USSN 12/445,005
  misc_feature (1)..(512): Ceres ANNOT ID no.1440705
  misc_feature (1)..(512): Score of 234.4 for HMM of FIGURE 5 of USSN 12/445,005.
  misc_feature (37)..(413): Pfam Name: Aa_trans Pfam Description: Transmembrane amino acid transporter protein
  misc_feature (37)..(431): Pfam Name: Aa_trans Pfam Description: Transmembrane amino acid transporter protein
  misc_feature (1)..(512): Functional Homolog Of Ceres SEEDLINE ID no. ME06123
MGTQVPDNQKPDVPEELSEADRRKKEIDDWLPITSSRNAKWWYSAFHNVTAMVGAGVLSLPYAMANLGWGPGTVILVLSWTITLYTLWQMVEMHEMVPGKRFDRYHELGQHAFGEKLGLYIVVPQQLICEVGVDIVYMVTGGKSLQKIHNLVCKDCAPIKLTYFIMIFASVHFVLSHLPNFNSISGVSLAAAVMSLSYSTIAWSASVHKGVQPDVDYGYKASTTSGTVFNFFSALGDVAFAYAGHNVVLEIQATIPSKPGKPSKGPMWKGVVVAYIVVALCYFPVALIGYYMFGNKVEDNILISLEKPTWLIVAANMFVVIHVIGSYQIYAIPVFDMLETLLVKKLHFRPSRKLRFITRNIYVAFTMFVGICFPFFGGLLGFFGGFAFAPTTYFLPCIMWLAIYKPKRFSLSWITNWCLDLRTNLVSDSLFPMKRHGRNSGVTLISSTFCIGLGGHDSSLSFSQLISRGFGRAYSCNVDILVRFPLYNFSEPCFKIVVWYREFSHQKLLLKS

SEQ ID NO: 2371 - DNA, 1600 bp, Zea mays
  misc_feature (1)..(1600): useful for making plants with increased tolerance to oxidative stress as described in USSN 12/445,005
  misc_feature (1)..(1600): Ceres CLONE ID no.264227
ccgggctactccaaaatatccagctttttcctgcggcaaactacctggccgccatctcctccgatccctcggcatacgtctccatcggccgggcgaccgagatggcgacgccctccagcatgacgtcgacggagaaggagaaagccatcgacgactggctgcccatcacctcgtccaggaacgccaaatggtggtactccgccttccacaacgtcacggccatggtcggcgccggcgtcctcagcctgccctacgcaatgtccgagctcggctggggtcccggcgtggtcgccatggtcctgtcttgggtgatcaccctgtacacgctgtggcagatggtcgagatgcacgagtgcgtccccgggaagcgtttcgaccgctaccacgagctgggccagcacgcgttcggcgataagctgggcctctggatcgtcgtcccgcagcagctcatcgtcgagatcggcgtctgcatcgtctacatggtcaccggcggcaagtcgttcgagaagtgctacaccgtcgcctgcccggactgcaagccgctccgcaccagctcgtggatcatggtcttcgccgccatccacctgctgctctcgcagctgcccaacttcaactccatcacgctcgtctccctcgccgccgcagtcatgtcgctcacctactcgacgattgcatgggcggcgtcggcgcacaaggggcggcactcggccgtggactacagcatgaaggcgtcgacgacgacggggcagacgttcaacttcctgagcgcgctcggggacgtggcgttcgcgtacgcggggcacaacgtggtgctggagatccaggccaccatcccgtccacgccagacaagccgtccaagaagcccatgtggcagggcgtcgtcctcgcctacctcgtcgtcgccatctgctacctcccggtggcgttcgtcggctactacgtcttcggcaacgccgtcgacgacaacatcctcatcaccctcgagaagccacgctggctcatcgccgccgccaacatcttcgtcgtcgtgcacgtcatcggcagctaccagatctacgccatgcccgtgttcgacatgctcgagacgttcctggtgaagaaactccggttcaagccaggcatgcctctccgtttgatagcgcgctcgctctatgttgtgctgacagctctggttggcatcgccgtgccgttcttcggggggctgctagggttctttggtggcttcgcatttgcgccgacaacctactaccttccgtgcattctgtggttgaagattaagaagccaaagaagttcagcctctcttggttcatcaactggttctgcatcatagtcggcgtgctcctgacggtgcttgcgcccattggtggcctccggtcgatcgtcgtcaacgcctccacctacaagttcttctcgtgatcgggttatcccctcgcgccccatgcattgcggcgcccctagggatattagttagctagctagcaagataaacattagcaggtagctaggtttaaacttttttatgccatatatggtgtgtgtgagtgtgtttggaacttggtttaatttgtgctatcgctaagtcgtcgtcgttcactttc

SEQ ID NO: 2372 - protein, 438 aa, Zea mays
  misc_feature (1)..(438): useful for making plants with increased tolerance to oxidative stress as described in USSN 12/445,005
  misc_feature (1)..(438): Ceres CLONE ID no.264227
  misc_feature (1)..(438): Score of 271.2 for HMM of FIGURE 5 of USSN 12/445,005.
  misc_feature (26)..(425): Pfam Name: Aa_trans Pfam Description: Transmembrane amino acid transporter protein
  misc_feature (1)..(438): Functional Homolog Of Ceres SEEDLINE ID no. ME06123
MATPSSMTSTEKEKAIDDWLPITSSRNAKWWYSAFHNVTAMVGAGVLSLPYAMSELGWGPGVVAMVLSWVITLYTLWQMVEMHECVPGKRFDRYHELGQHAFGDKLGLWIVVPQQLIVEIGVCIVYMVTGGKSFEKCYTVACPDCKPLRTSSWIMVFAAIHLLLSQLPNFNSITLVSLAAAVMSLTYSTIAWAASAHKGRHSAVDYSMKASTTTGQTFNFLSALGDVAFAYAGHNVVLEIQATIPSTPDKPSKKPMWQGVVLAYLVVAICYLPVAFVGYYVFGNAVDDNILITLEKPRWLIAAANIFVVVHVIGSYQIYAMPVFDMLETFLVKKLRFKPGMPLRLIARSLYVVLTALVGIAVPFFGGLLGFFGGFAFAPTTYYLPCILWLKIKKPKKFSLSWFINWFCIIVGVLLTVLAPIGGLRSIVVNASTYKFFS

SEQ ID NO: 2373 - protein, 445 aa, Arabidopsis thaliana
  misc_feature (1)..(445): useful for making plants with increased tolerance to oxidative stress as described in USSN 12/445,005
  misc_feature (1)..(445): Public GI ID no.30693666
  misc_feature (1)..(445): Score of 250.5 for HMM of FIGURE 5 of USSN 12/445,005.
  misc_feature (33)..(432): Pfam Name: Aa_trans Pfam Description: Transmembrane amino acid transporter protein
  misc_feature (1)..(445): Functional Homolog Of Ceres SEEDLINE ID no. ME06123
MVAQAPHDDHDDEKLAAARQKEIEDWLPITSSRNAKWWYSAFHNVTAMVGAGVLGLPYAMSQLGWGPGIAVLVLSWVITLYTLWQMVEMHEMVPGKRFDRYHELGQHAFGEKLGLYIVVPQQLIVEIGVCIVYMVTGGKSLKKFHELVCDDCKPIKLTYFIMIFASVHFVLSHLPNFNSISGVSLAAAVMSLSYSTIAWASSASKGVQEDVQYGYKAKTTAGTVFNFFSGLGDVAFAYAGHNVVLEIQATIPSTPEKPSKGPMWRGVIVAYIVVALCYFPVALVGYYIFGNGVEDNILMSLKKPAWLIATANIFVVIHVIGSYQIYAMPVFDMMETLLVKKLNFRPTTTLRFFVRNFYVAATMFVGMTFPFFGGLLAFFGGFAFAPTTYFLPCVIWLAIYKPKKYSLSWWANWVCIVFGLFLMVLSPIGGLRTIVIQAKGYKFYS

SEQ ID NO: 2374 - protein, 446 aa, Arabidopsis thaliana
  misc_feature (1)..(446): useful for making plants with increased tolerance to oxidative stress as described in USSN 12/445,005
  misc_feature (1)..(446): Public GI ID no.30693663
  misc_feature (1)..(446): Score of 251.6 for HMM of FIGURE 5 of USSN 12/445,005.
  misc_feature (34)..(433): Pfam Name: Aa_trans Pfam Description: Transmembrane amino acid transporter protein
  misc_feature (1)..(446): Functional Homolog Of Ceres SEEDLINE ID no. ME06123
MVAQAPHDDHQDDEKLAAARQKEIEDWLPITSSRNAKWWYSAFHNVTAMVGAGVLGLPYAMSQLGWGPGIAVLVLSWVITLYTLWQMVEMHEMVPGKRFDRYHELGQHAFGEKLGLYIVVPQQLIVEIGVCIVYMVTGGKSLKKFHELVCDDCKPIKLTYFIMIFASVHFVLSHLPNFNSISGVSLAAAVMSLSYSTIAWASSASKGVQEDVQYGYKAKTTAGTVFNFFSGLGDVAFAYAGHNVVLEIQATIPSTPEKPSKGPMWRGVIVAYIVVALCYFPVALVGYYIFGNGVEDNILMSLKKPAWLIATANIFVVIHVIGSYQIYAMPVFDMMETLLVKKLNFRPTTTLRFFVRNFYVAATMFVGMTFPFFGGLLAFFGGFAFAPTTYFLPCVIWLAIYKPKKYSLSWWANWVCIVFGLFLMVLSPIGGLRTIVIQAKGYKFYS

SEQ ID NO: 2375 - protein, 418 aa, Arabidopsis thaliana
  misc_feature (1)..(418): useful for making plants with increased tolerance to oxidative stress as described in USSN 12/445,005
  misc_feature (1)..(418): Public GI ID no.2443875
  misc_feature (1)..(418): Score of 214.9 for HMM of FIGURE 5 of USSN 12/445,005.
  misc_feature (24)..(402): Pfam Name: Aa_trans Pfam Description: Transmembrane amino acid transporter protein
  misc_feature (24)..(413): Pfam Name: Aa_trans Pfam Description: Transmembrane amino acid transporter protein
  misc_feature (1)..(418): Functional Homolog Of Ceres SEEDLINE ID no. ME06123
MKTLRDLQDQSFELEDWLPITASRNANWYYSAFHNVTAIVGAGVLGLPYAMSELGWGPGVVVLILSWVITLYTFWQMIEMHEMFEGKRFDRYHELGQAAFGKKLGLYIVVPLQLLVETSACIVYMVTGGESLKKIHQLSVGDYECRKLKVRHFILIFASSQFVLSLLKNFNSISGVSLVAAVMSMSYSTIAWVASLTKGVANNVEYGYKRRNNTSVPLAFLGALGEMAFAYAGHNVVLEIQATIPSTPENPSKRPMWKGAIVAYIIVAFCYFPVALVGFWTFGNNVEENILKTLRGPKGLIIVANIFVIIHLMGSYQVYAMPVFDMIESVMIKKWHFSPTRVLRFTIRWTFVAATMGIAVALPHFSALLSFFGGFIFAPTTYFIPCIIWLILKKPKRFSLSWCINWASGTPPFGLFVN

SEQ ID NO: 2376 - DNA, 1594 bp, Brassica napus
  misc_feature (1)..(1594): useful for making plants with increased tolerance to oxidative stress as described in USSN 12/445,005
  misc_feature (1)..(1594): Ceres CLONE ID no.1257761
atcttaaaatcttcttaatagcctcctctcctcttatctcttctcctctctatatctcaaaaagagtgtcccttatagaacgatatggggaataacgaaacgtcagcgagtgagactgccgcggctaagcagaagaaagtcgacgattggttaccgatcacatcctcaagaaacgccaagtggtggtactctgcgtttcacaatgttactgccatggttggtgctggtgttctcagcttgccctacgccatgtccaatctcggatggggacctggcgtgacgttgatgataatgtcatgggtgataactttgtacacactgtggcaaatggtggagatgcacgagattgtacctgggaagaggtttgatagatatcacgagctaggtcaagaagcttttggtgaaaagcttggcctttggatcattgtgcctcagcaactcatcgtggaggtcggtgtagacattgtttatatggtcactggagggaaatctctacagaaagtccatgaactcctctgctctgattgcaaagacatcaaaactacatattggatcatgatctttgcgtctatccacttcgttatctctcacctaccaaactttaactccatgtccgtcatctcactcgccgctgccgttatgtccttaacttactcaactatcgcgtggactgcatcagtgcacaaaggggttcgtccagatgtagactactcgtctagagcctcgacaagtgctggaaatgtattcaacttcttgaacgcgttgggagatgtggcttttgcctacgcaggtcacaacgtcgttttggagattcaagccaccatcccttcgactccggaggtgccatccaaggttccaatgtttagaggagtcgttgtagcctacatcatagtagccatttgctactttcctgtagcgttcctagggtactggatctttgggaacagcgttgatgacaacattctaatgactttggagaagcctgtatggcttatcgcaatggctaacttatttgtggtcatccacgttattggaagctatcagatttttgcaatgccggtttttgacatgcttgaaaccgttttggtcaagaagatgaatttcgatccatccttcaaactccgcttcatcactcgcagtctttatgttgctttcactatgtccattgcgatatgtatcccgttttttggtggactactcggcttctttggaggatttgcctttgcaccaacaacttactaccttccatgcattatttggctcattctcaagaaaccaaagaagtttagtctatcatggataatcaactggttttgcattatattaggagttattttgacggtcatggctcccattggtggcctcagaactattattgtcaacgcaagcacctacaagttcttttcttagatttcttcttgtaccacacaaaaaaaaaaagtagatctaaggaaataagccacggccagtctcgttttctatgactgtccgttttgttacttttaaggttttagtatagttcaagattcgtaatttatgtaatctgctgctttatattaaaacttcatattccggttcaaaaaaaaaaaaaaaa

SEQ ID NO: 2377 - protein, 441 aa, Brassica napus
  misc_feature (1)..(441): useful for making plants with increased tolerance to oxidative stress as described in USSN 12/445,005
  misc_feature (1)..(441): Ceres CLONE ID no.1257761
  misc_feature (1)..(441): Score of 245.5 for HMM of FIGURE 5 of USSN 12/445,005.
  misc_feature (29)..(428): Pfam Name: Aa_trans Pfam Description: Transmembrane amino acid transporter protein
  misc_feature (1)..(441): Functional Homolog Of Ceres SEEDLINE ID no. ME06123
MGNNETSASETAAAKQKKVDDWLPITSSRNAKWWYSAFHNVTAMVGAGVLSLPYAMSNLGWGPGVTLMIMSWVITLYTLWQMVEMHEIVPGKRFDRYHELGQEAFGEKLGLWIIVPQQLIVEVGVDIVYMVTGGKSLQKVHELLCSDCKDIKTTYWIMIFASIHFVISHLPNFNSMSVISLAAAVMSLTYSTIAWTASVHKGVRPDVDYSSRASTSAGNVFNFLNALGDVAFAYAGHNVVLEIQATIPSTPEVPSKVPMFRGVVVAYIIVAICYFPVAFLGYWIFGNSVDDNILMTLEKPVWLIAMANLFVVIHVIGSYQIFAMPVFDMLETVLVKKMNFDPSFKLRFITRSLYVAFTMSIAICIPFFGGLLGFFGGFAFAPTTYYLPCIIWLILKKPKKFSLSWIINWFCIILGVILTVMAPIGGLRTIIVNASTYKFFS

SEQ ID NO: 2378 - DNA, 1479 bp, Brassica napus
  misc_feature (1)..(1479): useful for making plants with increased tolerance to oxidative stress as described in USSN 12/445,005
  misc_feature (1)..(1479): Ceres CLONE ID no.1109755
aacttgtcaagacttcttctctcctctttatatctttctccctcattttctctcggtgtaatcatggtaaatcaagctcctcaagatgattatgatgatgagaaatcggcaagacaaaaggaaatcgaagattggttaccaattacttcatcaagaaatgctaagtggtggtactcagcttttcacaatgtcaccgccatggtcggtgcaggagttctcggcctcccttacgccatgtctcagcttggctggggaccaggagttgcagtattggttctctcatgggtaataacactatacacattatggcaaatggttgaaatgcacgaaatggttccgggaaagcgttttgatcgttaccatgaactcggacaacacgcgtttggagaaaagcttggtctttatatagtcgtaccgcaacagctgatcgtggaaataggcgtttgtatcgtttatatggtcactggaggcaaatctctaaagaagtttcatgagcttgtttgtgaggattgcaaacccatcaagcttacttacttcatcatgatctatgcttctgttcacttcgtcctctctcatctccccaatttcaattccatctctggcgtttctctcgccgcggcggttatgtctctaagctactcaacaatcgcatggacagcttcgacgagtaaaggcgttcgagaagatgttgaatatggttacaaagcaaaatcaacagccggtacggttttcaacttcttcagcggtttaggtgatgtggcattcgcttacgcaggccacaatgtggtccttgagatccaagcaacgatcccttcgactcctgagaaaccatcaaaaggcccaatgtggaaaggagtcatcgttgcttacatcgttgtcgcactttgttattttccggtggctctcgtcggatactacattttcgggaacagtgttgaagataatatcctcatatcacttaaaaagccagtttggttaatcgcgacggctaatatctttgttgtgatccatgttatcggtagttaccagatatatgcaatgccggtttttgacatgatggaaactttattggttaagaagcttaattttagaccaaccacgattctccggttctgtgttcgtaatttctatgttgctgcaaccatgtttcttggtatgacgttcccgttctttggtggccttttggcgttctttggtggattcgcgtttgcccctacgacatacttcctaccttgcataatttggctagccatctacaaacctaggaagtacggcttgtcttggtgggccaactgggtatgtatcgtgtttggtattttcttaatggtcttgtcgcctattggagggctaaggacgatcgttattcaagcaaaggaataccagttttactcgtaaatgctgtttaatatgactaatgtttagagacatatttatatattaatgtgtgaagattttaaaagatcaaaaaaaaaaaaaaaa

SEQ ID NO: 2379 - protein, 443 aa, Brassica napus
  misc_feature (1)..(443): useful for making plants with increased tolerance to oxidative stress as described in USSN 12/445,005
  misc_feature (1)..(443): Ceres CLONE ID no.1109755
  misc_feature (1)..(443): Score of 247.1 for HMM of FIGURE 5 of USSN 12/445,005.
  misc_feature (31)..(430): Pfam Name: Aa_trans Pfam Description: Transmembrane amino acid transporter protein
  misc_feature (1)..(443): Functional Homolog Of Ceres SEEDLINE ID no. ME06123
MVNQAPQDDYDDEKSARQKEIEDWLPITSSRNAKWWYSAFHNVTAMVGAGVLGLPYAMSQLGWGPGVAVLVLSWVITLYTLWQMVEMHEMVPGKRFDRYHELGQHAFGEKLGLYIVVPQQLIVEIGVCIVYMVTGGKSLKKFHELVCEDCKPIKLTYFIMIYASVHFVLSHLPNFNSISGVSLAAAVMSLSYSTIAWTASTSKGVREDVEYGYKAKSTAGTVFNFFSGLGDVAFAYAGHNVVLEIQATIPSTPEKPSKGPMWKGVIVAYIVVALCYFPVALVGYYIFGNSVEDNILISLKKPVWLIATANIFVVIHVIGSYQIYAMPVFDMMETLLVKKLNFRPTTILRFCVRNFYVAATMFLGMTFPFFGGLLAFFGGFAFAPTTYFLPCIIWLAIYKPRKYGLSWWANWVCIVFGIFLMVLSPIGGLRTIVIQAKEYQFYS

SEQ ID NO: 2380 - protein, 479 aa, Arabidopsis thaliana
  misc_feature (1)..(479): useful for making plants with increased tolerance to oxidative stress as described in USSN 12/445,005
  misc_feature (1)..(479): Public GI ID no.15232176
  misc_feature (1)..(479): Score of 206.1 for HMM of FIGURE 5 of USSN 12/445,005.
  misc_feature (56)..(458): Pfam Name: Aa_trans Pfam Description: Transmembrane amino acid transporter protein
  misc_feature (1)..(479): Functional Homolog Of Ceres SEEDLINE ID no. ME06123
MAGIPDHIQDQHLVEEVYAFYDFVTLKNFILKEFLLLYLQDQPFDLEDWLPITASRNANWYYSAFHNVTAIVGAGVLGLPYAMSELGWGPGVVVLILSWVITLYTLWQMIEMHEMFEGQRFDRYHELGQAAFGKKLGLYIIVPLQLLVEISVCIVYMVTGGKSLKNVHDLALGDGDKCTKLRIQHFILIFASSQFVLSLLKNFNSISGVSLVAAVMSVSYSTIAWVASLRKGATTGSVEYGYRKRTTSVPLAFLSALGEMAFAYAGHNVVLEIQATIPSTPENPSKRPMWKGAVVAYIIVAFCYFPVALVGFKTFGNSVEESILESLTKPTALVIVANMFVVIHLLGSYQVYAMPVFDMIESVMIRIWHFSPTRVLRFTIRWTFVAATMGIAVGLPYYSALLSFFGGFVFAPTTYFIPCIMWLILKKPKRFSLSWCMNWFCIIFGLVLMIIAPIGGLAKLIYNIQKGTLPNSRCNLPKH

SEQ ID NO: 2381 - protein, 455 aa, Arabidopsis thaliana
  misc_feature (1)..(455): useful for making plants with increased tolerance to oxidative stress as described in USSN 12/445,005
  misc_feature (1)..(455): Public GI ID no.6091720
  misc_feature (1)..(455): Score of 210.6 for HMM of FIGURE 5 of USSN 12/445,005.
  misc_feature (32)..(434): Pfam Name: Aa_trans Pfam Description: Transmembrane amino acid transporter protein
  misc_feature (1)..(455): Functional Homolog Of Ceres SEEDLINE ID no. ME06123
MAGIPDHIQDQHLVEEDQPFDLEDWLPITASRNANWYYSAFHNVTAIVGAGVLGLPYAMSELGWGPGVVVLILSWVITLYTLWQMIEMHEMFEGQRFDRYHELGQAAFGKKLGLYIIVPLQLLVEISVCIVYMVTGGKSLKNVHDLALGDGDKCTKLRIQHFILIFASSQFVLSLLKNFNSISGVSLVAAVMSVSYSTIAWVASLRKGATTGSVEYGYRKRTTSVPLAFLSALGEMAFAYAGHNVVLEIQATIPSTPENPSKRPMWKGAVVAYIIVAFCYFPVALVGFKTFGNSVEESILESLTKPTALVIVANMFVVIHLLGSYQVYAMPVFDMIESVMIRIWHFSPTRVLRFTIRWTFVAATMGIAVGLPYYSALLSFFGGFVFAPTTYFIPCIMWLILKKPKRFSLSWCMNWFCIIFGLVLMIIAPIGGLAKLIYNIQKGTLPNSRCNLPKH

SEQ ID NO: 2382 - DNA, 1182 bp, Populus balsamifera subsp. trichocarpa
  misc_feature (1)..(1182): useful for making plants with increased tolerance to oxidative stress as described in USSN 12/445,005
  misc_feature (1)..(1182): Ceres ANNOT ID no.1512922
atggcttacaacgagtcacggaatgatgcagcagcaaaagagaaggccatagatgattggcttccaatcacttcctctaggaaagccaaatggtggtactcaaccttccacaatgttactgccatggttggtgctggtgtccttagcctcccctatgccatggctcaacttggatggggaccaggaatcgccatacttgttttgtcatgggtgatcacgttgtacactctgtggcaaatggtcgaaatgcatgagatggtgcctggcaagcgatttgacaggtaccatgagctagggcaacatgtgtttggagacaagctgggtctctggattgttgtgccacagcaactaattgttcaagttggagtaaatattgtctacatggttactggaggaaaatcattgaagaagttccatgatgtggtttgccccaactgcaaagacatcaggctaacatacttcatcatgattttcgcctcagttcagatggtactggctcatcttcccaatctcaactccattagtgtaatctcgctggctgcagcagtcatgtccttaagttactctacaattgcttgggctgtcacgcttaacaagggggttcagcctgatgtcgactacagctacaaagcaagaactagaacaggagctttctttgactttatcactgccttgggtgatgtagcttttgcatatgctggtcacaatgtggtcttggagattcaagcaacaatcccttcttctccagagaagccttccaagaaacccatgtggagaggagctttccttgcatatctcgtcgtcgccttctgctacttcccagttgccttgattggatactggtgttatggcaacagcgtggacgacaacattctaatctcactgcagaaaccatcttggcttattgcagctgctaacatgtttgttgtcattcatgttattggaagctaccagatatatgcaattgcagtgttcgacttgctggaaactgcattgggctcacaatgtttgttgctcccctgcgtcatgtggctttccatctacaaaccgaagaggttcggcttctcttggacagcaaattgggtctgcgttatacttggcgttctcttgatgatactgtcacccattggtgccctaaggcatatcatccttacagccaaggactacgaattcttctcatga

SEQ ID NO: 2383 - protein, 393 aa, Populus balsamifera subsp. trichocarpa
  misc_feature (1)..(393): useful for making plants with increased tolerance to oxidative stress as described in USSN 12/445,005
  misc_feature (1)..(393): Ceres ANNOT ID no.1512922
  misc_feature (1)..(393): Score of 165.9 for HMM of FIGURE 5 of USSN 12/445,005.
  misc_feature (27)..(330): Pfam Name: Aa_trans Pfam Description: Transmembrane amino acid transporter protein
  misc_feature (1)..(393): Functional Homolog Of Ceres SEEDLINE ID no. ME06123
MAYNESRNDAAAKEKAIDDWLPITSSRKAKWWYSTFHNVTAMVGAGVLSLPYAMAQLGWGPGIAILVLSWVITLYTLWQMVEMHEMVPGKRFDRYHELGQHVFGDKLGLWIVVPQQLIVQVGVNIVYMVTGGKSLKKFHDVVCPNCKDIRLTYFIMIFASVQMVLAHLPNLNSISVISLAAAVMSLSYSTIAWAVTLNKGVQPDVDYSYKARTRTGAFFDFITALGDVAFAYAGHNVVLEIQATIPSSPEKPSKKPMWRGAFLAYLVVAFCYFPVALIGYWCYGNSVDDNILISLQKPSWLIAAANMFVVIHVIGSYQIYAIAVFDLLETALGSQCLLLPCVMWLSIYKPKRFGFSWTANWVCVILGVLLMILSPIGALRHIILTAKDYEFFS

SEQ ID NO: 2384 - protein, 441 aa, Arabidopsis thaliana
  misc_feature (1)..(441): useful for making plants with increased tolerance to oxidative stress as described in USSN 12/445,005
  misc_feature (1)..(441): Public GI ID no.15220504
  misc_feature (1)..(441): Score of 246.0 for HMM of FIGURE 5 of USSN 12/445,005.
  misc_feature (29)..(428): Pfam Name: Aa_trans Pfam Description: Transmembrane amino acid transporter protein
  misc_feature (1)..(441): Functional Homolog Of Ceres SEEDLINE ID no. ME06123
MEKSQSSPTKDASTKQKNVDDWLPITSSRNAKWWYSAFHNVTAMVGAGVLSLPYAMSNLGWGPGVTIMIMSWLITFYTLWQMVQMHEMVPGKRFDRYHELGQHAFGEKLGLWIVVPQQLIVEVGVDIVYMVTGGKSLKKIHDLLCTDCKNIRTTYWIMIFASIHFVLAHLPNFNSISIVSLAAAVMSLSYSTIAWATSVKKGVHPNVDYSSRASTTSGNVFNFLNALGDVAFAYAGHNVVLEIQATIPSTPEKPSKIAMWKGVVVAYIVVAICYFPVAFVCYYIFGNSVDDNILMTLEKPIWLIAIANAFVVVHVIGSYQIYAMPVFDMLETFLVKKMMFAPSFKLRFITRTLYVAFTMFVAICIPFFGGLLGFFGGFAFAPTTYYLPCIMWLCIKKPKKYGLSWCINWFCIVVGVILTILAPIGGLRTIIISAKNYEFFS

SEQ ID NO: 2385 - protein, 442 aa, Arabidopsis thaliana
  misc_feature (1)..(442): useful for making plants with increased tolerance to oxidative stress as described in USSN 12/445,005
  misc_feature (1)..(442): Public GI ID no.116830999
  misc_feature (1)..(442): Score of 246.5 for HMM of FIGURE 5 of USSN 12/445,005.
  misc_feature (29)..(428): Pfam Name: Aa_trans Pfam Description: Transmembrane amino acid transporter protein
  misc_feature (1)..(442): Functional Homolog Of Ceres SEEDLINE ID no. ME06123
MEKSQSSPTKDASTKQKNVDDWLPITSSRNAKWWYSAFHNVTAMVGAGVLSLPYAMSNLGWGPGVTIMIMSWLITFYTLWQMVQMHEMVPGKRFDRYHELGQHAFGEKLGLWIVVPQQLIVEVGVDIVYMVTGGKSLKKIHDLLCTDCKNIRTTYWIMIFASIHFVLAHLPNFNSISIVSLAAAVMSLSYSTIAWATSVKKGVHPNVDYSSRASTTSGNVFNFLNALGDVAFAYAGHNVVLEIQATIPSTPEKPSKIAMWKGVVVAYIVVAICYFPVAFVCYYIFGNSVDDNILMTLEKPIWLIAIANAFVVVHVIGSYQIYAMPVFDMLETFLVKKMMFAPSFKLRFITRTLYVAFTMFVAICIPFFGGLLGFFGGFAFAPTTYYLPCIMWLCIKKPKKYGLSWCINWFCIVVGVILTILAPIGGLRTIIISAKNYEFFSG

SEQ ID NO: 2386 - protein, 441 aa, Arabidopsis thaliana
  misc_feature (1)..(441): useful for making plants with increased tolerance to oxidative stress as described in USSN 12/445,005
  misc_feature (1)..(441): Public GI ID no.18395471
  misc_feature (1)..(441): Score of 250.9 for HMM of FIGURE 5 of USSN 12/445,005.
  misc_feature (29)..(428): Pfam Name: Aa_trans Pfam Description: Transmembrane amino acid transporter protein
  misc_feature (1)..(441): Functional Homolog Of Ceres SEEDLINE ID no. ME06123
MGNSEMSASEVAAAKQKNVDDWLPITSSRNAKWWYSAFHNVTAMVGAGVLSLPYAMSNLGWGPGVTIMVMSWIITLYTLWQMVEMHEIVPGKRLDRYHELGQHAFGEKLGLWIVVPQQLIVEVGVDIVYMVTGGASLKKVHQLVCPDCKEIRTTFWIMIFASVHFVISHLPNFNSISIISLAAAVMSLTYSTIAWAASVHKGVHPDVDYSPRASTDVGKVFNFLNALGDVAFAYAGHNVVLEIQATIPSTPEMPSKVPMWRGVIVAYIVVAICYFPVAFLGYYIFGNSVDDNILITLEKPIWLIAMANMFVVIHVIGSYQIFAMPVFDMLETVLVKKMNFNPSFKLRFITRSLYVAFTMIVAICVPFFGGLLGFFGGFAFAPTTYYLPCIMWLVLKKPKRFGLSWTANWFCIIVGVLLTILAPIGGLRTIIINAKTYKFFS

SEQ ID NO: 2387 - DNA, 1434 bp, Populus balsamifera subsp. trichocarpa
  misc_feature (1)..(1434): useful for making plants with increased tolerance to oxidative stress as described in USSN 12/445,005
  misc_feature (1)..(1434): Ceres ANNOT ID no.1463076
atgccatccaatgagtcacagaacgatgaagcagcaagagaaaaggccataaatgattggcttccagtcacttcctcgaggaatgccaaatggtggtactcaaccttccacaatgtcactgccatggttggtgctggtgttcttagtctcccctatgccatggctcaacttggatggggaccaggtgttgccatactttttttatcatgggtgatcacgttatacactctatggcaaatggttgaaatgcatgagatggttcctggtaagcgatttgatagataccatgagctagggcaacatgcgtttggagagaagctgggtctctggattgttgtgccacagcaactagttgtacaagttggagtaaacatagtctatatggttaccggaggaaaatcattgaagaagttccatgatttggtttgctccgactgcaaagacatcaggctaacgtacttcatcatgattttcgcttcgcttcagtttgttctggctcatcttcccaatctcaactccattagtgttatctctctggctgcagcagtcatgtccttgagttactccacaattgcctggggagccacccttaataagggtgttcagcctgatgtcgactacagctataaagcgagcactaaaaccggagctgtctttgactttttctctgccttgggtgatatagcttttgcatatgccggtcacaatgtgatcttggagatccaagcaacaattccctctactccagagaagccttccaagaaacccatgtggagaggagccttccttgcatatgttgtcgtcgccatctgctacttcccagttgccttgattggatactggttttttggaaacagcgtggaagacaacattcttatctcactcgagaaaccagcttggcttattgcaactgctaacatgtttgttgtcattcatgttattggaagttatcagatatatgctatggcagtgttcgacatgttggaaactgcattggtgaagaaactccatttttctccttctttcatgcttcgctttgttactcgcacggtatatgttgggttcacaatgattgttggtatatgtattccattcttcggtggcctgctttcgttcttcggaggatttgcttttgccccaacaacatactttctcccttgcatcatgtggcttgccatctataaacccaagaagttcagcttctcttggatagcaaattgggtgcgtctgcattgtgcttggaattttgctgatgatattgtcacccattggtgccctaagacatatcatccttacagccaaagactacgagttcttctcatgagcatcacaccaaatgcgagacaagggcagaccaagtactgtaaagaaagggtgttgattgagttgctggttatggcctttgcacttagcaggaaactcaaatttaattaa

SEQ ID NO: 2388 - protein, 477 aa, Populus balsamifera subsp. trichocarpa
  misc_feature (1)..(477): useful for making plants with increased tolerance to oxidative stress as described in USSN 12/445,005
  misc_feature (1)..(477): Ceres ANNOT ID no.1463076
  misc_feature (1)..(477): Score of 199.0 for HMM of FIGURE 5 of USSN 12/445,005.
  misc_feature (27)..(405): Pfam Name: Aa_trans Pfam Description: Transmembrane amino acid transporter protein
  misc_feature (27)..(421): Pfam Name: Aa_trans Pfam Description: Transmembrane amino acid transporter protein
  misc_feature (1)..(477): Functional Homolog Of Ceres SEEDLINE ID no. ME06123
MPSNESQNDEAAREKAINDWLPVTSSRNAKWWYSTFHNVTAMVGAGVLSLPYAMAQLGWGPGVAILFLSWVITLYTLWQMVEMHEMVPGKRFDRYHELGQHAFGEKLGLWIVVPQQLVVQVGVNIVYMVTGGKSLKKFHDLVCSDCKDIRLTYFIMIFASLQFVLAHLPNLNSISVISLAAAVMSLSYSTIAWGATLNKGVQPDVDYSYKASTKTGAVFDFFSALGDIAFAYAGHNVILEIQATIPSTPEKPSKKPMWRGAFLAYVVVAICYFPVALIGYWFFGNSVEDNILISLEKPAWLIATANMFVVIHVIGSYQIYAMAVFDMLETALVKKLHFSPSFMLRFVTRTVYVGFTMIVGICIPFFGGLLSFFGGFAFAPTTYFLPCIMWLAIYKPKKFSFSWIANWVRLHCAWNFADDIVTHWCPKTYHPYSQRLRVLLMSITPNARQGQTKYCKERVLIELLVMAFALSRKLKFN

SEQ ID NO: 2389 - DNA, 1704 bp, Panicum virgatum
  misc_feature (1)..(1704): useful for making plants with increased tolerance to oxidative stress as described in USSN 12/445,005
  misc_feature (1)..(1704): Ceres CLONE ID no.1904659
ttttccattagctctataaattaaagaagaagagcgcttgcgctgtctgccgcctccgctccttccccattgctgaaggctcagtggcatccatcgtcgacgtcgaggcgctcctgccggcggccatggagatacagcagctcgacgactactctccggccaagcttgccagccttgctcttgcgcccagcaaagggcgtacggactccaaggagggcagctggagcgcgccggagaagccggtcgaggactggcgtgccatcaactcgaggaggaacgccaagtggtggtacgccgccttccacaatgtcaccgccatggtcggcgccggcgtgcttagccttcccttcgccatgtccgagctcggctggggggttggcatcacggtgctggtcctgtcatggatcctcacggtgtacaccctgtggcagatggtggagatgcacgagatcgtgccggggaagcggttcgaccggtaccacgagctggggcagcacgcgttcggcgagaagctgggcctctggatcgtcgtgccgcagcagctggtggtggaggtcggcctgaacattgtctacatggtcaccggcggccagtccctgcagaagttccacgacttggtctgccacggcaggtgcaataacatcaagctcccctatttcatcatgatcttcgcctccgtccagttcgtgctctcccagctccccaacttccactccatctccagcatctccctcatcgcagccgtcatgtcagtcagttactcgacgattgcatgggctgcatcaacacatcatcacaagacaaattcggcagaggtggactacagccttcgtgcaacgacgacgcccggcaaggtgttcgacttcttggggggactgggcgacgtggcgttcacatacgccgggcacaacgtggtgctggagatccaggccaccatcccgtcgacgccggagaagccgtccaagaagcccatgtggaagggcgtcgtcgtcgcctacatcatcatcgccgcgtgctacttccctgttgcgcacgccggctactgggccttcggcaaccaagtggatgagaacatcctcatcgccctaaacaaacccaagtggctcatcgccgtcgccaacatgatggtcgtcgtccatgtcgttggcagctaccaggtctatgcgatgccggtattcgacatgatagagacgatgctagtgaggaagttttggttcactccagacctgaggctccgtctgatttcccggactgtctatgttgcgttcacaatgttcatagccatgaccttccccttcttcagtgaattgctcagtttcttcggtggatttgcctacgcgccaacaacttatttccttccctgcatcatgtggctcataatctgcaagccgaaaagattcagcctctcatggttcgccaactggacgtgcatttttattggagtgccactgatgatattggcaccgattggaggtctccggcagatcattttgagggtcaagacatacaaattctaccaagactaccatggtttaagccattagccatagttaacagagctcaccatgtctcaggccatcattagcattttaaaaaaaaatcgtaccgtaaaattcctcttttttttgtttctggcatgataagggaaattgacatcatcatgtactgtaatttgcccgtggaaatgcgagttttatgccatgc

SEQ ID NO: 2390 - protein, 472 aa, Panicum virgatum
  misc_feature (1)..(472): useful for making plants with increased tolerance to oxidative stress as described in USSN 12/445,005
  misc_feature (1)..(472): Ceres CLONE ID no.1904659
  misc_feature (1)..(472): Score of 238.3 for HMM of FIGURE 5 of USSN 12/445,005.
  misc_feature (50)..(452): Pfam Name: Aa_trans Pfam Description: Transmembrane amino acid transporter protein
  misc_feature (1)..(472): Functional Homolog Of Ceres SEEDLINE ID no. ME06123
MEIQQLDDYSPAKLASLALAPSKGRTDSKEGSWSAPEKPVEDWRAINSRRNAKWWYAAFHNVTAMVGAGVLSLPFAMSELGWGVGITVLVLSWILTVYTLWQMVEMHEIVPGKRFDRYHELGQHAFGEKLGLWIVVPQQLVVEVGLNIVYMVTGGQSLQKFHDLVCHGRCNNIKLPYFIMIFASVQFVLSQLPNFHSISSISLIAAVMSVSYSTIAWAASTHHHKTNSAEVDYSLRATTTPGKVFDFLGGLGDVAFTYAGHNVVLEIQATIPSTPEKPSKKPMWKGVVVAYIIIAACYFPVAHAGYWAFGNQVDENILIALNKPKWLIAVANMMVVVHVVGSYQVYAMPVFDMIETMLVRKFWFTPDLRLRLISRTVYVAFTMFIAMTFPFFSELLSFFGGFAYAPTTYFLPCIMWLIICKPKRFSLSWFANWTCIFIGVPLMILAPIGGLRQIILRVKTYKFYQDYHGLSH

SEQ ID NO: 2391 - DNA, 1308 bp, Populus balsamifera subsp. trichocarpa
  misc_feature (1)..(1308): useful for making plants with increased tolerance to oxidative stress as described in USSN 12/445,005
  misc_feature (1)..(1308): Ceres ANNOT ID no.1458889
atggtttcagcttctccttctaaggaagaccagtccattggcaaatggaccgaaggcgatcccgctcgccgagccaaatggtggtactcaactttccacacagtcacagccatgatcggtgcaggtgttctaagtctgccctatgccatggcttacttaggctggggtccagggataacggttctggtgttatcttggtgcatgaccctgaacacaatgtggcaaatgatcgaactccatgaatgtgttcctgggactcgctttgatcgctacatcgacctaggtcgacatgctttcggcccgaaattgggaccatggattgtcctacctcagcagctgattgttcaagttggttgtgatatcgtgtacatggttacgggtggaaagagtttaaagaagttcatggagatgacttgcgcctcttgcaccccaataaggcagtcttactggattttgatcttcggtggcatccatttcttcttgtctcagcttccgaatttcaattctgttgctggcgtttcactagctgcagcagtcatgtcactcggttattcaaccatagcctgggcaggttccttggctcatggccagattgataacgtgagctatgcttacaaaaacaccagcgcagctgactacatgtttcgtgtcttcaatgcactgggagaaatttctttcgcgttcgctggccatgcagttgtccttgagattcaggctacaattccatcaactactgagaagccttccaaaatcccaatgtggaaaggtgcactgggtgcttactttatcaatgcaatttgctatttccccgttgcccttatagggtattgggcatttggacaagatgttgatgataatgtccttatggagctgaaaagacccgcatggctcattgcctctgctaatttaatggtggtagttcatgtcattggtagctaccaggtctatgccatgcctgtttttgacatgctagagaggatgatgatgaaaagattcagttttccaccaggacttgcacttaggctcgtaactcgctctacttatgttgcatttacccttttcgttggagtcaccttcccattcttcggagatcttcttggtttctttggcgggtttggttttgcccccacttcatacttcctcccttgcgtaatgtggctaataatcaagaagcctaaaagattcagcaccaaatggtttataaactgggcatgcatattcgttggagtgttcatcatgatggcatccaccattggtgggttccggaatatcgttaccgatgcctcctcgtataggttctacacataa

SEQ ID NO: 2392 - protein, 435 aa, Populus balsamifera subsp. trichocarpa
  misc_feature (1)..(435): useful for making plants with increased tolerance to oxidative stress as described in USSN 12/445,005
  misc_feature (1)..(435): Ceres ANNOT ID no.1458889
  misc_feature (1)..(435): Score of 223.7 for HMM of FIGURE 5 of USSN 12/445,005.
  misc_feature (23)..(422): Pfam Name: Aa_trans Pfam Description: Transmembrane amino acid transporter protein
  misc_feature (1)..(435): Functional Homolog Of Ceres SEEDLINE ID no. ME06123
MVSASPSKEDQSIGKWTEGDPARRAKWWYSTFHTVTAMIGAGVLSLPYAMAYLGWGPGITVLVLSWCMTLNTMWQMIELHECVPGTRFDRYIDLGRHAFGPKLGPWIVLPQQLIVQVGCDIVYMVTGGKSLKKFMEMTCASCTPIRQSYWILIFGGIHFFLSQLPNFNSVAGVSLAAAVMSLGYSTIAWAGSLAHGQIDNVSYAYKNTSAADYMFRVFNALGEISFAFAGHAVVLEIQATIPSTTEKPSKIPMWKGALGAYFINAICYFPVALIGYWAFGQDVDDNVLMELKRPAWLIASANLMVVVHVIGSYQVYAMPVFDMLERMMMKRFSFPPGLALRLVTRSTYVAFTLFVGVTFPFFGDLLGFFGGFGFAPTSYFLPCVMWLIIKKPKRFSTKWFINWACIFVGVFIMMASTIGGFRNIVTDASSYRFYT

SEQ ID NO: 2393 - protein, 440 aa, Arabidopsis thaliana
  misc_feature (1)..(440): useful for making plants with increased tolerance to oxidative stress as described in USSN 12/445,005
  misc_feature (1)..(440): Public GI ID no.15222615
  misc_feature (1)..(440): Score of 222.3 for HMM of FIGURE 5 of USSN 12/445,005.
  misc_feature (28)..(427): Pfam Name: Aa_trans Pfam Description: Transmembrane amino acid transporter protein
  misc_feature (1)..(440): Functional Homolog Of Ceres SEEDLINE ID no. ME06123
MVSSSPVSPSKETDRKSGEKWTAEDPSRPAKWWYSTFHTVTAMIGAGVLSLPYAMAYLGWGPGTFVLAMTWGLTLNTMWQMVQLHECVPGTRFDRYIDLGRYAFGPKLGPWIVLPQQLIVQVGCNIVYMVTGGKCLKQFVEITCSTCTPVRQSYWILGFGGVHFILSQLPNFNSVAGVSLAAAVMSLCYSTIAWGGSIAHGRVPDVSYDYKATNPGDFTFRVFNALGQISFAFAGHAVALEIQATMPSTPERPSKVPMWQGVIGAYVVNAVCYFPVALICYWAFGQDVDDNVLMNLQRPAWLIAAANLMVVVHVIGSYQVFAMPVFDLLERMMVNKFGFKHGVVLRFFTRTIYVAFTLFIGVSFPFFGDLLGFFGGFGFAPTSFFLPSIMWLIIKKPRRFSVTWFVNWISIIVGVFIMLASTIGGLRNIIADSSTYSFYA

SEQ ID NO: 2394 - DNA, 1305 bp, Populus balsamifera subsp. trichocarpa
  misc_feature (1)..(1305): useful for making plants with increased tolerance to oxidative stress as described in USSN 12/445,005
  misc_feature (1)..(1305): Ceres ANNOT ID no.1527205
atgaatcaaatgcagccagtaaaggatatctcaagcattgagaatgcaaagaatgacaatgcgaagaaagacatgaatgactggcttcccatcaccaagtctaggaatgcaaagtggtggtattctgcctttcacaatgttacagccatggttggtgctggggtcctgggcctcccatatgccatgtctcaacttggatggggtcccggtgctgctgtattgatcctgtcatgggttatcactctatatacactatggcagatggtggagatgcatgaaatggtgcctggaaagagatttgataggtatcatgagttagggcagcatgcatttggtgaaaaacttgggctttgggtggtggttccccagcaactaatggtggaagtgggttcgagtatagtgtatatgatcactggagggaaatctctgaagaaggctcatgatactatctggcctaactacaaagaaatcaaacttacctatttcatcatgatcttttcctcggttcactttgtcatctctcatctccccagtttcaactccatcaccgttgtctctcttgccgctgccgtcatgtccttgagttactcgactattgcgtgggtggtttcatggcacaaaggggttcaaccagatgtgcagtatacctcaagggcttcaacaaataccgggcagatgttcgacagcttcagtgctctaggagatatagcttttgccttcgcagggcacagtgtggcgttggagatccaggcaacaatcccttccacaccagggaagccttccaagaaaccaatgtggaaaggagtggttgttgcttatcttgttgtcgctttgtgttacttacctgttagtttcgtaggttactgggtgtttggaaacaaagttgaggacaacatactcttatcactagagaagcctcgttggcttgttgccgtcgctaatttgtttgttgtcattcatgtcattggaagctatcaggtttttgcaatgccggtgtttgatatgatggaagcattcctagtcttgaaaatgaatttccaaccgggattgaccatgttcatcgcaatgacattcccattttttggtgggcttctaagtttctttggaggatttgcctttgctcccacctcatactatctcccctgcgtcatttggcttgctatatataaaccaaagaaattcagcttgtcatggctcgcaaattggatatgcattatccttggcgttgtattgatggtattagcccccattggagcattaaggcagataatactacaagccagggacttccagttttactcttga

SEQ ID NO: 2395 - protein, 431 aa, Populus balsamifera subsp. trichocarpa
  misc_feature (1)..(431): useful for making plants with increased tolerance to oxidative stress as described in USSN 12/445,005
  misc_feature (1)..(431): Ceres ANNOT ID no.1527205
  misc_feature (1)..(431): Score of 214.5 for HMM of FIGURE 5 of USSN 12/445,005.
  misc_feature (32)..(418): Pfam Name: Aa_trans Pfam Description: Transmembrane amino acid transporter protein
  misc_feature (1)..(431): Functional Homolog Of Ceres SEEDLINE ID no. ME06123
MQPVKDISSIENAKNDNAKKDMNDWLPITKSRNAKWWYSAFHNVTAMVGAGVLGLPYAMSQLGWGPGAAVLILSWVITLYTLWQMVEMHEMVPGKRFDRYHELGQHAFGEKLGLWVVVPQQLMVEVGSSIVYMITGGKSLKKAHDTIWPNYKEIKLTYFIMIFSSVHFVISHLPSFNSITVVSLAAAVMSLSYSTIAWVVSWHKGVQPDVQYTSRASTNTGQMFDSFSALGDIAFAFAGHSVALEIQATIPSTPGKPSKKPMWKGVVVAYLVVALCYLPVSFVGYWVFGNKVEDNILLSLEKPRWLVAVANLFVVIHVIGSYQVFAMPVFDMMEAFLVLKMNFQPGLTMFIAMTFPFFGGLLSFFGGFAFAPTSYYLPCVIWLAIYKPKKFSLSWLANWICIILGVVLMVLAPIGALRQIILQARDFQFYS

SEQ ID NO: 2396 - protein, 456 aa, Oryza sativa subsp. japonica
  misc_feature (1)..(456): useful for making plants with increased tolerance to oxidative stress as described in USSN 12/445,005
  misc_feature (1)..(456): Public GI ID no.53749301
  misc_feature (1)..(456): Score of 228.3 for HMM of FIGURE 5 of USSN 12/445,005.
  misc_feature (38)..(443): Pfam Name: Aa_trans Pfam Description: Transmembrane amino acid transporter protein
  misc_feature (1)..(456): Functional Homolog Of Ceres SEEDLINE ID no. ME06123
MSATEVMEECTETARERREEERLRNVNLDDWLPITSSRTAKWYYSAFHNVTAMVGAGVLGLPFAMSQLGWPTGVAAIASSFAITLYTLWQLVELHEPAPGGGKRFDRYHELGQAAFGRRLGVCLIVPLQLIVQVGTDIVYMVTGGQTLKKFVELACDGRCADIRLTFYIMMFASAQFVLSQCPNFNSISAVSAAAAAMSLCYSMIAFFASVLKAHPAAAAAVDYGFKATTAAGRVFGAFNALGAVSFAFAGHNVVLEIQATIPSTPERPSKRPMWRGVVVAYAVVALCYFTVAFGGYHAFGNAVAPNVLISLEKPRWLVAAANLMVVVHVIGAYQVYAMPVFDMIETVLAKKLHLRPGLPLRVTARSAYVALTMFIGITFPFFDGLLGFFGGFGFAPTTYFIPCIIWLIMRKPAKYSLSWLMNWCFIIIGMLLMLVSPIGGLRQIILDASKYKFYS

SEQ ID NO: 2397 - protein, 478 aa, Oryza sativa subsp. japonica
  misc_feature (1)..(478): useful for making plants with increased tolerance to oxidative stress as described in USSN 12/445,005
  misc_feature (1)..(478): Public GI ID no.115458804
  misc_feature (1)..(478): Score of 177.2 for HMM of FIGURE 5 of USSN 12/445,005.
  misc_feature (56)..(465): Pfam Name: Aa_trans Pfam Description: Transmembrane amino acid transporter protein
  misc_feature (1)..(478): Functional Homolog Of Ceres SEEDLINE ID no. ME06123
MGEGRSGVGQAETSASSGDTSMAQGPVERQRRGSGAALGMTTAVVDDAGEGEANPRRAKWWYATFHSVTAMVGAGVLSLPYAMAHLGWGPGTAALVVSWGMTLYTLRLLIELHECVPGVRFDRYRDLGAHALGPRLGPWLVVPQQLIVQLGCDVVYMVIGGKCLMKFAESVSSWSRAPQLHHQSYWICIFGASQFLLSQLPSLDSITAVSLAAAAMSVGYSTISWAACLARGTPAAAEGGGGGVSYAYKDGTAADSVFRVCSALGQVAFAYAGHGVVLEIQATIPSTPTKPSRGAMWKGAVAAYLVTALCYFPVAIAGYWAFGRDVSDNVLVALRRPPWLVAAANMMVVVHVLGSYQVYAMPIFETLETILITRIRLPPGALLRLVARSAYVAFTLFVAVTFPFFGDLLGFFGGFGFTPTSYFLPCILWLKIKKPPRFSASWFANWGCIVVGVLLMIASTIGGLRSIIQDASTFQFYS

SEQ ID NO: 2398 - protein, 484 aa, Oryza sativa subsp. japonica
  misc_feature (1)..(484): useful for making plants with increased tolerance to oxidative stress as described in USSN 12/445,005
  misc_feature (1)..(484): Public GI ID no.125590641
  misc_feature (1)..(484): Score of 165.3 for HMM of FIGURE 5 of USSN 12/445,005.
  misc_feature (62)..(471): Pfam Name: Aa_trans Pfam Description: Transmembrane amino acid transporter protein
  misc_feature (1)..(484): Functional Homolog Of Ceres SEEDLINE ID no. ME06123
MEAYQTHPLIKAMVAGEKKGFADRKFAATVAVCVHRSDLSMVTSSVLPKVVDDAGEGEANPRRAKWWYATFHSVTAMVGAGVLSLPYAMAHLGWGPGTAALVVSWGMTLYTLRLLIELHECVPGVRFDRYRDLGAHALGPRLGPWLVVPQQLIVQLGCDVVYMVIGGKCLMKFAESVSSWSRAPQLHHQSYWICIFGASQFLLSQLPSLDSITAVSLAAAAMSVGYSTISWAACLARGTPAAAEGGGGGVSYAYKDGTAADSVFRVCSALGQVAFAYAGHGVVLEIQATIPSTPTKPSRGAMWKGAVAAYLVTALCYFPVAIAGYWAFGRDVSDNVLVALRRPPWLVAAANMMVVVHVLGSYQVYAMPIFETLETILITRIRLPPGALLRLVARSAYVAFTLFVAVTFPFFGDLLGFFGGFGFTPTSYFLPCILWLKIKKPPRFSASWFANWGCIVVGVLLMIASTIGGLRSIIQDASTFQFYS

SEQ ID NO: 2399 - protein, 446 aa, Arabidopsis thaliana
  misc_feature (1)..(446): useful for making plants with increased tolerance to oxidative stress as described in USSN 12/445,005
  misc_feature (1)..(446): Public GI ID no.2576361
  misc_feature (1)..(446): Score of 183.6 for HMM of FIGURE 5 of USSN 12/445,005.
  misc_feature (34)..(433): Pfam Name: Aa_trans Pfam Description: Transmembrane amino acid transporter protein
  misc_feature (1)..(446): Functional Homolog Of Ceres SEEDLINE ID no. ME06123
MVAQAPHDDHQDDEKLAAARQKEIEDWLPITSSRNAKWWYSAFHNVTAMVGAGVLGLPYAMSQLGWGPGIAVLVLSWVITLYTLWQMVEMHEMVPGKRFDRYHELGQHAFGEKLGLYIVVPQQLIVEIGVCIVYMVTGGKSLKKFHELVCDDCKPIKLTYFIMIFASVHFVLSHLPNFNSISGSFSCCCRYVSQLLNNRMGIISKQRCSRRRSIRLQSENNSRYVFNFFSGLGDVAFAYAGHNVVLEIQATIPSTPEKPSKGPMWRGVIVAYIVVALCYFPVALVGYYIFGNGVEDNILMSLKKPAWLIATANIFVVIHVIGSYQIYAMPVFDMMETLLVKKLNFRPTTTLRFFVRNFYVAATMFVGMTFPFFGGLLAFFGGFAFAPTTYFLPCVIWLAIYKPKKYSLSWWANWVCIVFGLFLMVLSPIGGLRTIVIQAKGYKFYS

SEQ ID NO: 2400 - protein, 456 aa, Arabidopsis thaliana
  misc_feature (1)..(456): useful for making plants with increased tolerance to oxidative stress as described in USSN 12/445,005
  misc_feature (1)..(456): Public GI ID no.21593132
  misc_feature (1)..(456): Score of 1128.1 for HMM of FIGURE 5 of USSN 12/445,005.
  misc_feature (36)..(442): Pfam Name: Aa_trans Pfam Description: Transmembrane amino acid transporter protein
  misc_feature (1)..(456): Functional Homolog Of Ceres SEEDLINE ID no. ME06123
MSPAPSTDPQPISGKKNGGDGGRIPVEEWLPITESRKGNVYTATFHLLCSGIGLQVILLPAAFAALGWVWGTIILTVGFVWKLYTTWLLVQLHEAVPGIRISRYVRLAIASFGVKLGKLLGIFPVMYLSGGACTILVITGGKSIQQLLQIMSDDNTAPLTSVQCFLVFSCIAMIMSQFPNLNSLFGVSLIGAFMGIAYCTVIWILPVASDSQRTQVSVSYATMDKSFVHIFNAIGLIALVYRGNNLVLEIQGTLPSDSKNPSCKTMWRAVMISHALVAICMFPLTFVVYWAYGDKIPATGGPVGNYLKLYTQEHSKRAACFIHLTFIFSCLCSYPINLMPACDNIEMVYITKKKKPASIIVRMMLRVFLSLVCFTIAVGFPFLPYLAVLIGAIALLVTFTYPCFMWISIKKPQRKSPMWLFNVLVGCLGASLSVLLLVASAMRLAQKGLHANFFRP

SEQ ID NO: 2401 - DNA, 1572 bp, Arabidopsis thaliana
  misc_feature (1)..(1572): useful for making plants with increased tolerance to oxidative stress as described in USSN 12/445,005
  misc_feature (1)..(1572): Ceres CLONE ID no.36461
aattatttgatttggaatcacaagaaagtggtggttctcctttatttatgtcaccagccccctccacggatccacaaccaatctccggcaaaaaaaacggcggcgatggtggtaggattccggtagaagagtggctgccgatcacagaatcaagaaaaggaaatgtttatacggcgacgtttcatcttctctgttcgggaattggtctccaagtgattcttcttcctgcagctttcgcagcactcggatgggtatggggaacgataatcttaacggtagggtttgtatggaagctctacacgacgtggcttcttgttcaactccacgaagcggttccgggaattcgtatcagcagatacgtgagactcgcaattgcttcttttggtgtgaagcttgggaaacttctcggaatattccctgtgatgtatctctcaggaggagcttgtacgattctggttataaccggagggaaatcaatacaacaactgttacaaattatgtctgacgacaatacagcgccacttacttcagtgcaatgcttcttggtttttagttgcattgcgatgatcatgtctcagtttccgaatctaaattctctctttggagtctcgttgatcggtgcttttatgggaattgcgtattgcaccgtgatatggattttacctgtagctagtgactcacaaaggactcaagtcagtgtctcgtacgctacaatggataaaagtttcgttcacattttcaacgctattggattgatagctctagtatatcgcgggaacaatctcgtccttgagatacagggtactcttccttccgattcaaagaacccttcatgtaagacaatgtggagagcagtgatgatctctcatgctctcgtcgcgatttgtatgtttccattaacgtttgttgtatattgggcatacggagacaagattccggcgacgggaggtcccgtgggcaactatctgaaactttacacacaagagcactcgaagcgagcagcctgtttcatacacctcacgtttatcttctcttgcttatgttcatatccgataaacttaatgccggcgtgtgacaacatagagatggtgtacataaccaagaagaaaaagcctgcatccatcattgtccggatgatgttgcgtgtgtttttgagcttggtttgtttcactatagccgttggattcccgttcttgccttatctagcggttcttattggagcaatagccttgcttgtgacgtttacgtatccatgtttcatgtggatctctatcaaaaagccccaaaggaaaagcccaatgtggttgtttaacgttttggtgggttgcctaggtgcttctctcagcgttttgcttctggttgcctcggctatgcgtttggctcaaaagggtttgcatgctaacttcttcagaccctaaagcatccttgcaatcgttagaatgtaattagaatttgtggcacacgtggtaaacttgggactactaacatgttcagttgaaatatttaaattttgtaattatgatattttaatgtatacttctctcaaaaaagagaaaatcgtcagttgatgac

SEQ ID NO: 2402 - protein, 456 aa, Arabidopsis thaliana; identical to SEQ ID NO: 2400
  misc_feature (1)..(456): useful for making plants with increased tolerance to oxidative stress as described in USSN 12/445,005
  misc_feature (1)..(456): Ceres CLONE ID no.36461
  misc_feature (1)..(456): Score of 1128.1 for HMM of FIGURE 5 of USSN 12/445,005.
  misc_feature (36)..(442): Pfam Name: Aa_trans Pfam Description: Transmembrane amino acid transporter protein
  misc_feature (1)..(456): Functional Homolog Of Ceres SEEDLINE ID no. ME06123

SEQ ID NO: 2403 - protein, 473 aa, Arabidopsis thaliana
  misc_feature (1)..(473): useful for making plants with increased tolerance to oxidative stress as described in USSN 12/445,005
  misc_feature (1)..(473): Public GI ID no.4455344
  misc_feature (1)..(473): Score of 1041.6 for HMM of FIGURE 5 of USSN 12/445,005.
  misc_feature (58)..(459): Pfam Name: Aa_trans Pfam Description: Transmembrane amino acid transporter protein
  misc_feature (1)..(473): Functional Homolog Of Ceres SEEDLINE ID no. ME06123
MSIALGNLFDLESQESGGSPLFMSPAPSTDPQPISGEKNGGDGGRIPVEEWLPITESRKGNVYTATFHLLCSGIGLQVILLPAAFAALGWVWGTIILTVGFVWKLYTTWLLVQLHEAVPGIRISRYVRLAIASFGGACTILVITGGKSIQQLLQIMSDDNTAPLTSVQCFLVFSCIAMIMSQFPNLNSLFGVSLIGAFMGIAYCTVIWILPVASDSQRTQVSVSYATMDKSFVHIFNAIGLIALVYRGNNLVLEIQVLTNSQLKHDLDGTLPSDSKNPSCKTMWRAVMISHALVAICMFPLTFAVYWAYGDKIPATGGPVGNYLKLYTQEHSKRAACFIHLTFIFSCLCSYPINLMPACDNIEMVYITKKKKPASIIVRMMLRVFLSLVCFTIAVGFPFLPYLAVLIGAIALLVTFTYPCFMWISIKKPQRKSPMWLFNVLVGCLGASLSVLLLVASAMRLAQKGLHANFFRP

SEQ ID NO: 2404 - DNA, 1368 bp, Populus balsamifera subsp. trichocarpa
  misc_feature (1)..(1368): useful for making plants with increased tolerance to oxidative stress as described in USSN 12/445,005
  misc_feature (1)..(1368): Ceres ANNOT ID no.1450630
atgcctcttacagaatcgagaaatggcaatgtcgctactgcagtgttccatttgttatcttcaggaatcggaatccaggcccttctacttccagtagctttcgccactctcggatgggtatggggggcaataagcttgtccctagcatttacatggcagctctacaccatatggactcttgttcaactgcacgaaccaattcctggaattagaactcgctacagcagatatttacagcttgctatagccgcctttggtccaaagcttggaaagttgctagcaatatttccggtaatgtacctctcagggagcacatgtatcatgctgattataaaaggagctggagttatggagctgctattcaagctaatgtgtgaaggtggggctacatgcgatgccaagtctttgaccggggcagagtggttcctggtcttcacttgcatggctatagcattggctcagcgacctaacttgaattccattgctgggttctcactagttggtgccatgagtgccattgggtattgtactctgatttgggcactgcccatttccaaggacaggcccagtggcgtgtcttatgactcacgcaaggggggatctaccatggctggaatgtttgatgtcttgaatgcaattggtataattgtgcttgctttcagggggcataatcttgtgcttgagattcagggaacattgccttcaagcttaacaaatccatccaaaaggacgatgtggagaggggtgagtgtctcgtacatcataatagccatgtgtcagtttcctctagcaatagctggattttgggcttatggaaacaagcatcatggggaatcttttgcatgtgctaattatttgctaccgctttggcagataccttcgaatggagggatgttgactgcatttatgcagttccatggacacgacacatcaagatttgcgaagggccttgtatacttgctagtagtgattaactgccttagttcattccaaatctacgccatgccagttttcgacaacctggaatttaggtacattagcatgaagaacaggcgatgcccatggtgggttcgcattggttttcggctcttcttcggaggattggccttcttcatagctgtggctcttccttttctgccaagcctagctcctttagttggagggatcaccttacccttaacactggcttatccatgtttcatgtggatcttgattaagaaaccccatcaaaaaggtcacgatgccttgtggtgtcttaatctaggacttggatgcttaggcattgttctaagtgttctattggtagttgccgcagcatggaatttggctatcaaaggcctacatgccagcttcttcaaacccctatga

SEQ ID NO: 2405 - protein, 455 aa, Populus balsamifera subsp. trichocarpa
  misc_feature (1)..(455): useful for making plants with increased tolerance to oxidative stress as described in USSN 12/445,005
  misc_feature (1)..(455): Ceres ANNOT ID no.1450630
  misc_feature (1)..(455): Score of 968.3 for HMM of FIGURE 5 of USSN 12/445,005.
  misc_feature (7)..(444): Pfam Name: Aa_trans Pfam Description: Transmembrane amino acid transporter protein
  misc_feature (1)..(455): Functional Homolog Of Ceres SEEDLINE ID no. ME06123
MPLTESRNGNVATAVFHLLSSGIGIQALLLPVAFATLGWVWGAISLSLAFTWQLYTIWTLVQLHEPIPGIRTRYSRYLQLAIAAFGPKLGKLLAIFPVMYLSGSTCIMLIIKGAGVMELLFKLMCEGGATCDAKSLTGAEWFLVFTCMAIALAQRPNLNSIAGFSLVGAMSAIGYCTLIWALPISKDRPSGVSYDSRKGGSTMAGMFDVLNAIGIIVLAFRGHNLVLEIQGTLPSSLTNPSKRTMWRGVSVSYIIIAMCQFPLAIAGFWAYGNKHHGESFACANYLLPLWQIPSNGGMLTAFMQFHGHDTSRFAKGLVYLLVVINCLSSFQIYAMPVFDNLEFRYISMKNRRCPWWVRIGFRLFFGGLAFFIAVALPFLPSLAPLVGGITLPLTLAYPCFMWILIKKPHQKGHDALWCLNLGLGCLGIVLSVLLVVAAAWNLAIKGLHASFFKPL

SEQ ID NO: 2406 - protein, 513 aa, Lilium longiflorum
  misc_feature (1)..(513): useful for making plants with increased tolerance to oxidative stress as described in USSN 12/445,005
  misc_feature (1)..(513): Public GI ID no.452593
  misc_feature (1)..(513): Score of 1181.8 for HMM of FIGURE 5 of USSN 12/445,005.
  misc_feature (89)..(495): Pfam Name: Aa_trans Pfam Description: Transmembrane amino acid transporter protein
  misc_feature (1)..(513): Functional Homolog Of Ceres SEEDLINE ID no. ME06123
MEVQSMPVTPRSGTPRVTPPISAPPSQLHSPSLTRSPLLGPATPRASRLTPLASPIRKAIVSMRGYLEEVGHVTRLDPQDEWLPITQSRNGNSYYSAFHTLSSGIGFQALVVPVAFTFLGWLWGIVLLSVGFCWQLYTLWLLVELHESVPGTRYSRYLHLAKDTFGEKLGKFMALVPIIYLSAGTCSALIIVGGSTMKGFFQIVCGPTCRYMPLTTVEWYLVFVCLAVVLAQLPHLNSIAGVSLIGAVTAVTYCTMIWVISVRKGKIPNISYEAVDTSWDVARVLSILNAIGIIAFAFRGHNLVLEIQGTMPSTQKHPARVPMWRGVKVAYVLIAFCLFPVALIGFWSYGNQIPPNGVLTALNQFHSHDTSRTILGLTTLLVVINCLSSFQIYAMPIFDNMEAGYTSKKNKPCPQWLRSGFRAFFGAVAFLISSAFPFLPQLAGLIGAVALPVTFAYPCFMWIVIKKPERFGVMWWLNWCLGCLGMGLSVVLVVAGVWRLVETGVNISFFDPQ

SEQ ID NO: 2407 - DNA, 1581 bp, Populus balsamifera subsp. trichocarpa
  misc_feature (1)..(1581): useful for making plants with increased tolerance to oxidative stress as described in USSN 12/445,005
  misc_feature (1)..(1581): Ceres ANNOT ID no.1495347
atggaagagaaaaaggaaatgaaattcgtgagacctgaaagtttgaatgttggggcagaaattcctgcaatttctgcacctccatttcagctccactgtccttcaatgacgaggtcaccattgctagacatagctcccaaaactcccaaaacacccaaaagtcccttagcttcgcttctgatgactactcctatagccagccccatgaagaaggcaattgcaagcatgcaatgttacttagaagaagttggccacttcactaagcttgatccccaggatgcatggcttcccataaccgagtctagaaatggtaacgcatactactcggcatttcacacattgagctcaggaattggagttcaagcccttcttcttccacttgctttcaccactcttagctggacttggggaattctatgtctatctctagtgttcatgtggcaactatacactctatggctactgattcagctacatgaatccgagtccgggatgcgttatagccgatatctccggctatcaatggctgcctttggtgaaaagctggggaagcttcttgctctcttcccagtcatgtatctatcaggtggaacctgtgtgaccttgattatgataggtggtggaaccatgaaaatatttttccaaattgtctgtggagatacatgcagcatgaggccattagcaacaatagagtggtacttcctgttcgtttgtttggcaattattctagctcagctccccaacttaaattctatagctggagtttccctgattggagcaatcacagccattagctactgtacactgatatgggtagtgtccattattcaaggtaggcctgagggtgtatcctatgaccctccggagacaaaatccgacatggctagaatttgtgacattctaaatgcacttgggataatcgccttcgctttcagaggtcacaatcttgtgctcgaaatacaggggaccatgccttccagtgcaaagcaaccatcccgtaagccaatgtggagaggagtaaagttggcatatgtgatcatagcgatgtgtttgtttcctcttgcaataggaggctattgggcctatggtaacttgatgccaaacggagggatgctcaatgctctacacaaatatcacggacacagcacctctaagttgctactaggattaacaagcctattcgttgtgcttaactgcctcagctcatttcagatatatgcaatgccagtgttcgacaatctggagctcagattcaccagcaaaatgaagaaaccatgtccctggtggttgcgcatagtgttcaggatcttctttggatgcttggcattttttatatcagtggcacttcctttcttgatgagtttggcaggattgattggaggggttgcactcccagttaccttagcatatccatgtttcatgtggatactcattaaaaaacccacaaaatacagtgcaatctggtgcctgaattggatactgggagtcttggggatggtgcttagcatgctagttatagctggagcaatatggactattgtgaccatgggtatcgaaattcacttcttcaagccccagtaa

SEQ ID NO: 2408 - protein, 491 aa, Populus balsamifera subsp. trichocarpa
  misc_feature (1)..(491): useful for making plants with increased tolerance to oxidative stress as described in USSN 12/445,005
  misc_feature (1)..(491): Ceres ANNOT ID no.1495347
  misc_feature (1)..(491): Score of 1078.0 for HMM of FIGURE 5 of USSN 12/445,005.
  misc_feature (67)..(476): Pfam Name: Aa_trans Pfam Description: Transmembrane amino acid transporter protein
  misc_feature (1)..(491): Functional Homolog Of Ceres SEEDLINE ID no. ME06123
MTRSPLLDIAPKTPKTPKSPLASLLMTTPIASPMKKAIASMQCYLEEVGHFTKLDPQDAWLPITESRNGNAYYSAFHTLSSGIGVQALLLPLAFTTLSWTWGILCLSLVFMWQLYTLWLLIQLHESESGMRYSRYLRLSMAAFGEKLGKLLALFPVMYLSGGTCVTLIMIGGGTMKIFFQIVCGDTCSMRPLATIEWYFLFVCLAIILAQLPNLNSIAGVSLIGAITAISYCTLIWVVSIIQGRPEGVSYDPPETKSDMARICDILNALGIIAFAFRGHNLVLEIQGTMPSSAKQPSRKPMWRGVKLAYVIIAMCLFPLAIGGYWAYGNLMPNGGMLNALHKYHGHSTSKLLLGLTSLFVVLNCLSSFQIYAMPVFDNLELRFTSKMKKPCPWWLRIVFRIFFGCLAFFISVALPFLMSLAGLIGGVALPVTLAYPCFMWILIKKPTKYSAIWCLNWILGVLGMVLSMLVIAGAIWTIVTMGIEIHFFKPQ

SEQ ID NO: 2409 - DNA, 1647 bp, Populus balsamifera subsp. trichocarpa
  misc_feature (1)..(1647): useful for making plants with increased tolerance to oxidative stress as described in USSN 12/445,005
  misc_feature (1)..(1647): Ceres ANNOT ID no.1442446
atggaagagaaaaaggaaatgaaattcgtgagacctgaaagtttgaatgttggggcagaaattcctgcaatttctgcacctccatttcagctccactgtccttcaatgacgaggtcaccattgctagacatagctcccaaaactcccaaaacacccaaaagtcccttagcttcgcttctgatgactactcctatagccagccccatgaagaaggcaattgcaagcatgcaatgttacttagaagaagttggccacttcactaagcttgatccccaggatgcatggcttcccataaccgagtctagaaatggtaacgcatactactcggcatttcacacattgagctcaggaattggagttcaagcccttcttcttccacttgctttcaccactcttagctggacttggggaattctatgtctatctctagtgttcatgtggcaactatacactctatggctactgattcagctacatgaatccgagtccgggatgcgttatagccgatatctccggctatcaatggctgcctttggtgaaaagctggggaagcttcttgctctcttcccagtcatgtatctatcaggtggaacctgtgtgaccttgattatgataggtggtggaaccatgaaaatatttttccaaattgtctgtggagatacatgcagcatgaggccattagcaacaatagagtggtacttcctgttcgtttgtttggcaattattctagctcagctccccaacttaaattctatagctggagtttccctgattggagcaatcacagccattagctactgtacactgatatgggtagtgtccattattcaaggtaggcctgagggtgtatcctatgaccctccggagacaaaatccgacatggctagaatttgtgacattctaaatgcacttgggataatcgccttcgctttcagaggtcacaatcttgtgctcgaaatacaggggaccatgccttccagtgcaaagcaaccatcccgtaagccaatgtggagaggagtaaagttggcatatgtgatcatagcgatgtgtttgtttcctcttgcaataggaggctattgggcctatggtaacttgatgccaaacggagggatgctcaatgctctacacaaatatcacggacacagcacctctaagttgctactaggattaacaagcctattcgttgtgcttaactgcctcagctcatttcagatatatgcaatgccagtgttcgacaatctggagctcagattcaccagcaaaatgaagaaaccatgtccctggtggttgcgcatagtgttcaggatcttctttggatgcttggcattttttatatcagtggcacttcctttcttgatgagtttggcaggattgattggaggggttgcactcccagttaccttagcatatccatgtttcatgtggatactcattaaaaaacccacaaaatacagtgcaatctggtgcctgaattggatactgggagtcttggggatggtgcttagcatgctagttatagctggagcaatatggactattgtgaccatgggtatcgaaattcacttcttcaagccccaatggatgaaataccttcaggagcggcaagcacagccactgcttgaagaatctccccacgcaccaacttaa

SEQ ID NO: 2410 - protein, 513 aa, Populus balsamifera subsp. trichocarpa
  misc_feature (1)..(513): useful for making plants with increased tolerance to oxidative stress as described in USSN 12/445,005
  misc_feature (1)..(513): Ceres ANNOT ID no.1442446
  misc_feature (1)..(513): Score of 1078.0 for HMM of FIGURE 5 of USSN 12/445,005.
  misc_feature (67)..(476): Pfam Name: Aa_trans Pfam Description: Transmembrane amino acid transporter protein
  misc_feature (1)..(513): Functional Homolog Of Ceres SEEDLINE ID no. ME06123
MTRSPLLDIAPKTPKTPKSPLASLLMTTPIASPMKKAIASMQCYLEEVGHFTKLDPQDAWLPITESRNGNAYYSAFHTLSSGIGVQALLLPLAFTTLSWTWGILCLSLVFMWQLYTLWLLIQLHESESGMRYSRYLRLSMAAFGEKLGKLLALFPVMYLSGGTCVTLIMIGGGTMKIFFQIVCGDTCSMRPLATIEWYFLFVCLAIILAQLPNLNSIAGVSLIGAITAISYCTLIWVVSIIQGRPEGVSYDPPETKSDMARICDILNALGIIAFAFRGHNLVLEIQGTMPSSAKQPSRKPMWRGVKLAYVIIAMCLFPLAIGGYWAYGNLMPNGGMLNALHKYHGHSTSKLLLGLTSLFVVLNCLSSFQIYAMPVFDNLELRFTSKMKKPCPWWLRIVFRIFFGCLAFFISVALPFLMSLAGLIGGVALPVTLAYPCFMWILIKKPTKYSAIWCLNWILGVLGMVLSMLVIAGAIWTIVTMGIEIHFFKPQWMKYLQERQAQPLLEESPHAPT

SEQ ID NO: 2411 - DNA, 1906 bp, Glycine max
  misc_feature (1)..(1906): useful for making plants with increased tolerance to oxidative stress as described in USSN 12/445,005
  misc_feature (1)..(1906): Ceres CLONE ID no.573806
atcttcaaagctaagacgtaaagtagtaagcagtttcatcattttttctttttttctctcttttggtacattggaaagaaagaaaggaagcttcaatttcttccaataaagcgtgttttagaacgtgcttttaaggtatatatatatatatataactacatataccaaaaaactgatttgcagctgaaattgctttcgttcattagtatttagtttttcacaagctagggaagacatgggagaagtggctgatgaaggtcaatatttcagatcagaaatagctctattgaattactcggatgcaaccttcaaacccccactttcttctctgttgatacacattgatccactcataatacccaatggccacacttgttctgcatcagaatctgatccatcacccacttctcagcaccatcagcaggagcagcatcccaaagatgcctggcttccaatcactgaatcaagaaatggaaatgcctattatgcagcctttcatattcttaattccaacattggattccaggctctcatgcttcccgttgccttcgccactcttggttgggcatggggtacagtatgtttgtcactagcatttgtttggcaactctatgccatatttcttcttgttcagcttcacgaatccgtccccggaattcgtcacagcagatacctcttccttgccatggctgccttcggtaaaaagttagggaaggtggcagcattattcccggtaatgtacctttcaggaggcacatgcgtcatgataatcatcaccggtggtgggaccctgaaacaattattgaagacgctttgcgacaacgatgatcatgttcatgagcaaataacatgtaatgcccacgcgcttagcggggctgagtggttcttggtgtttacctgtgtcgccattctcattgcacagttgcccaacctcaactcaatggccatggtttctctcgtcggcgccgttacctccgttacttattgcaccctcttttgggttctctctgttaagaatggtaggcccaacaacgtatcctatagctcatccctgcagtcccaagaacacacaccagtggctaagatcaatggcgttctcaatgccattggaatcattgtgctagccttcagaggacacaatgttttgcccgaaatacaggggacgctgccttcaaatttcgaacaaacatccaaaagaccaatgcgaagaggagttagcatatcatatgtactcatttccatgtgcatgtttcccctcgcaattgccggattttgggcctatggaaaccagataaatgacgggggattgttaacttcgttcccacaattccacaagaggcaaatcacaaaattctctatgggtgcaatatatgttctagtaataatacattgtttaaccagctttcaaatatatgcgatgcctgtttttgacaacctggagataagatacacgagcataaagaatcagagatgtccacgattggtgagaacatgcataagactattctttggggggttgacattttttatttcggtcacgttcccattccttccacgcctatcagcactactcggaagcatgacccttgtgcccattacatatgcatacccttgtttcatgtggctatccctcaagaagcctcgtccaagaggttttgtttggtgcttcaacgttgcactcggttgtgtagggatgcttctcagtgctcttttggtagctgcagctatacggactctagctctcaatggcctagatgctaacttcttcaaaccataacaattaatattatgccatccaacagcaactagtatattgccaacaatttattttaatctactgttagtgatatacagaaaatcatttttgaacatgatactccagtaatacaaacgttaagttttgaat

SEQ ID NO: 2412 - protein, 513 aa, Glycine max
  misc_feature (1)..(513): useful for making plants with increased tolerance to oxidative stress as described in USSN 12/445,005
  misc_feature (1)..(513): Ceres CLONE ID no.573806
  misc_feature (1)..(513): Score of 808.7 for HMM of FIGURE 5 of USSN 12/445,005.
  misc_feature (78)..(499): Pfam Name: Aa_trans Pfam Description: Transmembrane amino acid transporter protein
  misc_feature (1)..(513): Functional Homolog Of Ceres SEEDLINE ID no. ME06123
MGEVADEGQYFRSEIALLNYSDATFKPPLSSLLIHIDPLIIPNGHTCSASESDPSPTSQHHQQEQHPKDAWLPITESRNGNAYYAAFHILNSNIGFQALMLPVAFATLGWAWGTVCLSLAFVWQLYAIFLLVQLHESVPGIRHSRYLFLAMAAFGKKLGKVAALFPVMYLSGGTCVMIIITGGGTLKQLLKTLCDNDDHVHEQITCNAHALSGAEWFLVFTCVAILIAQLPNLNSMAMVSLVGAVTSVTYCTLFWVLSVKNGRPNNVSYSSSLQSQEHTPVAKINGVLNAIGIIVLAFRGHNVLPEIQGTLPSNFEQTSKRPMRRGVSISYVLISMCMFPLAIAGFWAYGNQINDGGLLTSFPQFHKRQITKFSMGAIYVLVIIHCLTSFQIYAMPVFDNLEIRYTSIKNQRCPRLVRTCIRLFFGGLTFFISVTFPFLPRLSALLGSMTLVPITYAYPCFMWLSLKKPRPRGFVWCFNVALGCVGMLLSALLVAAAIRTLALNGLDANFFKP

SEQ ID NO: 2413 - protein, 512 aa, Oryza sativa subsp. japonica; identical to SEQ ID NO: 2182
  misc_feature (1)..(512): useful for making plants with increased tolerance to oxidative stress as described in USSN 12/445,005
  misc_feature (1)..(512): Public GI ID no.115459914
  misc_feature (1)..(512): Score of 1401.5 for HMM of FIGURE 5 of USSN 12/445,005.
  misc_feature (84)..(489): Pfam Name: Aa_trans Pfam Description: Transmembrane amino acid transporter protein
  misc_feature (1)..(512): Functional Homolog Of Ceres SEEDLINE ID no. ME06123

SEQ ID NO: 2414 - protein, 508 aa, Oryza sativa subsp. indica
  misc_feature (1)..(508): useful for making plants with increased tolerance to oxidative stress as described in USSN 12/445,005
  misc_feature (1)..(508): Public GI ID no.116310155
  misc_feature (1)..(508): Score of 1380.7 for HMM of FIGURE 5 of USSN 12/445,005.
  misc_feature (80)..(485): Pfam Name: Aa_trans Pfam Description: Transmembrane amino acid transporter protein
  misc_feature (1)..(508): Functional Homolog Of Ceres SEEDLINE ID no. ME06123
MSSEVTSVPPPPVSAPPSQIQSPAAPASSRASPLRGMGTPNIASPVRKAVASVSGYLGEVGQMTRLADPRDAWLPITESRSGNAYYAAFHSFSSGIGFQALVLPVAFSLLGWTWAIICLTVAFAWQLYTLWLLVKLHEPVAGGTRYSRYMYLATTVFGEKWGKILALLPVMYLSAGTCTALIIVGGGSMKLLFNIACGEVCLARPLTTVEWYLVFVCVAALLSQLPNLNSIAGVSLVGATAAVAYCTMIWVVSVAKGRVAGVSYDPVRATDEEDGAIGILNGLGIIAFAFRGHNLVLEIQATMPSTLKHPSHVPMWKGVKAAYVIIALCLYPVAVGGFWAYGDQIPPNGIVSALYKFHSQDVSRVVLGTATLLVIVNCLTTYQIYAMPVFDNMETGYVHKKNRPCPWWMRAGFRALFGAINLLIAVALPFLSELAGLLGGISLPVTLAYPCFMWVAIMRPAKGTAMWYTNWGLGSLGMGLSFVLIVGNLWGLVEKGLHVKFFKPADFQ

SEQ ID NO: 2415 - protein, 508 aa, Oryza sativa subsp. japonica
  misc_feature (1)..(508): useful for making plants with increased tolerance to oxidative stress as described in USSN 12/445,005
  misc_feature (1)..(508): Public GI ID no.115488592
  misc_feature (1)..(508): Score of 941.2 for HMM of FIGURE 5 of USSN 12/445,005.
  misc_feature (83)..(496): Pfam Name: Aa_trans Pfam Description: Transmembrane amino acid transporter protein
  misc_feature (1)..(508): Functional Homolog Of Ceres SEEDLINE ID no. ME06123
MAMAVEGAGAGVVVSEPEVVSIPPTPRGMSTPDGTATPPPAAGRGAATPARRVVEGLRGYLEEVGHLTRLNPQDAWLPITESRSGNARYAAFHTLNAGLGFQALLLPLAFPALGWSWGIISLTVAYFWQLYTLWILVKLHEAVPGRRYNRYVELAQAAFGEKLGMWLSLFPTIYLSAGSATALILVGGETMKLFYQIVCGPICSPSPISTIEWYLVFTSLAIVLSQLPNLNSIAGVSLIGGTTAITYCTMSWVLSVSQPQPPTVSYEPQAYTSLGSSLFSTLNALGIIAFAFRGHNLALEIQATMPSTFKHPAHVPMWRGAKVAYALIAMCLFPVAIGGYWAYGNMVPQGGMLTALYAFHSHDIPRGLLAATFLLVVFNCLSSFQIYSMPVFDSFEAAYTGRTNRPCSVWVRSGFRVFYGFLSLFISVALPFLSSLAGLLGGLTLPVTFAYPCFMWICIKKPERFSSGWYLNWGLGLLGTAFSLALCVGGVWSIISSGMKFKFFKPPS

SEQ ID NO: 2416 - protein, 519 aa, Arabidopsis thaliana
  misc_feature (1)..(519): useful for making plants with increased tolerance to oxidative stress as described in USSN 12/445,005
  misc_feature (1)..(519): Public GI ID no.15220283
  misc_feature (1)..(519): Score of 971.0 for HMM of FIGURE 5 of USSN 12/445,005.
  misc_feature (94)..(507): Pfam Name: Aa_trans Pfam Description: Transmembrane amino acid transporter protein
  misc_feature (1)..(519): Functional Homolog Of Ceres SEEDLINE ID no. ME06123
MDERPETELISIPATPRVSTPEILTPSGQRSPRPATKPSSATWTPTSFISPRFLSPIGTPMKRVLVNMKGYLEEVGHLTKLNPQDAWLPITESRNGNAHYAAFHNLNAGVGFQALVLPVAFAFLGWSWGILSLTIAYCWQLYTLWILVQLHEAVPGKRYNRYVELAQAAFGERLGVWLALFPTVYLSAGTATALILIGGETMKLFFQIVCGPLCTSNPLTTVEWYLVFTSLCIVLSQLPNLNSIAGLSLIGAVTAITYSTMVWVLSVSQPRPATISYEPLSMPSTSGSLFAVLNALGIIAFAFRGHNLVLEIQSTMPSTFKHPAHVPMWRGAKISYFLIALCIFPISIGGFWAYGNLMPSGGMLAALYAFHIHDIPRGLLATAFLLVVFSCLSSFQIYSMPAFDSFEAGYTSRTNKPCSIWVRSGFRVFFGFVSFFIGVALPFLSSLAGLLGGLTLPVTFAYPCFMWVLIKKPAKYSFNWYFHWGLGWLGVAFSLAFSIGGIWSMVTNGLKLKFFKPPN

SEQ ID NO: 2417 - protein, 519 aa, Arabidopsis thaliana
  misc_feature (1)..(519): useful for making plants with increased tolerance to oxidative stress as described in USSN 12/445,005
  misc_feature (1)..(519): Public GI ID no.5688864
  misc_feature (1)..(519): Score of 966.0 for HMM of FIGURE 5 of USSN 12/445,005.
  misc_feature (94)..(507): Pfam Name: Aa_trans Pfam Description: Transmembrane amino acid transporter protein
  misc_feature (1)..(519): Functional Homolog Of Ceres SEEDLINE ID no. ME06123
MDERPETELISIPATPRVSTPEILTPSGQRSPRPATKPSSATWTPTSFISPRFLSPIGTPMKRVLVNMKGYLEEVGHLTKLNPQDAWLPITESRNGNAHYAAFHNLNAGVGFQALVLPVAFAFLGWSWGILSLTIAYCWQLYTLWILVQLHEAVPGKRYNRYVELAQAAFGERLGVWLALFPTVYLSAGTATALILIGGETMKLFFQIVCGPLCTSNPLTTVEWYLVFTSLCIVLSQLPDLNSIAGLSLIGAVTAITYSTMVWVLSVSQPRPATISYEPLSMPSTSGSLFAVLNALGIIAFAFRGHNLVLEIQSTMPSTFKHPAHVPMWRGAKISYFLIALCIFPISIGGFWAYGNLMPSGGMLAALYAFHIHDIPRGLLATAFLLVVFSCLSSFQIYSMPAFDSFEAGYTSRTNKPCSIWVRSGFRVFFGFVSFFIGVALPFLSSLAGLLGGLTLPVTFAYPCFMWVLIKKPAKYSFNWYFHWGLGWLGVAFSLAFSIGGIWSMVTNGLKLKFFKPPN

SEQ ID NO: 2418 - DNA, 1566 bp, Populus balsamifera subsp. trichocarpa
  misc_feature (1)..(1566): useful for making plants with increased tolerance to oxidative stress as described in USSN 12/445,005
  misc_feature (1)..(1566): Ceres ANNOT ID no.1539815
atggaggagagaccagagacggagttaatatccattccagcaacgccacgtgcatcgacgccagagatactgactccttcaggtcagaggtcaccaaggccagcttcaaaggaagcgaaatcatcgacagcatggacaccgacatcgtttatctcgccgaggtttttgagcccaatagggacgccaatgaagagggtgttgattaacatgaagggttatttagaggaagtgggtcatttgactaagctaaatccgcaagatgcttggcttcctatcaccgagtctcgtaatgggaatgctcattatgcggcgtttcataacttgaatgccggtgttgggtttcaagcccttgttttgcctgttgcctttgcttttcttggctggagttggggaatactgtccttaaccatagcctactgctggcaactttacactctatggattctggttcagctgcatgaagctgttcccgggaagagatacaacagatatgtggagcttgcacaagctgcattcggggaaagattaggcctctggcttgcgctcttcccaacagtttatttgtcagctggaaccgcaacagctttgattcttataggaggggagacaatgaaattattcttccaaatagtttgtgggccactctgttcatcaaatcccctaacaacagttgagtggtacctggtattcacttctctatgcatcgttctgtcccagctcccaaatctgaattcaattgcgggactttcactcatcggtgccataacagctatcacttactctaccatggtgtgggttctttctgttagccaacaaaggccacctacaatctcttatgaacccctttctttgccatcctttagtgcttctgtcttttcagtcatgaatgctcttgggattgttgcctttgctttcagagggcacaatctagccatggagattcaggcaacaatgccatcaacatttaagcacccagctcatgtgcccatgtggaaaggagccaaagttgcctatttctttattgctttgtgcctgtttccagtcgccattggaggcttttgggcttatgggaaccttatgccttcaggaggaattctcaatgccctgtatgggtttcacagccacgacattcctcgaggacttcttgcaatgacttttcttctcgtggtgttcaattgcctaagcagcttccagatatattcaatgcctgtttttgacagttttgaagctagctataccacccgaacaaaccgaccatgctccatttgggttcgatccggcttccgggtgttctatggattcatctctttcttcattggggtagcactccctttcctctccagtcttgctggtctcttaggaggattaacactcccagtcacattcgcttacccttgcttcatgtgggttctcataaaaaaaccttccaaatacagtttcaattggtacttcaactggatccttggttggttaggtattgcttttagcttggccttctccattggaggtgtctggagcatggtgaacagtggacttaaattaaaattcttcaagccaccaaattaa

SEQ ID NO: 2419 - protein, 521 aa, Populus balsamifera subsp. trichocarpa
  misc_feature (1)..(521): useful for making plants with increased tolerance to oxidative stress as described in USSN 12/445,005
  misc_feature (1)..(521): Ceres ANNOT ID no.1539815
  misc_feature (1)..(521): Score of 953.2 for HMM of FIGURE 5 of USSN 12/445,005.
  misc_feature (96)..(509): Pfam Name: Aa_trans Pfam Description: Transmembrane amino acid transporter protein
  misc_feature (1)..(521): Functional Homolog Of Ceres SEEDLINE ID no. ME06123
MEERPETELISIPATPRASTPEILTPSGQRSPRPASKEAKSSTAWTPTSFISPRFLSPIGTPMKRVLINMKGYLEEVGHLTKLNPQDAWLPITESRNGNAHYAAFHNLNAGVGFQALVLPVAFAFLGWSWGILSLTIAYCWQLYTLWILVQLHEAVPGKRYNRYVELAQAAFGERLGLWLALFPTVYLSAGTATALILIGGETMKLFFQIVCGPLCSSNPLTTVEWYLVFTSLCIVLSQLPNLNSIAGLSLIGAITAITYSTMVWVLSVSQQRPPTISYEPLSLPSFSASVFSVMNALGIVAFAFRGHNLAMEIQATMPSTFKHPAHVPMWKGAKVAYFFIALCLFPVAIGGFWAYGNLMPSGGILNALYGFHSHDIPRGLLAMTFLLVVFNCLSSFQIYSMPVFDSFEASYTTRTNRPCSIWVRSGFRVFYGFISFFIGVALPFLSSLAGLLGGLTLPVTFAYPCFMWVLIKKPSKYSFNWYFNWILGWLGIAFSLAFSIGGVWSMVNSGLKLKFFKPPN

SEQ ID NO: 2420 - protein, 545 aa, Oryza sativa subsp. japonica
  misc_feature (1)..(545): useful for making plants with increased tolerance to oxidative stress as described in USSN 12/445,005
  misc_feature (1)..(545): Public GI ID no.125591283
  misc_feature (1)..(545): Score of 1365.7 for HMM of FIGURE 5 of USSN 12/445,005.
  misc_feature (84)..(522): Pfam Name: Aa_trans Pfam Description: Transmembrane amino acid transporter protein
  misc_feature (1)..(545): Functional Homolog Of Ceres SEEDLINE ID no. ME06123
MSSEVTSVPPTPTPPPVSTPPSQIQSPAAPASSRASPLRGMGTPNIASPVRKAVASVSGYLGEVGQMTRLADPRDAWLPITESRSGNAYYAAFHSLSSGIGFQALVLPVAFSLLGWTWAIICLTVAFAWQLYTLWLLVKLHEPVAGGTRYSRYMYLATTVFGEKWGKILALLPVMYLSAGTCTALIIVGGGSMKLLFNIACGEVCLARPLTTVEWYLVFVCVAALLSQLPNLNSIAGVSLVGATAAVAYCTMIWVVSVAKGRVAGVSYDPVRTTDEEDGAIGILNGLGIIAFAFRGHNLVLEIQVKSLSHSFRLHSATDNDGKDKVTDECMFAINSQATMPSTLKHPSHVPMWKGVKAAYVIIALCLYPVAVGGFWAYGDQIPPNGILSALYKFHSQDVSRVVLGTATLLVIVNCLTTYQIYAMPVFDNMETGYVHKKNRPCPWWMRAGFRALFGAINLLIAVALPFLSELAGLLGGISLPVTLAYPCFMWVAIMRPAKGTAMWYTNWGLGSLGMGLSFVLIVGNLWGLVEKGLHVKFFKPADFQ

SEQ ID NO: 2421 - protein, 541 aa, Oryza sativa subsp. indica
  misc_feature (1)..(541): useful for making plants with increased tolerance to oxidative stress as described in USSN 12/445,005
  misc_feature (1)..(541): Public GI ID no.125549341
  misc_feature (1)..(541): Score of 1350.0 for HMM of FIGURE 5 of USSN 12/445,005.
  misc_feature (80)..(518): Pfam Name: Aa_trans Pfam Description: Transmembrane amino acid transporter protein
  misc_feature (1)..(541): Functional Homolog Of Ceres SEEDLINE ID no. ME06123
MSSEVTSVPPPPVSAPPSQIQSPAAPASSRASPLRGMGTPNIASPVRKAVASVSGYLGEVGQMTRLADPRDAWLPITESRSGNAYYAAFHSLSSGIGFQALVLPVAFSLLGWTWAIICLTVAFAWQLYTLWLLVKLHEPVAGGTRYSRYMYLATTVFGEKWGKILALLPVMYLSAGTCTALIIVGGGSMKLLFNIACGEVCLARPLTTVEWYLVFVCVAALLSQLPNLNSIAGVSLVGATAAVAYCTMIWVVSVAKGRVAGVSYDPVRATDEEDGAIGILNGLGIIAFAFRGHNLVLEIQVKSLSHSFRLHSATDNDGKDKVTDECMFAINSQATMPSTLKHPSHVPMWKGVKAAYVIIALCLYPVAVGGFWAYGDQIPPNGILSALYKFHSQDVSRVVLGTATLLVIVNCLTTYQIYAMPVFDNMETGYVHKKNRPCPWWMRAGFRALFGAINLLIAVALPFLSELAGLLGGISLPVTLAYPCFMWVAIMRPAKGTAMWYTNWGLGSLGMGLSFVLIVGNLWGLVEKGLHVKFFKPADFQ

SEQ ID NO: 2422 - DNA, 1871 bp, Triticum aestivum
  misc_feature (1)..(1871): useful for making plants with increased tolerance to oxidative stress as described in USSN 12/445,005
  misc_feature (1)..(1871): Ceres CLONE ID no.833489
acttctcctcgctctctctcacacacacagcgcgccgcgctccaagaacaagaagaagaacccactccaagtcgtccaagggagcatggcggcaatggcggagggggcgggggagccggagctggtgtcgatccccgtgacgccgcggggtctgtccacgccggaggggatgtccacgccgccggttaggaggggaggggcagcgacgagcggcgccgggacgccggtgcgccgggtggtggagggcctgcgcggctacctggaggaggtgggccacctcacgcgcctcaacccgcaggacgcctggctccccatcaccgagagccgcagcggcaacgccagctacgctgcattccactccctcaacgccggccttgggttccaggcgctcctcctcccactcgccttccccgccctcggatggagctggggaataatatcattgactggtgcttacttctggcaactgtacacactctccattctagtcaagcttcacgaagcagtcccgggcaggaggtacaacagatatgtggagcttgcacaagctgcatttggagaaaaactgggggtgtggctagctcttttcccaactatttatctttcggcaggcactgcaactgcattgatccttgtcggaggggagactatgaagctcttttaccaaatagtgtgcggccccctttgtacaccgagccctatttcgacggtggagtggtacttggtattcacatccttggcagtcattctttcccagctcccaaatctcaactcgattgctgggctttcgcttatcggtggcgccacagcgataatgtactgcaccatgtcatgggttctctctgtgagccagcaacggccggcagcagtctcttatgaacaagtgagatccacttcttttggctcatcactgttctctaccttgaatgctcttgggataatagcctttgcattcaggggacacaatctttcattagaaatacaggcgacgatgccgtcgactttcaaacaccctgcacatgtgcctatgtggcgcggggccaaagcggcttatcttctgattgcgatgtgcatcttccctgttgccattgggggttactgggcctacgggaacatgatgccaccaggagggatcctgaccgccctctacatcttccacggccacgacatctctcgtgggctcctcgcggcgacgttcctcctcgtcgtgttcaactgccttagcagcttccagatatactccatgccagtgttcgacagcttcgaggccttctacacaggtcgcaccaaccggccctgctcagtctgggtccggtccggattcaggatcttctacgggttcatctcgctcttcatcggcatcgctctgccgttcctctccagcctcgccggccttctgggcggcctaacgctgccggtgacgtttgcctacccgtgcttcatgtggatctgcatcaagaagcctgagaggttcagctacagctggtacgtgaactggggcctcgccctgctcggcaccgccttcagcttggcctcctctgtgggtggtgtctggagcatcattaacactgggatgaagctcaagttcttcaagcccaactagcatgtctactgttttcagcttgcaaatttatgatatataggtatatgcttcttatattacatgccttggcaagaccaatggcattaagtggtgtcgatcttatattagtagactttgtcttggtaaaatgtaagtatcccctgttggataagaaaaacacgagccgatgaaatgatcaaatctcgcagtggcaaccttatgaaggtcaaatgtaactcgaacaatttatataatgactatctctgtggtaacaaaaaaaaaaaaaaaa

SEQ ID NO: 2423 - protein, 502 aa, Triticum aestivum
  misc_feature (1)..(502): useful for making plants with increased tolerance to oxidative stress as described in USSN 12/445,005
  misc_feature (1)..(502): Ceres CLONE ID no.833489
  misc_feature (1)..(502): Score of 923.9 for HMM of FIGURE 5 of USSN 12/445,005.
  misc_feature (78)..(491): Pfam Name: Aa_trans Pfam Description: Transmembrane amino acid transporter protein
  misc_feature (1)..(502): Functional Homolog Of Ceres SEEDLINE ID no. ME06123
MAEGAGEPELVSIPVTPRGLSTPEGMSTPPVRRGGAATSGAGTPVRRVVEGLRGYLEEVGHLTRLNPQDAWLPITESRSGNASYAAFHSLNAGLGFQALLLPLAFPALGWSWGIISLTGAYFWQLYTLSILVKLHEAVPGRRYNRYVELAQAAFGEKLGVWLALFPTIYLSAGTATALILVGGETMKLFYQIVCGPLCTPSPISTVEWYLVFTSLAVILSQLPNLNSIAGLSLIGGATAIMYCTMSWVLSVSQQRPAAVSYEQVRSTSFGSSLFSTLNALGIIAFAFRGHNLSLEIQATMPSTFKHPAHVPMWRGAKAAYLLIAMCIFPVAIGGYWAYGNMMPPGGILTALYIFHGHDISRGLLAATFLLVVFNCLSSFQIYSMPVFDSFEAFYTGRTNRPCSVWVRSGFRIFYGFISLFIGIALPFLSSLAGLLGGLTLPVTFAYPCFMWICIKKPERFSYSWYVNWGLALLGTAFSLASSVGGVWSIINTGMKLKFFKPN

SEQ ID NO: 2424 - DNA, 1584 bp, Populus balsamifera subsp. trichocarpa
  misc_feature (1)..(1584): useful for making plants with increased tolerance to oxidative stress as described in USSN 12/445,005
  misc_feature (1)..(1584): Ceres ANNOT ID no.1450632
atgggtgaagttgttgatgcaaactctactcctgtgacaccaagaccagcctcagtggcaccaacgccaccgatatcagctcctccgtcgcaatttcattcaccgtcgttgtctagatcacctttgctcacacctgatcatattgttccaagcaaaacccccaaaaactcaaccccaagaaatgcaaccccaagaaatagaacacctcgctttattacccctataggtagtcctattagaagggctctcaagctcactagactagaccctgaagatgcttggcttcctatcaccgagtcccgaaatggaaacgcgtggtatgcagcgtttcattgcctttgctcaggaattggttttcaagcacttgtgctccctgtcgccttcactgtccttggctgggcatgggggatcatagccttgactgttgctttcgcatggcagctttacaccctttatttacttgtgcaactccatgaaaacactgaaactggcgttcgctacagcagatatcttcaaattatgagtgcaaatttcggtgagaagaaagcaaagtggctgggcctgttcccaatattgtacctatcaataggcacatgtgtggctctaaacataattggaggatcaacatcaaaattatttttccagactgtatgcggtcaatcatgcacagtcaaaacattaacaccagtggaatggtacctggtgtttgctagtgctgcagttcttctgtctcagctgccaaacttgaactcaatagctggtgtctccctaatcggatccatcacggctgttatgtactgcacaattatgtggatggtttctgttaacaaggacaggctgcctggaatttcatacaaaccagttcgcggaccaaaggaggttgataggctttttgaagttcttaacgcacttggcattgttgcttttgcatttagaggccacaatcttatacttgagatccaggctactatgccttcaagtgagaagcatccatctcgtgtgccaatgtggaggggtgccaaggctgcttatacagttattgcagcatgtatattcccccttgcaattggaggcttctgggcatacggtcaaaggataccaaaaaatggtggtttgcaatctgccttctatgcataccgaaggagagacacctcacaatttatcatgggactcgttagtttacttatcatagtaaatgctcttagctcattccaaatctacgccatgccaatgtttgatgagttagagtcaattttcactaagaggatgaagaggccatgccaatggtggctccgagtgattttgagggcgttcttcgggtatggggtcttctttttggccgtcgcaatcccatctattggaagtgtaggtggtctagtcggaggaatatcactgccagtcacattggcttatccatgcttcatgtggcttaagatgaggaaaccgaacaagtatagcaagatgtggtaccttaactggggactaggaatcattggtttgattcttagcgtgtgtttgatggctgctggagtatatgttatcaaagagaatgataataaattccagtggttcaagcctaagtaa

SEQ ID NO: 2425 - protein, 527 aa, Populus balsamifera subsp. trichocarpa
  misc_feature (1)..(527): useful for making plants with increased tolerance to oxidative stress as described in USSN 12/445,005
  misc_feature (1)..(527): Ceres ANNOT ID no.1450632
  misc_feature (1)..(527): Score of 996.2 for HMM of FIGURE 5 of USSN 12/445,005.
  misc_feature (101)..(516): Pfam Name: Aa_trans Pfam Description: Transmembrane amino acid transporter protein
  misc_feature (1)..(527): Functional Homolog Of Ceres SEEDLINE ID no. ME06123
MGEVVDANSTPVTPRPASVAPTPPISAPPSQFHSPSLSRSPLLTPDHIVPSKTPKNSTPRNATPRNRTPRFITPIGSPIRRALKLTRLDPEDAWLPITESRNGNAWYAAFHCLCSGIGFQALVLPVAFTVLGWAWGIIALTVAFAWQLYTLYLLVQLHENTETGVRYSRYLQIMSANFGEKKAKWLGLFPILYLSIGTCVALNIIGGSTSKLFFQTVCGQSCTVKTLTPVEWYLVFASAAVLLSQLPNLNSIAGVSLIGSITAVMYCTIMWMVSVNKDRLPGISYKPVRGPKEVDRLFEVLNALGIVAFAFRGHNLILEIQATMPSSEKHPSRVPMWRGAKAAYTVIAACIFPLAIGGFWAYGQRIPKNGGLQSAFYAYRRRDTSQFIMGLVSLLIIVNALSSFQIYAMPMFDELESIFTKRMKRPCQWWLRVILRAFFGYGVFFLAVAIPSIGSVGGLVGGISLPVTLAYPCFMWLKMRKPNKYSKMWYLNWGLGIIGLILSVCLMAAGVYVIKENDNKFQWFKPK

SEQ ID NO: 2426 - DNA, 1617 bp, Populus balsamifera subsp. trichocarpa
  misc_feature (1)..(1617): useful for making plants with increased tolerance to oxidative stress as described in USSN 12/445,005
  misc_feature (1)..(1617): Ceres ANNOT ID no.1460559
atgggtgaagttgttgatgcaaactctactcccgtgacaccaaggcctaatgtaaactctactcctgtaacaccaaggccagcctcagtgtcaccaacgccaccgatatcggctcctccgtcgcaatttcattcgccgtcgttgtctagatcacctttgctcacacctgatcatattgttccaagcaaaactccaaggaactcaaccccaagaaatgcaaccccaagacttagaactcctcgctttatgacccctttaggtagtcctcttagaagggctctccaactcacaaaacttgaccctcaagatgcttggcttccaattactgagtcccgaaatggaaacgcatggtatgcagcgtttcattgcctttgctctggcattggttttcaagcactcgtgctccctgtttccttcactgtccttggttgggcatggggcatcatagccttgacagttgcattcgcatggcagctttacactttttatttacttgtgcaactacatgaaaacaccgagactggcattcgttacagcagatatcttcaaattatgagtgcaaatttcggtgagaagaaagcaaagtggctaggcctatttccaatcttgtacctatcaataggtacatgtgtggctctaaacataatcggaggatcaacatcaaaattatttttccagactgtatgcggtcaatcatgcacagtcaaaacattaacaccagtagaatggtacttggtgtttgcgagcgctgcagttcttctgtctcagctaccaaacttgaactcaattgctggtgtatcacttattggatccatcactgctgtcgtgtattgcacaattatgtggatggtttctgttaacaaggataggttgcctggcataacttacaagccagttcgtggaccaaaggaggttgacaggctctttgaagttcttaattcactcgggatcattgcttttgcatttagaggtcacaatctcgtacttgagatccaggctactatgccctcgagtgagaagcatccctcccgtgtgccgatgtggaagggtgccaaggctgcttatgcagttattgcagcatgtttattcccccttgcaattggaggcttttgggcttacggccaaaggataccaaaaaatggtggcttgcaatcagccttctacgcgtaccgaaggaatgacacctcggaatttatcatgggacttgttagtttacttatcataataaatgctctcagctcattccagatctatgccatgccaatgtttgatgagttggagtcgattttcaccaagaggatgaagaagccatgccaatggtggctccgaataatcctgagggcatttttcggatacggggtcttctttttggccgtcgcaatcccgtctatcgggagtgtgggtggtctggtcggaggaatatcattgccggtcacattggcttacccttgcttcatgtggcttaggatgaagaagccaaagaagtatggcaagatgtggtaccttaattggagcctgggaatcactggtttgattctgagcgtgtcttttatggctgccggagtatatgttataaaagagaatgacagtaaatttgagtggttcaagcccaagtaa

SEQ ID NO: 2427 - protein, 456 aa, Populus balsamifera subsp. trichocarpa
  misc_feature (1)..(456): useful for making plants with increased tolerance to oxidative stress as described in USSN 12/445,005
  misc_feature (1)..(456): Ceres ANNOT ID no.1460559
  misc_feature (1)..(456): Score of 861.9 for HMM of FIGURE 5 of USSN 12/445,005.
  misc_feature (30)..(445): Pfam Name: Aa_trans Pfam Description: Transmembrane amino acid transporter protein
  misc_feature (1)..(456): Functional Homolog Of Ceres SEEDLINE ID no. ME06123
MTPLGSPLRRALQLTKLDPQDAWLPITESRNGNAWYAAFHCLCSGIGFQALVLPVSFTVLGWAWGIIALTVAFAWQLYTFYLLVQLHENTETGIRYSRYLQIMSANFGEKKAKWLGLFPILYLSIGTCVALNIIGGSTSKLFFQTVCGQSCTVKTLTPVEWYLVFASAAVLLSQLPNLNSIAGVSLIGSITAVVYCTIMWMVSVNKDRLPGITYKPVRGPKEVDRLFEVLNSLGIIAFAFRGHNLVLEIQATMPSSEKHPSRVPMWKGAKAAYAVIAACLFPLAIGGFWAYGQRIPKNGGLQSAFYAYRRNDTSEFIMGLVSLLIIINALSSFQIYAMPMFDELESIFTKRMKKPCQWWLRIILRAFFGYGVFFLAVAIPSIGSVGGLVGGISLPVTLAYPCFMWLRMKKPKKYGKMWYLNWSLGITGLILSVSFMAAGVYVIKENDSKFEWFKPK

SEQ ID NO: 2428 - DNA, 1853 bp, Panicum virgatum
  misc_feature (1)..(1853): useful for making plants with increased tolerance to oxidative stress as described in USSN 12/445,005
  misc_feature (1)..(1853): Ceres CLONE ID no.1990904
caaccatccagccaaactggtcactggtgactggtgagtagcggcagccggcaccgcacaggtgcggtgcgggcagcagtgagcggagccagagcgggcgccagccaccggagccccgcagcgcggcggccatgtcgtccggcaaggaggccatcagcgaggtgcagtcggcgccgccgacgcccccgcccccgccggtgtccgcgccgccgtcgcgggcgcactcccccgcggcgcacggcggccggtcgtcgccgctgcgcgcgatggcgacgccgctcgcgagccccgtccggaaggcggtggccaccgtgcggggctgcctggaggaggtcggccacatcacgcgcctcgcggacccgcgcgacgcctggctgcccatcaccgagtcccggagcggcaacgcctactacgccgcgttccacaacctcagctccggcgtcgggttccaggcgctcgtgctacccgccgccttcgcctccctcggatggtgcgtgactgcgtggccgtgccggcgacgcacatgcctgcttcttcttcgatcgtcgcgcgcggtggctcacgcgtagcgatgcgttctttggttcctcgcaggacgtgggcgatcatctgcctgacgctggcgttcgcgtggcagctctacacgctgtggctgctcgtcaggcttcacgagcccgtcgcgggcggcgtccgctacagccggtacatgcacctcgccacgacggttttcggcgagcgatgggccaagatcctggcgctgctcccggtgatgtacctgtcggcggggatctgcacggcgctcatcatcgtcggcggcggaagcatgaagatgctgttcggcatcgcgtgcggcgaggcatgcctggcgcggccgctcaccgccgtggagtggtacctggtcttcatctgcgccgccgtgctgctgtcccagctccccaacctcaactccatcgccggcgtgtcgctggtgggcgccaccgccgccgtcgcctactgcaccatgatctgggccgcgtccgtcgccaaggggcgggtgcccggcgtgtcctacgaccccgtcaaggcccccaacgacgtcgacgctgcactgggggtcgtgaatgggctcggaatcattgcctttgctttcagagggcacaatgtcgtactggagattcagggcaccatgccgtcgactctgaagcatccttcacatgtgcccatgtggaagggcgtcaaggtagcctacgccatcgttgcgctctgcttctaccccctggccatcggtggcttctgggcctacggaaaccagatccctccgaacggcatcctgagcgccctgtacaagttccacagccacgatgtgtcccggctggtgctggggatcaccacgctgctggtgatcatcaactgcctgaccacgttccagatctacgccatgcccgtgtacgacaacatggaggccgggtacgtgcaccggaagaaccgtccgtgcccccggtggctgcgctcgggcttccgcgccttcttcggcgccgtcaacttcctcatcgccgtcgcgctgccgttcctgtcggagctcgccggcgtcctgggagggatcgcgcttcccgtcacgctggcgtacccgtgcttcatgtgggtggccatcaagaagccgcgcaagggcacggcgacgtggaacgtcaactgggctctgggcatcctcgggatgagcataagctttgtgctcatagtcgggaacctctggggtctcgtggagaaaggcttgcgtgtcaagttcttcaagcctgcggatgtccagtgaacgcgtgcaaaattgtcaaaaactcggggtctcgattcctaatgaaatatgacgtttggtgttgtgt

SEQ ID NO: 2429 - protein, 432 aa, Panicum virgatum
  misc_feature (1)..(432): useful for making plants with increased tolerance to oxidative stress as described in USSN 12/445,005
  misc_feature (1)..(432): Ceres CLONE ID no.1990904
  misc_feature (1)..(432): Score of 968.4 for HMM of FIGURE 5 of USSN 12/445,005.
  misc_feature (51)..(414): Pfam Name: Aa_trans Pfam Description: Transmembrane amino acid transporter protein
  misc_feature (1)..(432): Functional Homolog Of Ceres SEEDLINE ID no. ME06123
MVRDCVAVPATHMPASSSIVARGGSRVAMRSLVPRRTWAIICLTLAFAWQLYTLWLLVRLHEPVAGGVRYSRYMHLATTVFGERWAKILALLPVMYLSAGICTALIIVGGGSMKMLFGIACGEACLARPLTAVEWYLVFICAAVLLSQLPNLNSIAGVSLVGATAAVAYCTMIWAASVAKGRVPGVSYDPVKAPNDVDAALGVVNGLGIIAFAFRGHNVVLEIQGTMPSTLKHPSHVPMWKGVKVAYAIVALCFYPLAIGGFWAYGNQIPPNGILSALYKFHSHDVSRLVLGITTLLVIINCLTTFQIYAMPVYDNMEAGYVHRKNRPCPRWLRSGFRAFFGAVNFLIAVALPFLSELAGVLGGIALPVTLAYPCFMWVAIKKPRKGTATWNVNWALGILGMSISFVLIVGNLWGLVEKGLRVKFFKPADVQ

SEQ ID NO: 2430 - DNA, 1761 bp, Populus balsamifera subsp. trichocarpa
  misc_feature (1)..(1761): useful for making plants with increased tolerance to oxidative stress as described in USSN 12/445,005
  misc_feature (1)..(1761): Ceres ANNOT ID no.1486399
atggaggagagaccagagacggagttaatatccattccagcaacgccacgtgcatcgacgccagagatactgactccttcaggtcagaggtcaccaaggccagcttcaaaggaagcgaaatcatcgacagcatggacaccgacatcgtttatctcgccgaggtttttgagcccaatagggacgccaatgaagagggtgttgattaacatgaagggttatttagaggaagtgggtcatttgactaagctaaatccgcaagatgcttggcttcctatcaccgagtctcgtaatgggaatgctcattatgcggcgtttcataacttgaatgccggtgttgggtttcaagcccttgttttgcctgttgcctttgcttttcttggctgctttcaacatcgaaacctatcacttccatcgaagtttgatgaccaaaaaaagagttggggaatactgtccttaaccatagcctactgctggcaactttacactctatggattctggttcagctgcatgaagctgttcccgggaagagatacaacagatatgtggagcttgcacaagctgcattcggggaaagattaggcctctggcttgcgctcttcccaacagtttatttgtcagctggaaccgcaacagctttgattcttataggaggggagacaatgaaattattcttccaaatagtttgtgggccactctgttcatcaaatcccctaacaacagttgagtggtacctggtattcacttctctatgcatcgttctgtcccagctcccaaatctgaattcaattgcgggactttcactcatcggtgccataacagctatcacttactctaccatggtgtgggttctttctgttagccaacaaaggccacctacaatctcttatgaacccctttctttgccatcctttagtgcttctgtcttttcagtcatgaatgctcttgggattgttgcctttgctttcagagggcacaatctagccatggagattcaggcaacaatgccatcaacatttaagcacccagctcatgtgcccatgtggaaaggagccaaagttgcctatttctttattgctttgtgcctgtttccagtcgccattggaggcttttgggcttatgggaaccttattgtgctgactaaaggcttggctgcaagtattgtcttaggatatccaattcctgatagaatggctatggcttggacttcgtcaaaaactaaaatctcaccattaccatacgatcaagttttctcaattgccttggagaatctaatgccttcaggaggaattctcaatgccctgtatgggtttcacagccacgacattcctcgaggacttcttgcaatgacttttcttctcgtggtgttcaattgcctaagcagcttccagatatattcaatgcctgtttttgacagttttgaagctagctataccacccgaacaaaccgaccatgctccatttgggttcgatccggcttccgggtgttctatggattcatctctttcttcattggggtagcactccctttcctctccagtcttgctggtctcttaggaggattaacactcccagtcacattcgcttacccttgcttcatgtgggttctcataaaaaaaccttccaaatacagtttcaattggtacttcaactggatccttggttggttaggtattgcttttagcttggccttctccattggaggtgtctggagcatggtgaacagtggacttaaattaaaattcttcaagccaccaaattaa

SEQ ID NO: 2431 - protein, 517 aa, Populus balsamifera subsp. trichocarpa
  misc_feature (1)..(517): useful for making plants with increased tolerance to oxidative stress as described in USSN 12/445,005
  misc_feature (1)..(517): Ceres ANNOT ID no.1486399
  misc_feature (1)..(517): Score of 786.7 for HMM of FIGURE 5 of USSN 12/445,005.
  misc_feature (91)..(308): Pfam Name: Aa_trans Pfam Description: Transmembrane amino acid transporter protein
  misc_feature (1)..(517): Functional Homolog Of Ceres SEEDLINE ID no. ME06123
MKGYLEEVGHLTKLNPQDAWLPITESRNGNAHYAAFHNLNAGVGFQALVLPVAFAFLGCFQHRNLSLPSKFDDQKKSWGILSLTIAYCWQLYTLWILVQLHEAVPGKRYNRYVELAQAAFGERLGLWLALFPTVYLSAGTATALILIGGETMKLFFQIVCGPLCSSNPLTTVEWYLVFTSLCIVLSQLPNLNSIAGLSLIGAITAITYSTMVWVLSVSQQRPPTISYEPLSLPSFSASVFSVMNALGIVAFAFRGHNLAMEIQATMPSTFKHPAHVPMWKGAKVAYFFIALCLFPVAIGGFWAYGNLIVLTKGLAASIVLGYPIPDRMAMAWTSSKTKISPLPYDQVFSIALENLMPSGGILNALYGFHSHDIPRGLLAMTFLLVVFNCLSSFQIYSMPVFDSFEASYTTRTNRPCSIWVRSGFRVFYGFISFFIGVALPFLSSLAGLLGGLTLPVTFAYPCFMWVLIKKPSKYSFNWYFNWILGWLGIAFSLAFSIGGVWSMVNSGLKLKFFKPPN

SEQ ID NO: 2432 - DNA, 1465 bp, Arabidopsis thaliana
  misc_feature (1)..(1465): useful for making plants with increased tolerance to oxidative stress as described in USSN 12/445,005
  misc_feature (1)..(1465): Ceres CLONE ID no.30044
aaagttgtcctaaaaaaaaccacccctctaaatagggagtgagtgagagagagagtgatagtgagaacaaaaaaaaaacatcatttcttctcgcactcttcacctgctccaatggacgaaagacccgagacagagctaatatcaataccagccacaccacgagtttcaacaccggagattctaactccctccggtcaaagatcacctcgtccggccaccaaaccatcgtcggcgacatggactccgacttcgttcatatcaccgaggttcttgagtccgattggtacaccaatgaaacgagttcttgtgaacatgaaagggtatcttgaagaagttggtcatctcactaagctaaacccacaagatgcttggcttccaatcactgaatctcgtaatggaaacgctcattacgctgcttttcacaatctcaacgctggtgttggttttcaagcccttgttcttcccgtcgcgtttgcgtttcttggctggagttggggaatactgtctttaacaatagcatattgctggcaactctacacactgtggattctggttcagttgcacgaagctgtccccgggaaacgctacaatcgatatgtcgagcttgcacaagctgcttttggagaaaggttaggagtatggcttgcattgtttcctacggtttacttatcagcaggaaccgcgacagcgctgattctgatcggtggagagacaatgaaactcttcttccagatagtttgcggtccattatgcacctcgaatccgttaacaacagttgaatggtatttggtgtttacatctctctgcatcgttctgtctcagctaccaaacctcaattctattgcgggactctccttaataggagcagtgactgcaataacttactccacaatggtttgggttctctctgtgagccaaccaagaccagccactatctcatacgagcctctttctatgccttcgacttctggttcactcttcgctgttttgaatgctcttggcattatagcttttgccttcagaggtcacaacttggttttggaaattcagtcgacgatgccatcaacgtttaagcatcctgctcacgtaccaatgtggagaggagccaaaatctcttacttcctcattgctctgtgtatctttccaatctccatcggaggcttttgggcttatgggaaccttatgccttcaggaggtatgcttgctgctttgtatgcattccacatttacgatatcccgagaggcttattagcgacggcatttctcctagtagtcttcagctgcttgagcagttttcagatatactccatgcctgcctttgacagctttgaagctggctacacaagcagaaccaacaagccgtgttcgatttgggtcagatcaggtttccgagtcttttttggttttgtctcgtttttcatcggtgttgctctcccttttctgtctagtcttgcggggttgctcg

SEQ ID NO: 2433 - protein, 451 aa, Arabidopsis thaliana
  misc_feature (1)..(451): useful for making plants with increased tolerance to oxidative stress as described in USSN 12/445,005
  misc_feature (1)..(451): Ceres CLONE ID no.30044
  misc_feature (1)..(451): Score of 779.1 for HMM of FIGURE 5 of USSN 12/445,005.
  misc_feature (94)..(451): Pfam Name: Aa_trans Pfam Description: Transmembrane amino acid transporter protein
  misc_feature (1)..(451): Functional Homolog Of Ceres SEEDLINE ID no. ME06123
MDERPETELISIPATPRVSTPEILTPSGQRSPRPATKPSSATWTPTSFISPRFLSPIGTPMKRVLVNMKGYLEEVGHLTKLNPQDAWLPITESRNGNAHYAAFHNLNAGVGFQALVLPVAFAFLGWSWGILSLTIAYCWQLYTLWILVQLHEAVPGKRYNRYVELAQAAFGERLGVWLALFPTVYLSAGTATALILIGGETMKLFFQIVCGPLCTSNPLTTVEWYLVFTSLCIVLSQLPNLNSIAGLSLIGAVTAITYSTMVWVLSVSQPRPATISYEPLSMPSTSGSLFAVLNALGIIAFAFRGHNLVLEIQSTMPSTFKHPAHVPMWRGAKISYFLIALCIFPISIGGFWAYGNLMPSGGMLAALYAFHIYDIPRGLLATAFLLVVFSCLSSFQIYSMPAFDSFEAGYTSRTNKPCSIWVRSGFRVFFGFVSFFIGVALPFLSSLAGLL

SEQ ID NO: 2434 - DNA, 1741 bp, Triticum aestivum
  misc_feature (1)..(1741): useful for making plants with increased tolerance to oxidative stress as described in USSN 12/445,005
  misc_feature (1)..(1741): Ceres CLONE ID no.910080
atcagcacccaaccgagctcccttgcacacctcctcacaaggtctgggcacctacactggtacagccatagctagctagcgcatactactacaccggagggagcgagcgagcggccatgacgagcgaggtgcagtcggcgccgccgacgccgcggccggtgtccgccccgccgtcgcagatgcactctccggcgcccagccggtcgccgctgcgcgcgatggcgtcgccgctcgccagccccgtgaagaaggcggtggcgagcgtgagggggtacctggaggaggtcgggcacatcaccaagctcgccgacccgcgcgacgcctggctgcccatcaccgcgtccaggagcggcaacgcctactacgccgccttccacaacctcagctccggcgtcggcttccaggcgctcgtgctccccgccgccttcgcctccctcggatgctctacacgctgcggctgctggtgaacctccacgagcccgtcgccggcggcacacgctacagccggtacatgcacctcgccaccaccgtcttcggcgagagatggggcaagatcctggccctgctcccgacgatgtacctgtcggcggggacctgcacggcgctcatcatcgtgggcggcggcagcatgaagatcctcttcagcatcgcgtgcgggccggcgtgcctggcgcggccgccgaccatggtggagtggtacgtcgtcttcgtctgcgtggccgtggtgctgtcccagctccccaacctcaactccatcgccggcgtctccctggtcggggcgacggcggccgtcgggtactgcaccatgatctgggtcatttccgttgccaagggcagggtggccggcgtgtcctacgacccggtcaaggccagcagcgacgtcgacaggacgatcgccgtcctcaatggcctcggcatcatcgcgttcgctttcagggggcacaatcttgtgctcgagattcagggcacaatgccgtcgacgctgaagcacccttctcacgtgcccatgtggaagggcgtcaagttcgcctacctcgtcgtggcgctctgcctctaccccgtcgccatcggcggcttctgggcctacggcaaccagatacctcccaacggaatcctgagcgcgctctacaagttccacagccgcgacgtgtcccggctggttatcggtctcgccaccctgctggtgatcgtgaactgcctgaccacgttccagatctacgcgatgccggtgttcgacaacatggaggccgggtacgtgcacaagaagaaccggccgtgcccgtggtggctgcgcgcgggcttccgcgccttgttcggcgccatcaacctgctcatcgccgtcgcgctgcccttcctgtcggagctggccggcctcctcggcgggatctcgctgccggtcaccctggcctacccgtgcttcatgtggctggcgatcatgaagcccgggaggggcacggcgatgtggtgcgtcaactgggcgctggggtgcctcggcatggggctcagcttcgtcctcatagtcgggaacctctgggggctcgtcgccactggcctgcacgtgcagttcttcaagcccgccgagttccagtgaaactaaagatggaagcaagttttttttttcgagtgaagatggaagcaagtttgctgtctaatccaccaacggaagacatatttatgtgatgtaatgctggcttgtttttcattttgtttctgatgagaaatatactatgtcttgtactgg

SEQ ID NO: 2435 - protein, 383 aa, Triticum aestivum
  misc_feature (1)..(383): useful for making plants with increased tolerance to oxidative stress as described in USSN 12/445,005
  misc_feature (1)..(383): Ceres CLONE ID no.910080
  misc_feature (1)..(383): Score of 910.6 for HMM of FIGURE 5 of USSN 12/445,005.
  misc_feature (2)..(365): Pfam Name: Aa_trans Pfam Description: Transmembrane amino acid transporter protein
  misc_feature (1)..(383): Functional Homolog Of Ceres SEEDLINE ID no. ME06123
MLYTLRLLVNLHEPVAGGTRYSRYMHLATTVFGERWGKILALLPTMYLSAGTCTALIIVGGGSMKILFSIACGPACLARPPTMVEWYVVFVCVAVVLSQLPNLNSIAGVSLVGATAAVGYCTMIWVISVAKGRVAGVSYDPVKASSDVDRTIAVLNGLGIIAFAFRGHNLVLEIQGTMPSTLKHPSHVPMWKGVKFAYLVVALCLYPVAIGGFWAYGNQIPPNGILSALYKFHSRDVSRLVIGLATLLVIVNCLTTFQIYAMPVFDNMEAGYVHKKNRPCPWWLRAGFRALFGAINLLIAVALPFLSELAGLLGGISLPVTLAYPCFMWLAIMKPGRGTAMWCVNWALGCLGMGLSFVLIVGNLWGLVATGLHVQFFKPAEFQ

SEQ ID NO: 2436 - protein, 494 aa, Oryza sativa subsp. indica
  misc_feature (1)..(494): useful for making plants with increased tolerance to oxidative stress as described in USSN 12/445,005
  misc_feature (1)..(494): Public GI ID no.125536645
  misc_feature (1)..(494): Score of 712.5 for HMM of FIGURE 5 of USSN 12/445,005.
  misc_feature (360)..(482): Pfam Name: Aa_trans Pfam Description: Transmembrane amino acid transporter protein
  misc_feature (1)..(494): Functional Homolog Of Ceres SEEDLINE ID no. ME06123
MAMAVEGAGAGVVVSEPEVVSIPPTPRGMSTPEGTATPPPAAGRGAATPARRVVEGLRGYLEEVGHLTRLNPQDAWLPITESRSGNARYAAFHTLNAGLGFQALLLPLAFPALGWRSWGIISLTVAYFWQLYTLWILVKLHEAVPGRRYNRYVELAQAAFAQEIIASGYTKLRTCNVAKILSADLIHLTGEKLGMWLSLFPTIYLSAGSATALILVGGETMKLFYQIVCGPICSPSPISTIEWYLVFTSLAIVLSQLPNLNSIAGVSLIGGTTAITYCTMSWVLSVSQPRPPTVSYEPQAYTSLGSSLFSTLNALGIIAFAFRGHNLALEIQVPQGGMLTALYAFHSHDIPRGLLAATFLLVVFNCLSSFQIYSMPVFDSFEAAYTGRTNRPCSVWVRSGFRVFYGFLSLFISVALPFLSSLAGLLGGLTLPVTFAYPCFMWICIKKPERFSSGWYLNWGLGLLGTAFSLSLCVGGVWSIISSGMKFKFFKPPS

SEQ ID NO: 2437 - protein, 336 aa, Gossypium hirsutum
  misc_feature (1)..(336): useful for making plants with increased tolerance to oxidative stress as described in USSN 12/445,005
  misc_feature (1)..(336): Public PUBLICCLONE ID no.100065345
  misc_feature (1)..(336): Score of 545.1 for HMM of FIGURE 5 of USSN 12/445,005.
  misc_feature (4)..(331): Pfam Name: Aa_trans Pfam Description: Transmembrane amino acid transporter protein
  misc_feature (1)..(336): Functional Homolog Of Ceres SEEDLINE ID no. ME06123
MAAFTLYLLVHLHESPETGMRYSRYLQLCNATFGEKLAKWFALFPILYLSAGTCITLIIIGAQSCRLFFNTVCGGTCSAQPPTNAEWYLIFTSAAVLLSQLPNLNSIAGVSLVGAITAIAYCTLIWVISVVEGRMPGVSYNPVKGRTEVIRIFDILNALGIIAFAFRGHNLILEIQATMPSDEKHPSRVPMWKGVKIAYTLVAMCLFPLAIAGYWAYGQMIPVDGGMLTALFAFHGQDTSQFLLGLTSLCVIISSLSSFQIYGMPAFDDMESLYVKKKKEPSPWWLRLIFRALFGYLCFFAAVAIPFLASFAGLIGGITLPVTLAYPCFMWVKPKA

SEQ ID NO: 2438 - protein, 168 aa, Arabidopsis thaliana
  misc_feature (1)..(168): useful for making plants with increased tolerance to oxidative stress as described in USSN 12/445,005
  misc_feature (1)..(168): Public GI ID no.21593648
  misc_feature (1)..(168): Functional Homolog Of Ceres SEEDLINE ID no. ME12485
MTIPTYNLLCIGSFIFLLCFSITFGRKNLLDKPGGTLYTSKPVEAAELRATLVTNTKARDISSNIGLGEVGSQEMHHTYIGTGEDSSLGNKQDNINSVPRKVIRGIVSISFAFPIIKIQVPIPKPNITVAAINQLDEEEMIKGIVITPTKTNELCISLGNYDVELSYS

SEQ ID NO: 2439 - DNA, 819 bp, Arabidopsis thaliana
  misc_feature (1)..(819): useful for making plants with increased tolerance to oxidative stress as described in USSN 12/445,005
  misc_feature (1)..(819): Ceres CLONE ID no.40875
aattttaaggtggagaaaatgacaataccaacatataaccttttatgcataggatcattcattttcttactatgtttcagcattacctttggtcgcaaaaacctactagacaagcccggtggcactctatatacctccaaacctgttgaagccgccgagcttagagccactttggttactaataccaaagctagagacatttcaagtaatattggtttgggagaggttggaagtcaagagatgcatcacacttacataggaacaggtgaagattcaagtcttggaaataaacaagacaatataaactctgtgcctaggaaggttataagaggtatcgtttccatctcattcgcatttcctatcatcaagattcaggttcctattccgaagccaaatattacggtggctgccataaaccaactcgatgaagaagagatgattaaaggcattgtcataactccaacaaagactaatgagttgtgtatttcccttggaaattacgatgtagagctctcatacagctaaaaacaatttcaagagccgtatgtcgcaggcccattgccagttttctaagggttattctggagatggaagttagtataaaacatatgacgaattgataaagttgatggaagtacttttttttttttggacaaagtacttgatggaagtacttaagttatggttcaagagacaaataagtagttggtgaccaacgagtataaacaaaatatgtagccatctttaacaatgacaaaaggatatatgtgaaccattttgtaatatctatttactatgctataagtacctatgatatat

SEQ ID NO: 2440 - protein, 168 aa, Arabidopsis thaliana; identical to SEQ ID NO: 2438
  misc_feature (1)..(168): useful for making plants with increased tolerance to oxidative stress as described in USSN 12/445,005
  misc_feature (1)..(168): Ceres CLONE ID no.40875
  misc_feature (1)..(168): Functional Homolog Of Ceres SEEDLINE ID no. ME12485

SEQ ID NO: 2441 - protein, 169 aa, Arabidopsis thaliana
  misc_feature (1)..(169): useful for making plants with increased tolerance to oxidative stress as described in USSN 12/445,005
  misc_feature (1)..(169): Public GI ID no.15223328
  misc_feature (1)..(169): Functional Homolog Of Ceres SEEDLINE ID no. ME12485
MTTPTYNLLCIGSFMFLLCFSIGFGRKNLQDKLGDTLFASKPVEATELRAALVSNTEARDISGSIGLGEVGSQEMHHIYIETGEDSSLVNKQDNINSMPRKVIRGTVSISFSFPIIRIKVPIPKPNITVAERNQLNEEEIKGIVITPTKTNEFGLSLGNDGAELGYNYQ

SEQ ID NO: 2442 - DNA, 457 bp, Triticum aestivum
  misc_feature (1)..(457): useful for making plants with increased heat tolerance as described in USSN 12/515,707
  misc_feature (1)..(457): Ceres CLONE ID no.605798
  misc_feature (421)..(421): y is t/u or c
aacccgatcattcgcaccgaccacatcctcatcgtctccaacctcggcgaaaccctagctagccccaccgaagccggagcaagccgagatgtctcgcaccggaccgatcgcccaggactgggagccggtggtcgtgcgcaagaagctgcccaacgccgccgccaagaaggacgagaaggccgtcaacgccgcccgccgcgccggcgtcgacatcgacatcgccaagaagcataatgctgggacaaacaaagctgctcatagcaccacatcgctcaatacaaagaggcttgatgatgatacagagaatcttgctcatgagcgtgtgccgtcagacctgaagaagagcattatgcaggctagaacggacaagaagctcacacaggcacagcttgcacagctgatcaatgagaagccacaagtyatccaggagtacgagtcaggcaaggctatcccaaac

SEQ ID NO: 2443 - protein, 123 aa, Triticum aestivum
  misc_feature (1)..(123): useful for making plants with increased heat tolerance as described in USSN 12/515,707
  misc_feature (1)..(123): Ceres CLONE ID no.605798
  misc_feature (1)..(123): Score of 256.0 for HMM of FIGURE 2 of USSN 12/515,707.
  misc_feature (87)..(123): Pfam Name: HTH_3 Pfam Description: Helix-turn-helix
  misc_feature (9)..(79): Pfam Name: MBF1 Pfam Description: Multiprotein bridging factor 1
  misc_feature (1)..(123): Functional Homolog Of Ceres SEEDLINE ID no. ME04448
  misc_feature (111)..(111): Xaa is any aa, unknown or other
MSRTGPIAQDWEPVVVRKKLPNAAAKKDEKAVNAARRAGVDIDIAKKHNAGTNKAAHSTTSLNTKRLDDDTENLAHERVPSDLKKSIMQARTDKKLTQAQLAQLINEKPQXIQEYESGKAIPN

SEQ ID NO: 2444 - DNA, 441 bp, Zea mays
  misc_feature (1)..(441): useful for making plants with increased heat tolerance as described in USSN 12/515,707
  misc_feature (1)..(441): Ceres CLONE ID no.1276602
ctgcgttgcgtcttgagagggagagagagaggagtgggagacccgcgagaggctgccgtgtagggaccaccgtagactcagcgtctcagctactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaaacgcctcgacgacgacaccgagaacctcgcccatgagcgagttccaagtgatctgaagaagaatctcatgcaagcaaggctcgataagaagctgacacaggcacaacttgctcagatgataaatgagaagccac

SEQ ID NO: 2445 - protein, 109 aa, Zea mays
  misc_feature (1)..(109): useful for making plants with increased heat tolerance as described in USSN 12/515,707
  misc_feature (1)..(109): Ceres CLONE ID no.1276602
  misc_feature (1)..(109): Score of 221.5 for HMM of FIGURE 2 of USSN 12/515,707.
  misc_feature (9)..(79): Pfam Name: MBF1 Pfam Description: Multiprotein bridging factor 1
  misc_feature (80)..(108): Pfam Name: HTH_3 Pfam Description: Helix-turn-helix
  misc_feature (1)..(109): Functional Homolog Of Ceres SEEDLINE ID no. ME04448
MAGIGPIRQDWEPVVVRKKAPTAAAKKDEKAVNAARRAGAEIDTMKKYNAGTNKAASSGTSLNTKRLDDDTENLAHERVPSDLKKNLMQARLDKKLTQAQLAQMINEKP

SEQ ID NO: 2446 - DNA, 478 bp, Triticum aestivum
  misc_feature (1)..(478): useful for making plants with increased heat tolerance as described in USSN 12/515,707
  misc_feature (1)..(478): Ceres CLONE ID no.733766
  misc_feature (358)..(358): n is a, c, t, g, unknown, or other
  misc_feature (430)..(430): n is a, c, t, g, unknown, or other
cgactcgagaacctttcgttcatctccaaaatatcttcctcctctgttctgcgcctccagccctccactatcccttgcgtggttttagtctgtgaactcgagagaccgagcgaggaaagttgccgtgtgagacctgaaagttagggagatatggctgggattggtcctatcaggcaggactgggagccgatagtggcgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacnacacggagaacctttcccatgagcgtgtttcaagtgacctgaagaaaaaccttatgcaagcaagactggatnagaagatgacccaggcacaacttgctcagatgatcaatgagaagccac

SEQ ID NO: 2447 - protein, 109 aa, Triticum aestivum
  misc_feature (1)..(109): useful for making plants with increased heat tolerance as described in USSN 12/515,707
  misc_feature (1)..(109): Ceres CLONE ID no.733766
  misc_feature (1)..(109): Score of 197.0 for HMM of FIGURE 2 of USSN 12/515,707.
  misc_feature (9)..(79): Pfam Name: MBF1 Pfam Description: Multiprotein bridging factor 1
  misc_feature (80)..(108): Pfam Name: HTH_3 Pfam Description: Helix-turn-helix
  misc_feature (1)..(109): Functional Homolog Of Ceres SEEDLINE ID no. ME04448
  misc_feature (70)..(70): Xaa is any aa, unknown or other
  misc_feature (94)..(94): Xaa is any aa, unknown or other
MAGIGPIRQDWEPIVARKKAQNAADKKDEKAVNAARRSGAEIDTTKKYNAGTNKAASSGTSLNTKRLDDXTENLSHERVSSDLKKNLMQARLDXKMTQAQLAQMINEKP

SEQ ID NO: 2448 - DNA, 633 bp, Zea mays
  misc_feature (1)..(633): useful for making plants with increased heat tolerance as described in USSN 12/515,707
  misc_feature (1)..(633): Ceres CLONE ID no.419680
atatcttcttcttggtccgccgtctccactccgcgttccctggctccctgcgttgcgtcttgggggagagagagaagtgggagacccgcgagaggctgccgtgtagggactagggaccgtagagtaagcgacagcgaaggagggagagggggatggccgggatcgggccgatcagacaggactgggagccggtggttgtgcggaagaaggcacccatcgccgctgccaagaaggatgagaaggccgtcaacgccgcgcgccgctccggcgcggagatcgagaccatgaagaagtacaacgctggtatgaacaaggcggcgtccagcggcacatccctcaacaccaagcgcctcgacgatgacacagagaacctcgcccatgagcgagttccaagtgacctgaagaaaaatctcatgcaagcaagggttaataaaagagcgcaccagactagatatttttcttcaaaactttataaggaaagatcaagccattgtttgtttcagttttttggagcttctggccaccaaatgctactgcgggctgtcaaacgctcagcttttcagtcagcttttataaaattcgtttggataaaaaccattcaacatcaacataaacacaaaaaaaaaaaaaaaa

SEQ ID NO: 2449 - protein, 155 aa, Zea mays
  misc_feature (1)..(155): useful for making plants with increased heat tolerance as described in USSN 12/515,707
  misc_feature (1)..(155): Ceres CLONE ID no.419680
  misc_feature (1)..(155): Score of 201.4 for HMM of FIGURE 2 of USSN 12/515,707.
  misc_feature (9)..(79): Pfam Name: MBF1 Pfam Description: Multiprotein bridging factor 1
  misc_feature (83)..(111): Pfam Name: HTH_3 Pfam Description: Helix-turn-helix
  misc_feature (1)..(155): Functional Homolog Of Ceres SEEDLINE ID no. ME04448
MAGIGPIRQDWEPVVVRKKAPIAAAKKDEKAVNAARRSGAEIETMKKYNAGMNKAASSGTSLNTKRLDDDTENLAHERVPSDLKKNLMQARVNKRAHQTRYFSSKLYKERSSHCLFQFFGASGHQMLLRAVKRSAFQSAFIKFVWIKTIQHQHKH

SEQ ID NO: 2450 - DNA, 438 bp, Populus balsamifera subsp. trichocarpa
  misc_feature (1)..(438): useful for making plants with increased heat tolerance as described in USSN 12/515,707
  misc_feature (1)..(438): Ceres ANNOT ID no.1477956
atgccaagcagatcagcaggagtaataaagcaggactgggagccggtggtgatgcacaaggcgaagcccaagtcccaagaccttcgcgatccgaaggtagtgaaccatgccctccgatcgggtgctccagtccagacaatcaagaaattcgacgctgggtctaataagaaagcaacggcaccagtggtgaatgccaggaagttggaggaggagacggagccagcggcgttggacaggatttctacggaggtgaggcaggcgattcaaaaagcgcggctggagaagaagatgagccagacagagcttgctaagctgattaatgagcagccaaaggtggtgcaagagtatgagaatggaaaggcggtgcctaaccaagctattttggccaagatggagagagtgctaggcgtgaagcttagagggaagactggcaagtga

SEQ ID NO: 2451 - protein, 145 aa, Populus balsamifera subsp. trichocarpa
  misc_feature (1)..(145): useful for making plants with increased heat tolerance as described in USSN 12/515,707
  misc_feature (1)..(145): Ceres ANNOT ID no.1477956
  misc_feature (1)..(145): Score of 192.9 for HMM of FIGURE 2 of USSN 12/515,707.
  misc_feature (11)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(145): Functional Homolog Of Ceres SEEDLINE ID no. ME04448
MPSRSAGVIKQDWEPVVMHKAKPKSQDLRDPKVVNHALRSGAPVQTIKKFDAGSNKKATAPVVNARKLEEETEPAALDRISTEVRQAIQKARLEKKMSQTELAKLINEQPKVVQEYENGKAVPNQAILAKMERVLGVKLRGKTGK

SEQ ID NO: 2452 - protein, 144 aa, Vitis vinifera
  misc_feature (1)..(144): useful for making plants with increased heat tolerance as described in USSN 12/515,707
  misc_feature (1)..(144): Public GI ID no.147852829
  misc_feature (1)..(144): Score of 187.4 for HMM of FIGURE 2 of USSN 12/515,707.
  misc_feature (11)..(79): Pfam Name: MBF1 Pfam Description: Multiprotein bridging factor 1
  misc_feature (87)..(141): Pfam Name: HTH_3 Pfam Description: Helix-turn-helix
  misc_feature (1)..(144): Functional Homolog Of Ceres SEEDLINE ID no. ME04448
  misc_feature (6)..(6): Xaa is any aa, unknown or other
MPNRFXGALSQDWEPVVLHKSKPKAQELRDPKAVNKAIRSGAPVQTLKKFDGGANKKAAPIMNTRKLDEGTEPAALDRVSVDVRQLIQKARLEKKMSQAELAKLINERPQVVQEYEEGKAVPNQAVLAKMEKVLGVKLRGKISK

SEQ ID NO: 2453 - protein, 148 aa, Arabidopsis thaliana
  misc_feature (1)..(148): useful for making plants with increased heat tolerance as described in USSN 12/515,707
  misc_feature (1)..(148): Public GI ID no.15230125
  misc_feature (1)..(148): Score of 173.5 for HMM of FIGURE 2 of USSN 12/515,707.
  misc_feature (11)..(83): Pfam Name: MBF1 Pfam Description: Multiprotein bridging factor 1
  misc_feature (91)..(145): Pfam Name: HTH_3 Pfam Description: Helix-turn-helix
  misc_feature (1)..(148): Functional Homolog Of Ceres SEEDLINE ID no. ME04448
MPSRYPGAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 2454 - DNA, 787 bp, Brassica napus
  misc_feature (1)..(787): useful for making plants with increased heat tolerance as described in USSN 12/515,707
  misc_feature (1)..(787): Ceres CLONE ID no.946651
gttctcaatttcagaaacttatcattatcatcatctctctgagacatcaagttttaaacaacagcgacgatgccgagcagatacccaggagccgtgacgcaagactgggagccagtggtgctccacaaaactaagccaaagagccaagacctccgtaatcccaaggcggttaacgcggctctcagaagcggcttagcggttcagacggtgaagaaattcgacgccggttcgaacaagaaggggaaatcgacggctgtgccggtgatcaacacgaagaagctggaggaagagacggagccgtcggcgatggatagggtgaaagcggaggtgaggctagcgatacagaaagctcggttggagaagaagatgtcacaagcggatctagcgaaacagatcaacgagcggacacaggtggttcaagaatacgaaaacgggaaagctgttcctaaccaggccgtacttgccaagattgagaaggttctaggtgttaaactcaggggtaaacatgtcaaataattcaaaacgatgccgtctctggtttcgttcttccttcttttgggtgcacatcttcctattctcaatcttatgaatataaataataacgcttttggcttcgtattcaaacgacatcgtatctgccaaacgattgtcaaatttaaaaaggaaatggatttgttctgtttgagttacttgaatttcttcatacatgagtcatgactggtctaaatatttattctttgcatgtataatgtattcctgtaatcaacaagattaaaaatcctttttt

SEQ ID NO: 2455 - protein, 148 aa, Brassica napus
  misc_feature (1)..(148): useful for making plants with increased heat tolerance as described in USSN 12/515,707
  misc_feature (1)..(148): Ceres CLONE ID no.946651
  misc_feature (1)..(148): Score of 179.9 for HMM of FIGURE 2 of USSN 12/515,707.
  misc_feature (11)..(83): Pfam Name: MBF1 Pfam Description: Multiprotein bridging factor 1
  misc_feature (91)..(145): Pfam Name: HTH_3 Pfam Description: Helix-turn-helix
  misc_feature (1)..(148): Functional Homolog Of Ceres SEEDLINE ID no. ME04448
MPSRYPGAVTQDWEPVVLHKTKPKSQDLRNPKAVNAALRSGLAVQTVKKFDAGSNKKGKSTAVPVINTKKLEEETEPSAMDRVKAEVRLAIQKARLEKKMSQADLAKQINERTQVVQEYENGKAVPNQAVLAKIEKVLGVKLRGKHVK

SEQ ID NO: 2456 - protein, 148 aa, Arabidopsis thaliana
  misc_feature (1)..(148): useful for making plants with increased heat tolerance as described in USSN 12/515,707
  misc_feature (1)..(148): Public GI ID no.21553721
  misc_feature (1)..(148): Score of 172.0 for HMM of FIGURE 2 of USSN 12/515,707.
  misc_feature (11)..(83): Pfam Name: MBF1 Pfam Description: Multiprotein bridging factor 1
  misc_feature (91)..(145): Pfam Name: HTH_3 Pfam Description: Helix-turn-helix
  misc_feature (1)..(148): Functional Homolog Of Ceres SEEDLINE ID no. ME04448
MPSRYPEAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 2457 - protein, 145 aa, Retama raetam
  misc_feature (1)..(145): useful for making plants with increased heat tolerance as described in USSN 12/515,707
  misc_feature (1)..(145): Public GI ID no.19225065
  misc_feature (1)..(145): Score of 168.2 for HMM of FIGURE 2 of USSN 12/515,707.
  misc_feature (11)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(145): Functional Homolog Of Ceres SEEDLINE ID no. ME04448
MPTRATGTITQDWETVVLHKSKPKAQDLRNPKAISQALRAGAEVQTIKKFDAGSNEKTAGPVVYARKLDEAAEPAALERVAGEVRHAIQKARLEKKMSQAEVAKQINERPQVVQEYENGKAVPNQAVLAKMERVLGVKLRGKIGK

SEQ ID NO: 2458 - DNA, 468 bp, Sorghum bicolor
  misc_feature (1)..(468): useful for making plants with increased heat tolerance as described in USSN 12/515,707
  misc_feature (1)..(468): Ceres ANNOT ID no.6065163
atgccgacgggtaggctgagcggcaacatcacgcaggactgggagccggtggttctgcgccggacgaagccgaaggcggccgacctcaagtcggcgaaggcggtgaaccaggcgctgcggtcgggcgcggccgtggagacggtgcgcaagtcggcggcgggcacgaacaagcacttcgcgtccacgaccgtggcgcccgcgcgcaagctggacgagacgacggagccggcggcggtggagcgcgtggcggccgaggtgcgcgcggcgatccagaaggcgcgcgtggccaaagggtggagccaggccgagctggcgaagcgcatcaacgagcgcgcgcaggtggtgcaggagtacgagagcggcaaggcggcgccggcccaggccgtgctcgccaagatggagcgcgccctcgaggtcaagctccgtggcaagggcgtcggcgcgcccctggcggctgccagcaaatga

SEQ ID NO: 2459 - protein, 155 aa, Sorghum bicolor
  misc_feature (1)..(155): useful for making plants with increased heat tolerance as described in USSN 12/515,707
  misc_feature (1)..(155): Ceres ANNOT ID no.6065163
  misc_feature (1)..(155): Score of 186.4 for HMM of FIGURE 2 of USSN 12/515,707.
  misc_feature (12)..(82): Pfam Name: MBF1 Pfam Description: Multiprotein bridging factor 1
  misc_feature (90)..(144): Pfam Name: HTH_3 Pfam Description: Helix-turn-helix
  misc_feature (1)..(155): Functional Homolog Of Ceres SEEDLINE ID no. ME04448
MPTGRLSGNITQDWEPVVLRRTKPKAADLKSAKAVNQALRSGAAVETVRKSAAGTNKHFASTTVAPARKLDETTEPAAVERVAAEVRAAIQKARVAKGWSQAELAKRINERAQVVQEYESGKAAPAQAVLAKMERALEVKLRGKGVGAPLAAASK

SEQ ID NO: 2460 - protein, 155 aa, Oryza sativa subsp. japonica
  misc_feature (1)..(155): useful for making plants with increased heat tolerance as described in USSN 12/515,707
  misc_feature (1)..(155): Public GI ID no.115468750
  misc_feature (1)..(155): Score of 173.6 for HMM of FIGURE 2 of USSN 12/515,707.
  misc_feature (12)..(81): Pfam Name: MBF1 Pfam Description: Multiprotein bridging factor 1
  misc_feature (89)..(143): Pfam Name: HTH_3 Pfam Description: Helix-turn-helix
  misc_feature (1)..(155): Functional Homolog Of Ceres SEEDLINE ID no. ME04448
MPTGRLSGNITQDWEPVVLRRTKPKAADLKSTRAVNQAMRTGAPVETVRKAAAGTNKAAAGAAAPARKLDESTEPAGLGRVGAEVRGAIQKARVAKGWSQAELAKRINERAQVVQEYESGKAVPVQAVLAKMERALEVKLRGKAVGAPAAPAGAK

SEQ ID NO: 2461 - protein, 146 aa, Solanum lycopersicum
  misc_feature (1)..(146): useful for making plants with increased heat tolerance as described in USSN 12/515,707
  misc_feature (1)..(146): Public GI ID no.5669634
  misc_feature (1)..(146): Score of 165.9 for HMM of FIGURE 2 of USSN 12/515,707.
  misc_feature (11)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(146): Functional Homolog Of Ceres SEEDLINE ID no. ME04448
MPMRPTGGLKQDWDPIVLQKPKMKAQDLKDPKIVNQALRAGAQVQTVKKIDAGLNKKAATLAVNVRKLDEAAEPAALEKLPVDVRQAIQKARIEKKMSQADLAKKINERTQVVAEYENGKAVPNQLVLGKMENVLGVKLRGKIHKS

SEQ ID NO: 2462 - protein, 153 aa, Zea mays
  misc_feature (1)..(153): useful for making plants with increased heat tolerance as described in USSN 12/515,707
  misc_feature (1)..(153): Ceres Clone ID no.101137934
  misc_feature (1)..(153): Score of 176.2 for HMM of FIGURE 2 of USSN 12/515,707.
  misc_feature (12)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(153): Functional Homolog Of Ceres SEEDLINE ID no. ME04448
MPTGRLSGNITQDWEPVVLRRTKPKAADLKSSKAVNQALRSGAAVETVRKSAAGMNKHSTTLAPARKLDETTEPAAVERVAVEVRAAIQKARVAKGWSQAELAKRINERAQVVQEYESGKAAPAQAVLAKMERALEVKLRGKGVGAPLAAGGK

SEQ ID NO: 2463 - protein, 153 aa, Zea mays
  misc_feature (1)..(153): useful for making plants with increased heat tolerance as described in USSN 12/515,707
  misc_feature (1)..(153): Ceres Clone ID no.101144543
  misc_feature (1)..(153): Score of 177.0 for HMM of FIGURE 2 of USSN 12/515,707.
  misc_feature (12)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(153): Functional Homolog Of Ceres SEEDLINE ID no. ME04448
MPTGRLSGNITQDWEPVVLRRTKPKAADLKSSKAVNQALRSGAAVETVRKSAAGMNKHSTTVAPARKLDETTEPAAVERVAVEVRAAIQKARVAKGWSQAELAKRINERAQVVQEYESGKAAPAQAVLAKMERALEVKLRGKGVGAPLAAGGK

SEQ ID NO: 2464 - DNA, 596 bp, Parthenium argentatum
  misc_feature (1)..(596): useful for making plants with increased heat tolerance as described in USSN 12/515,707
  misc_feature (1)..(596): Ceres CLONE ID no.1607224
  misc_feature (549)..(549): k is g or t/u
acatcatctcatctcatctcatctcatctcatcaacatcaaacatacatcaatagcataccgtcactaacaacctccttccaaaaccttcatcatatattcatataactacctattcatataaactatctatttataataacctgacaatgccaacaagaccagcaggaccagtatctcaagactgggagccagtagtcctccacaaatccaaaccaaaatcacacgtcctccatgacaccaaatcaataaaccaagccatccgctcaggcgctcaagtccaaacagtaaaaaaacacgacggaggaacgaacaaaaagtctcccgctactgttatttacgccaggaagctcgacgaggcagaacagcctgcaacaattgaacgagtgggaacagaggtgaggcagttgatacagaaggcaaggattgagaagaagatgagtcaagcagagttagctaagcagattaatgaacggactcaggttgttcaggagtatgagaacgggaaggcggttccgaaccaggtggtgttggggaagatggagagggkttttgggtgtgaagcttagagggaagatacataagtgatgatgtttt

SEQ ID NO: 2465 - protein, 139 aa, Parthenium argentatum
  misc_feature (1)..(139): useful for making plants with increased heat tolerance as described in USSN 12/515,707
  misc_feature (1)..(139): Ceres CLONE ID no.1607224
  misc_feature (1)..(139): Score of 149.7 for HMM of FIGURE 2 of USSN 12/515,707.
  misc_feature (11)..(80): Pfam Name: MBF1 Pfam Description: Multiprotein bridging factor 1
  misc_feature (88)..(138): Pfam Name: HTH_3 Pfam Description: Helix-turn-helix
  misc_feature (1)..(139): Functional Homolog Of Ceres SEEDLINE ID no. ME04448
  misc_feature (134)..(134): Xaa is any aa, unknown or other
MPTRPAGPVSQDWEPVVLHKSKPKSHVLHDTKSINQAIRSGAQVQTVKKHDGGTNKKSPATVIYARKLDEAEQPATIERVGTEVRQLIQKARIEKKMSQAELAKQINERTQVVQEYENGKAVPNQVVLGKMERXFGCEA

SEQ ID NO: 2466 - DNA, 719 bp, Panicum virgatum
  misc_feature (1)..(719): useful for making plants with increased heat tolerance as described in USSN 12/515,707
  misc_feature (1)..(719): Ceres CLONE ID no.1760169
aacctccgtgttcgagatcgtgagcgcaagagacagaggagagagagagaggagggagggaagcagcgatgccgacgggtaggctgagcggcaacatcacccaggactgggagccggtggtgctgcggcggacgaagccgaaggcggcggacctcaagtcggcgaaggcggtgaaccaggcgctgcgctcgggcgcggccgtggagacggtgcggaagtcggcggcgggcacgaacaagcacgccgcggcgccggcggcgcccgcgcggaagctggacgagacgacagagcccgcggcggtggagcgggtggccgcggaggtgcgcgcggcgatccagcgggcgcgcgtggccaaggggtggagccaggcggagctggcgaagcgcatcagcgagcgcgcgcaggtggtgcaggagtacgagagcggcagggcggcgcccgcgcaggccgtgctcgccaagatggagcgcgcgctcgaggtcaagctccgcggcaggggcgtcggcgcgcccctggcggccggcggcggcaagtgatgcggtggccctgtgcagaccggaacgtcgatagcttaacttctttcggcccgtggaggaggatgcgaatcggcggtgaatgatgtgtaatttgtttgtgttgatctgatcggcttggaagatttggagaatgtaaatcagtagtgacgcattcgcaagtgatttctagaaatctattggtgc

SEQ ID NO: 2467 - protein, 155 aa, Panicum virgatum
  misc_feature (1)..(155): useful for making plants with increased heat tolerance as described in USSN 12/515,707
  misc_feature (1)..(155): Ceres CLONE ID no.1760169
  misc_feature (1)..(155): Score of 168.3 for HMM of FIGURE 2 of USSN 12/515,707.
  misc_feature (12)..(81): Pfam Name: MBF1 Pfam Description: Multiprotein bridging factor 1
  misc_feature (89)..(143): Pfam Name: HTH_3 Pfam Description: Helix-turn-helix
  misc_feature (1)..(155): Functional Homolog Of Ceres SEEDLINE ID no. ME04448
MPTGRLSGNITQDWEPVVLRRTKPKAADLKSAKAVNQALRSGAAVETVRKSAAGTNKHAAAPAAPARKLDETTEPAAVERVAAEVRAAIQRARVAKGWSQAELAKRISERAQVVQEYESGRAAPAQAVLAKMERALEVKLRGRGVGAPLAAGGGK

SEQ ID NO: 2468 - DNA, 703 bp, Panicum virgatum
  misc_feature (1)..(703): useful for making plants with increased heat tolerance as described in USSN 12/515,707
  misc_feature (1)..(703): Ceres CLONE ID no.2030861
aacctccgtgttcgagatcgtgagcgcaagagacagaggagggagggaagcagcgatgccgacgggtaggctgagcggcaacatcacccaggactgggagccggtggtgctgcggcggacgaagccgaaggcggcggacctcaagtcggcgaaggcggtgaaccaggcgctgcgctcgggcgcggccgtggagacggtgcggaagtcggcggcgggcacgaacaagcacgccgcggcgccggcggcgcccgcgcggaagctggacgagacgacggagcccgcggcggtggagcgggtggccgcggaggtgcgcgcggcgatccagcgggcgcgcgtggccaaggggtggagccaggcggagctggcgaagcgcatcagcgagcgcgcgcaggtggtgcaggagtacgagagcggcagggcggcgcccgcgcaggccgtgctcgccaagatggagcgcgcgctcgaggtcaagctccgcggcaggggcgtcggcgcgcccctggcggccggcggcggcaagtgatgcggtggccctgtgcagaccggaacgtcgatagcttaacttatttcggcccgtggaggaggatgcgaatcggcggtgaatgatgtgtagtttgtttgtgttgatctgatcggcttggaagatttggagaatgtaaatcagtagtgacgcattcgcaagtgatttctagaaatctattgg

SEQ ID NO: 2469 - protein, 155 aa, Panicum virgatum; identical to SEQ ID NO: 2467
  misc_feature (1)..(155): useful for making plants with increased heat tolerance as described in USSN 12/515,707
  misc_feature (1)..(155): Ceres CLONE ID no.2030861
  misc_feature (1)..(155): Score of 168.3 for HMM of FIGURE 2 of USSN 12/515,707.
  misc_feature (12)..(81): Pfam Name: MBF1 Pfam Description: Multiprotein bridging factor 1
  misc_feature (89)..(143): Pfam Name: HTH_3 Pfam Description: Helix-turn-helix
  misc_feature (1)..(155): Functional Homolog Of Ceres SEEDLINE ID no. ME04448

SEQ ID NO: 2470 - DNA, 616 bp, Triticum aestivum
  misc_feature (1)..(616): useful for making plants with increased heat tolerance as described in USSN 12/515,707
  misc_feature (1)..(616): Ceres CLONE ID no.638899
acgagaaaagagaaagagcgagagccgaggagaagataaaatctacaggaaaaacaggggagaggcagagagaacagaggcgaaggagcaatgccgacgggtcggatgagcggcaacatcacgcaggactgggagccggtggtcctgcggcgggcgaagcccaaggcggccgacctcaagtccgccaaggcggtgaaccaggcgctgcggacgggcgcgccggtggagacggtgcgcaaggcggcggcggggacgaacaagaatgcctccgccgcggccgtggcggcgcccgcgcggaagctggacgagatgacggagccggcggggctggggcgcgtgggcggcgacgtgcgcgcggccatccagaaggcgcgcgtcgccaaagggtggagccaggcggagctggccaagcgcgtcaacgagcgggcgcaggtggtgcaggagtacgagagcggcaaggccgtccctgtccaggccgtgctcgccaagatggagcgcgccctcgaggtcaagctccggggcaaggcggttggggcgcccgcgccgacaaagtgatggttcgtggggacatatcctgcctgtgaatttgtgatgaatggtagtaaatcggatctgc

SEQ ID NO: 2471 - protein, 154 aa, Triticum aestivum
  misc_feature (1)..(154): useful for making plants with increased heat tolerance as described in USSN 12/515,707
  misc_feature (1)..(154): Ceres CLONE ID no.638899
  misc_feature (1)..(154): Score of 173.3 for HMM of FIGURE 2 of USSN 12/515,707.
  misc_feature (12)..(83): Pfam Name: MBF1 Pfam Description: Multiprotein bridging factor 1
  misc_feature (91)..(145): Pfam Name: HTH_3 Pfam Description: Helix-turn-helix
  misc_feature (1)..(154): Functional Homolog Of Ceres SEEDLINE ID no. ME04448
MPTGRMSGNITQDWEPVVLRRAKPKAADLKSAKAVNQALRTGAPVETVRKAAAGTNKNASAAAVAAPARKLDEMTEPAGLGRVGGDVRAAIQKARVAKGWSQAELAKRVNERAQVVQEYESGKAVPVQAVLAKMERALEVKLRGKAVGAPAPTK

SEQ ID NO: 2472 - protein, 153 aa, Zea mays
  misc_feature (1)..(153): useful for making plants with increased heat tolerance as described in USSN 12/515,707
  misc_feature (1)..(153): Ceres Clone ID no.101136883
  misc_feature (1)..(153): Score of 173.2 for HMM of FIGURE 2 of USSN 12/515,707.
  misc_feature (12)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(153): Functional Homolog Of Ceres SEEDLINE ID no. ME04448
  misc_feature (125)..(125): Xaa is any aa, unknown or other
MPTGRLSGNITQDWEPVVLRRTKPKAADLKSSKAVNQALRSGAAVETVRKSAAGMNKHSTTVAPARKLDETTEPAAVERVAVEVRAAIQKARVAKGWSQAELAKRINERAQVVQEYESGKAAPAXAVLAKMERALEVKLRGKGVGAPLAAGGK

SEQ ID NO: 2473 - DNA, 675 bp, Zea mays
  misc_feature (1)..(675): useful for making plants with increased heat tolerance as described in USSN 12/515,707
  misc_feature (1)..(675): Ceres CLONE ID no.348434
aagtcctatcaacagcgtgctcgagattacagagatgccaactggtaggctgagcggcaacatcacccaggactgggagccggtggttctgcgccgtacgaagccgaaggcggccgacctcaagtcgtcgaaggcggtgaaccaggcgctgcgatcgggcgcggccgtggagacggtgcgcaagtcagcagcgggcatgaacaagcactccgctgcggtggcgcccgcgcgtaagctggacgagacgacggagcccgctgcggtggagcgggtggctgtggaggtgcgcgcggccattcagaaggcgcgcgtggccaagggatggagccaggcggagctggcgaagcacatcaacgagcgcgcgcaggtggtgcaggagtacgagagcagcaaggcggcgccggcccaggccgtgcttgccaagatggagcgcgctctcgaggtcaagctccgcgggaagggcgtcggcgcgccactggcggccgtcgggaagtgatctgatgtgatggacttgtgcagattgcaacgttgatagcttaacctctttttttgaatcggctggttcggatgtgcagtttgtgtttgtaggatcgtaattgtgggaatattatatgatgtgaaggacttgtttcgaagtttgactggtaaatggttgcgggtgaaaaaaaaaaaaaa

SEQ ID NO: 2474 - protein, 153 aa, Zea mays
  misc_feature (1)..(153): useful for making plants with increased heat tolerance as described in USSN 12/515,707
  misc_feature (1)..(153): Ceres CLONE ID no.348434
  misc_feature (1)..(153): Score of 170.2 for HMM of FIGURE 2 of USSN 12/515,707.
  misc_feature (12)..(80): Pfam Name: MBF1 Pfam Description: Multiprotein bridging factor 1
  misc_feature (88)..(142): Pfam Name: HTH_3 Pfam Description: Helix-turn-helix
  misc_feature (1)..(153): Functional Homolog Of Ceres SEEDLINE ID no. ME04448
MPTGRLSGNITQDWEPVVLRRTKPKAADLKSSKAVNQALRSGAAVETVRKSAAGMNKHSAAVAPARKLDETTEPAAVERVAVEVRAAIQKARVAKGWSQAELAKHINERAQVVQEYESSKAAPAQAVLAKMERALEVKLRGKGVGAPLAAVGK

SEQ ID NO: 2475 - DNA, 711 bp, Panicum virgatum
  misc_feature (1)..(711): useful for making plants with increased heat tolerance as described in USSN 12/515,707
  misc_feature (1)..(711): Ceres CLONE ID no.2032523
atcatcctccgcgttcgagatcgtgagcgctagagagagacagaggaagagagaggagggagcgaagcaaccatgccgacgggtaggctgagcggcaacatcacccaggactgggagccggtggtgctgcggcggacgaagccgaaggcggcggacctcaagtcggcgaaggcggtgaaccaggcgctgcgctcgggcgcggccgtggagacggtgcggaaggcggcggcgggcacgaacaggcacgccgcggcgccggcggcgcccgcgcggaagctggacgagacgacggagcccgcggcggtggagcgggtggccgcggaggtgcgcgcggcgatccagagggcgcgcgcggccaaggggtggagccaggcggagctggccaagcgcatcagcgagcgcgcgcaggtggtgcaggagtacgagagcggcagggcggcgcccgcgcaggccgtgctcgccaagatgtagcgcgcgctcgaggtcaagctccggcggcggcaagtgatcgatgcggtggccctgtgcagaccggaacgggtcgatggattaacctctttcggctcgtggagggtgcgaatcggcggcgaatcggatgtgtagtttgttcgtgttgtgatcggcttggaagacttgggggggatgcaatcagtagtaacgcgtgcgctagtgatttccagaaattttcttgtgtttgtggtgatcgcttgg

SEQ ID NO: 2476 - protein, 132 aa, Panicum virgatum
  misc_feature (1)..(132): useful for making plants with increased heat tolerance as described in USSN 12/515,707
  misc_feature (1)..(132): Ceres CLONE ID no.2032523
  misc_feature (1)..(132): Score of 122.0 for HMM of FIGURE 2 of USSN 12/515,707.
  misc_feature (12)..(81): Pfam Name: MBF1 Pfam Description: Multiprotein bridging factor 1
  misc_feature (89)..(132): Pfam Name: HTH_3 Pfam Description: Helix-turn-helix
  misc_feature (1)..(132): Functional Homolog Of Ceres SEEDLINE ID no. ME04448
MPTGRLSGNITQDWEPVVLRRTKPKAADLKSAKAVNQALRSGAAVETVRKAAAGTNRHAAAPAAPARKLDETTEPAAVERVAAEVRAAIQRARAAKGWSQAELAKRISERAQVVQEYESGRAAPAQAVLAKM

SEQ ID NO: 2477 - DNA, 459 bp, Triticum aestivum
  misc_feature (1)..(459): useful for making plants with increased heat tolerance as described in USSN 12/515,707
  misc_feature (1)..(459): Ceres CLONE ID no.685323
  misc_feature (311)..(311): n is a, c, t, g, unknown, or other
acgagaacagagaaagagaaaggcgaggagaagataaaatcaagaggggaaacagggtagaggcagagagaacagaaggagcgatgccgactggtaggatgagcggcaacatcacgcaggactgggagccggtggtcctgcggcgggcgaagcccaaggcggccgacctcaagtccgccaaggcggtgaaccaggcgctgcggacgggcgcgccggtggagacggtgcgcaaggtggcggcgggcacgaacaagaaggcctccgccgcggccgtggcggcgcccgcgaggaagctggacgagatgacgganccggcggggctggagcgcgtgggcggcgacgtgcgggcggccatccagaaggcgcgcgtggccaaagggtggagccaggcggagctggccaagcgcatcagcgagcgggcgcaggtggtgcaggagtacgagagcggcaaggccgtcc

SEQ ID NO: 2478 - protein, 125 aa, Triticum aestivum
  misc_feature (1)..(125): useful for making plants with increased heat tolerance as described in USSN 12/515,707
  misc_feature (1)..(125): Ceres CLONE ID no.685323
  misc_feature (1)..(125): Score of 101.1 for HMM of FIGURE 2 of USSN 12/515,707.
  misc_feature (12)..(83): Pfam Name: MBF1 Pfam Description: Multiprotein bridging factor 1
  misc_feature (91)..(124): Pfam Name: HTH_3 Pfam Description: Helix-turn-helix
  misc_feature (1)..(125): Functional Homolog Of Ceres SEEDLINE ID no. ME04448
  misc_feature (76)..(76): Xaa is any aa, unknown or other
MPTGRMSGNITQDWEPVVLRRAKPKAADLKSAKAVNQALRTGAPVETVRKVAAGTNKKASAAAVAAPARKLDEMTXPAGLERVGGDVRAAIQKARVAKGWSQAELAKRISERAQVVQEYESGKAV

SEQ ID NO: 2479 - protein, 148 aa, Gallus gallus
  misc_feature (1)..(148): useful for making plants with increased heat tolerance as described in USSN 12/515,707
  misc_feature (1)..(148): Public GI ID no.57525242
  misc_feature (1)..(148): Score of 168.1 for HMM of FIGURE 2 of USSN 12/515,707.
  misc_feature (4)..(73): Pfam Name: MBF1 Pfam Description: Multiprotein bridging factor 1
  misc_feature (81)..(135): Pfam Name: HTH_3 Pfam Description: Helix-turn-helix
  misc_feature (1)..(148): Functional Homolog Of Ceres SEEDLINE ID no. ME04448
MAESDWDTVTVLRKKGPSAAQAKSKQAVLAAQRRGEDVETSKKWAAGQNKQHFITKNTAKLDRETEELHHDRVPLEVGKVIQQGRQSKGMTQKDLATKINEKPQVIADYESGRAIPNNQVMGKIERAIGLKLRGKDIGKPLETGPKGK

SEQ ID NO: 2480 - protein, 148 aa, Homo sapiens
  misc_feature (1)..(148): useful for making plants with increased heat tolerance as described in USSN 12/515,707
  misc_feature (1)..(148): Public GI ID no.4503453
  misc_feature (1)..(148): Score of 168.3 for HMM of FIGURE 2 of USSN 12/515,707.
  misc_feature (4)..(73): Pfam Name: MBF1 Pfam Description: Multiprotein bridging factor 1
  misc_feature (81)..(135): Pfam Name: HTH_3 Pfam Description: Helix-turn-helix
  misc_feature (1)..(148): Functional Homolog Of Ceres SEEDLINE ID no. ME04448
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 2481 - protein, 190 aa, Canis familiaris
  misc_feature (1)..(190): useful for making plants with increased heat tolerance as described in USSN 12/515,707
  misc_feature (1)..(190): Public GI ID no.73967496
  misc_feature (1)..(190): Score of 168.3 for HMM of FIGURE 2 of USSN 12/515,707.
  misc_feature (123)..(177): Pfam Name: HTH_3 Pfam Description: Helix-turn-helix
  misc_feature (46)..(115): Pfam Name: MBF1 Pfam Description: Multiprotein bridging factor 1
  misc_feature (1)..(190): Functional Homolog Of Ceres SEEDLINE ID no. ME04448
MGRQGRVGGRRRKRPSDEGTSRRRVSSSCRGTAGRTRTCPPAMAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 2482 - protein, 148 aa, Xenopus laevis
  misc_feature (1)..(148): useful for making plants with increased heat tolerance as described in USSN 12/515,707
  misc_feature (1)..(148): Public GI ID no.148232343
  misc_feature (1)..(148): Score of 168.2 for HMM of FIGURE 2 of USSN 12/515,707.
  misc_feature (4)..(73): Pfam Name: MBF1 Pfam Description: Multiprotein bridging factor 1
  misc_feature (81)..(135): Pfam Name: HTH_3 Pfam Description: Helix-turn-helix
  misc_feature (1)..(148): Functional Homolog Of Ceres SEEDLINE ID no. ME04448
MAESDWDTVTVLRKKGPTAAQAKSKQAITAAQRRGEELETSKKWSAGQNKQHTITKNTAKLDRETEELHHDRVPLEVGKVIQQGRQGKGMTQKDLATKINEKPQVIADYESGKAIPNNQVMGKIERVIGMKLRGKDIGKPVEPGPKNK

SEQ ID NO: 2483 - protein, 149 aa, synthetic construct
  misc_feature (1)..(149): useful for making plants with increased heat tolerance as described in USSN 12/515,707
  misc_feature (1)..(149): Public GI ID no.60832184
  misc_feature (1)..(149): Score of 168.3 for HMM of FIGURE 2 of USSN 12/515,707.
  misc_feature (4)..(73): Pfam Name: MBF1 Pfam Description: Multiprotein bridging factor 1
  misc_feature (81)..(135): Pfam Name: HTH_3 Pfam Description: Helix-turn-helix
  misc_feature (1)..(149): Functional Homolog Of Ceres SEEDLINE ID no. ME04448
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAKD

SEQ ID NO: 2484 - protein, 148 aa, Silurana tropicalis
  misc_feature (1)..(148): useful for making plants with increased heat tolerance as described in USSN 12/515,707
  misc_feature (1)..(148): Public GI ID no.62859835
  misc_feature (1)..(148): Score of 166.0 for HMM of FIGURE 2 of USSN 12/515,707.
  misc_feature (4)..(73): Pfam Name: MBF1 Pfam Description: Multiprotein bridging factor 1
  misc_feature (81)..(135): Pfam Name: HTH_3 Pfam Description: Helix-turn-helix
  misc_feature (1)..(148): Functional Homolog Of Ceres SEEDLINE ID no. ME04448
MAESDWDTVTVLRKKGPTAAQAKSKQAITAAQRRGEEVETSKKWSAGQNKQHTITKNTAKLDRETEELHHDRVPLEVGKVIQQGRQGKGMNQKDLATKINEKPQVIADYESGKAIPNNQVLGKIERAIGLKLRGRDIGKPLDPIVKKN

SEQ ID NO: 2485 - DNA, 1960 bp, Zea mays
  misc_feature (1)..(1960): useful for making plants with increased heat tolerance as described in USSN 12/515,707
  misc_feature (1)..(1960): Ceres CLONE ID no.1571069
acccgcgctcgtgacggctcacccacccccgccgtggttccgggcaacagggaagaagatcccgccctggtgccaccacgaggcacccggcggctttgatttcctctccgcccctggcgtctggcgtggtgctctggcccccagtttgtcggctgctttctacctgtacttgcagagctgtaggtgggggtaaacatggtgaggtggtcttgccaggatgacaccttatcatgttccctatccccgtgctagatgcgcgccggccgccgtgtgtgtgtatgccttaacgtcgatgcgtgccttgtactcctgtgtggccgtgtgctaggggcagctgctcgttgctgctcttttacaacggagttttactgacattgtccaacagactattccattccggtgtcagagcagagattttagcatcgttactcggattaggagggtaggatccggctatggactcaacgctgaaccaggtgaaggaggagagccatggggagggaggagatttgatggcaggcacggtggaggccgcggatgggccgtccgcggccgtcgccgcggcaccaaagccgatggagggtctgcatgaccctgggccgccgccgttcctcaccaagacatatgacatggtcgacgactcggacaccgacctgattgtgtcttggagcgccaccaacaacagcttcgtggtgtgggatccgcacgccttcgccacggtgctgctgcccaggcacttcaagcacaacaacttctccagcttcgtccggcagctcaacacctatggtttcaggaaggtggatcctgatcggtgggaattcgcgaatgagggctttttacggggacagagacacctcctgaagaacatcaggcgtcgaaaacctcctgctcagaatgccacaaaccagcagtccattgggccttaccttgaggtgggacattttggatatgatgcagagattgacatgttgaagagagacaagcagttactgatggcagaagtggtgaagctaaggcaggagcagcagaacacaaaggcaaatctcaaagcgatggaggataggctacaagggactgaacagaagcagcagcagatgatggcgttcttggcacgtgtcatgcggaatcctgaattcttgaagcacctggtttcccagaatgagatgaggaaggagcttcaagatgctatttcaaagaaaagaagacggcgcatcgaccaagggcctgaagctgatgacttgggggctagtagcagcttggagcaaggttcaccggtcctgtttaatgcccaggacccagttgaattccttgtcgacggaatcccagctgacctcgagagcccagctttcgatggccacggcctgattgggccacatgatattgatattgatattgatattggcagtacctctgagcagcagcaagacatgccccaggaggatctgaatgacaacttctgggagcagttgctgaacgaaggacttggcgaggagaacgatagccctgtaatcgaggatgatatgaatgtgctgtctgagaagatgggttatctcaactcagatggcccaacatctagcaattagtcttggcttcgttgctgttttgttatttccatcttaccagaacccgcagctcctgaattgtgttcactgtgtcagcaagactaggcaattctgcttccgttgctcggtttccatgcccttctgaattcctcgccaatggtagggcttgcttccatgagaattggctggcattcgccatggtgtcaagggagaactgctaggtgcatctgatgtgatctgactagtgattgctgcttgccactggagtggctgttttaggcgacgccagcgatctgttggttgttttacgaccctgcccgtcaggaattcagtctgtagttatgtacagtgacagcgactcagcaagtagtactgatggttaaaaaaaaaaaaaaaaa

SEQ ID NO: 2486 - DNA, 1533 bp, Populus balsamifera subsp. trichocarpa
  misc_feature (1)..(1533): useful for making plants with increased heat tolerance as described in USSN 12/515,707
  misc_feature (1)..(1533): Ceres ANNOT ID no.1507529
atggtggttccagacggtggcgattttttcggctacgctcttgccggtgtttcttctgcatcattttctgcaacagctatgttaccaaaactcattttggatgatgatcattcattgacaaatgcaataaaatcggagaaagatcataaagtgggtcaagagagtaatatgtcccctttacacgacaccgcttgttgcggtggaggcggcgggacttcatctccatcatcatcatcatcaatgaatacaagagaaatgcagaaagcagcagcagtactggaggtagaggaggagaaaagaatcaaagcaacagcagtcacggtcaaagaagaagatgatgatggtgtagatagtctcaatgagttgaagggaggaggcggtggcggtaataataaaaataacaatgggatatcgtcgtcttcgtgttcctctgtggatttacctaaacccatggagggtttacatgaggcaggtccacctccgtttctgaagaagacatttgagatggtgggggatccggaaacggatgaaacagtgtcgtggggcaagaatcgcgatagttttgttgtttgggactctcatgaattctctaaaaatctgcttccaaagtatttcaagcacagtaatttctccagcttcattcgccagctaaatacctacggctttagaaagattgatccggatagatgggagtttgcaaatgaagggtttcacggtgccaagaagcatttgctaaagaccatcaagagaagaagcaggtataacaaacagcagagcggagcagttactggcgtcaatgattcaacaaaacctcgtttggaagctgaacttgaaaatctgaaggatgatcaggatgttttaaggttggaaatcttgaaaattagacagaagcagcaggagtcgcaaactcaactgagtgctgttgaagaacgcattcaagctgcagagtgcaagcaattgcagatgtttattttctttaccaaagctgccagaaatcctggatttattcaacaactaatccagaagagaaagcaaaaagggaaggtagatgggattgaattttgcaagaaaagacgactgcttcaaacccatctccctgaaagctttcctgctgccgtggataccaaccaaagcgtccattttaaaaaccatgctcaggaacaactggccacaatgcagaccgaaattactgagattttaactgaggatgtggagacctgccaaatgttgaaagtatttccagctccaatgagtgatgggttttgctgtccgatacttcaagatcataatgcaaatataatgtgcgaaaaaagtactcaagatatgtcctctgcttataatctaatgtcagagaagctactggatgatggttcggtgattgaggatttggttgatgaggaggtagatgtcaatgactcaaaactctaccttgaattagaggatttgattgggatgccacgaatgtggggtggatttgcaaccgagttagtagggcatacagctggttgtgttggatcaattcccagattgtaa

SEQ ID NO: 2487 - protein, 510 aa, Populus balsamifera subsp. trichocarpa
  misc_feature (1)..(510): useful for making plants with increased heat tolerance as described in USSN 12/515,707
  misc_feature (1)..(510): Ceres ANNOT ID no.1507529
  misc_feature (1)..(510): Score of 1272.4 for HMM of FIGURE 1 of USSN 12/515,707.
  misc_feature (160)..(326): Pfam Name: HSF_DNA-bind Pfam Description: HSF-type DNA-binding
  misc_feature (1)..(510): Functional Homolog Of Ceres SEEDLINE ID no. ME17524
MVVPDGGDFFGYALAGVSSASFSATAMLPKLILDDDHSLTNAIKSEKDHKVGQESNMSPLHDTACCGGGGGTSSPSSSSSMNTREMQKAAAVLEVEEEKRIKATAVTVKEEDDDGVDSLNELKGGGGGGNNKNNNGISSSSCSSVDLPKPMEGLHEAGPPPFLKKTFEMVGDPETDETVSWGKNRDSFVVWDSHEFSKNLLPKYFKHSNFSSFIRQLNTYGFRKIDPDRWEFANEGFHGAKKHLLKTIKRRSRYNKQQSGAVTGVNDSTKPRLEAELENLKDDQDVLRLEILKIRQKQQESQTQLSAVEERIQAAECKQLQMFIFFTKAARNPGFIQQLIQKRKQKGKVDGIEFCKKRRLLQTHLPESFPAAVDTNQSVHFKNHAQEQLATMQTEITEILTEDVETCQMLKVFPAPMSDGFCCPILQDHNANIMCEKSTQDMSSAYNLMSEKLLDDGSVIEDLVDEEVDVNDSKLYLELEDLIGMPRMWGGFATELVGHTAGCVGSIPRL

SEQ ID NO: 2488 - protein, 351 aa, Lycopersicon peruvianum
  misc_feature (1)..(351): useful for making plants with increased heat tolerance as described in USSN 12/515,707
  misc_feature (1)..(351): Public GI ID no.729774
  misc_feature (1)..(351): Score of 396.4 for HMM of FIGURE 1 of USSN 12/515,707.
  misc_feature (30)..(197): Pfam Name: HSF_DNA-bind Pfam Description: HSF-type DNA-binding
  misc_feature (1)..(351): Functional Homolog Of Ceres SEEDLINE ID no. ME17524
MEDVMKVKVEEDGIPTAVLPMEGLHDVGPPPFLSKTYEMVEDSSTDQVISWSTTRNSFIVWDSHKFSTTLLPRFFKHSNFSSFIRQLNTYGFRKVDPDRWEFANEGFLGGQKHLLKTIKRRRNVGQSMNQQGSGACIEIGYYGMEEELERLKRDKNVLMTEIVKLRQQQQSTRNQIIAMGEKIETQERKQVQMMSFLAKIFSNPTFLQQYLDKQVHRKDKQRIEVGQKRRLTMTPSVTGSDQPMNYSSSLQESEAELASIEMLFSAAMDNESSSNVRPDSVVTANGTDMEPVADDIWEELLSEDLISGDRAAEEVVVVEQPEFDVEVEDLVVKTPEWGEELQDLVDQLGFL

SEQ ID NO: 2489 - DNA, 1191 bp, Populus balsamifera subsp. trichocarpa
  misc_feature (1)..(1191): useful for making plants with increased heat tolerance as described in USSN 12/515,707
  misc_feature (1)..(1191): Ceres ANNOT ID no.1455221
atggagggagttgtagtgaaagaagaggagacagtgacatgtactggaggtggagcttcttcatcttcatcatcctctagtttctctccgcatccaatggaggggttaaatgaagtgggcccacctccgttcttgacgaagacatatgaaatggtggaagacccttcaacggatacagtggtttcgtggagtggaggtcgcaatagcttcatagtttgggactctcataagttctctactactttgcttccgaaacacttcaaacacagtaacttctccagcttcattcgacagctcaacacttatggtttcaggaaggttgatcctgaccggtgggaatttgccaatgaagggtttttgggagggcagaagcatctattgaagaccatcaaacggaaaagacatctctcacagaccacacaacaacaaggtggaggagcttgcattgagttaggacaatttgaatttgaaggagagcttgaaaggttaaaaagagaccgaaacgtgttaatggcagagattgtaaggcttaggcagcaacaacagcagtcgagggaacacattgctgcgatggaggataggttacgaagcacagagagaaaacagcagcgggtgatgacattccttgctaaagctctcaacaacccatcctttatcgagcaatttgcacaaagggctgcacagaggagagaaataagaggtgttgaaattgggcgtaagaggagactcactgcaagcccaagtgttgaaaatttgcaagaagttgcatctgtggcattaggtagcagccaatttgttgattacatgaatcaggatttaccaactattgagaacgagatggagacgcttttctctgctgtcttggacaatgaatcaagcagtgatatcaaggacccaatagcaagttctatggacacagcaagtggtggtagcactttggatgctgttaatgagacaatttgggaggagttacttactgatgatttagtttccggggaacctaatgaagttgttgtgagtgatgaaccagaagttgatgtggaagttgaggatttggttgcgaaacctgtggactggagtgatgattttcaggaccttgtggatcaaatgggttatctcaggagggagtggtggaagttccaacacggccaacagatgttactctgctcttctgtttccttcttgaattag

SEQ ID NO: 2490 - protein, 364 aa, Populus balsamifera subsp. trichocarpa
  misc_feature (1)..(364): useful for making plants with increased heat tolerance as described in USSN 12/515,707
  misc_feature (1)..(364): Ceres ANNOT ID no.1455221
  misc_feature (1)..(364): Score of 358.3 for HMM of FIGURE 1 of USSN 12/515,707.
  misc_feature (10)..(177): Pfam Name: HSF_DNA-bind Pfam Description: HSF-type DNA-binding
  misc_feature (1)..(364): Functional Homolog Of Ceres SEEDLINE ID no. ME17524
MEGLNEVGPPPFLTKTYEMVEDPSTDTVVSWSGGRNSFIVWDSHKFSTTLLPKHFKHSNFSSFIRQLNTYGFRKVDPDRWEFANEGFLGGQKHLLKTIKRKRHLSQTTQQQGGGACIELGQFEFEGELERLKRDRNVLMAEIVRLRQQQQQSREHIAAMEDRLRSTERKQQRVMTFLAKALNNPSFIEQFAQRAAQRREIRGVEIGRKRRLTASPSVENLQEVASVALGSSQFVDYMNQDLPTIENEMETLFSAVLDNESSSDIKDPIASSMDTASGGSTLDAVNETIWEELLTDDLVSGEPNEVVVSDEPEVDVEVEDLVAKPVDWSDDFQDLVDQMGYLRREWWKFQHGQQMLLCSSVSFLN

SEQ ID NO: 2491 - protein, 345 aa, Arabidopsis thaliana
  misc_feature (1)..(345): useful for making plants with increased heat tolerance as described in USSN 12/515,707
  misc_feature (1)..(345): Public GI ID no.15225255
  misc_feature (1)..(345): Score of 389.3 for HMM of FIGURE 1 of USSN 12/515,707.
  misc_feature (43)..(212): Pfam Name: HSF_DNA-bind Pfam Description: HSF-type DNA-binding
  misc_feature (1)..(345): Functional Homolog Of Ceres SEEDLINE ID no. ME17524
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 2492 - protein, 398 aa, Gossypium hirsutum
  misc_feature (1)..(398): useful for making plants with increased heat tolerance as described in USSN 12/515,707
  misc_feature (1)..(398): Ceres CLONE ID no.1947534
  misc_feature (1)..(398): Score of 881.6 for HMM of FIGURE 1 of USSN 12/515,707.
  misc_feature (43)..(219): Pfam Name: HSF_DNA-bind Pfam Description: HSF-type DNA-binding
  misc_feature (1)..(398): Functional Homolog Of Ceres SEEDLINE ID no. ME17524
MDGVSSSSNNQTDASTSGGGTQTAAQPLLMPQSVAGHSANGPPPFLSKTYDMVDDPATDAIVSWSPTNNSFVVWNPPEFARDLLPKYFKHNNFSSFVRQLNTYGFRKVDPDRWEFANEGFLRGQKHLLRNISRRKPAHGHGHQQTQQPHGQSSSMGACVEVGKFGLEEEVERLKRDKNVLMQELVRLRQQQQTTDNQLQNMVQRLQGMEQRQQQMMSFLAKAVQNPSFFAQFVHQQNESNRRISETNKKRRLKQDGIIGEDHSTASDGRIVKYQPLMNDAKAMLMQMMKGDASPRRDSFNNSNEHTLIGDGSLSSSGLDGGNSSSHVSGVTLQEVSPTSGISGHCPSAAISEIQSSPCTTSSERITTAELPDVSALIGAEKPPSVSVTQTDIIMPDLS

SEQ ID NO: 2493 - protein, 412 aa, Arabidopsis thaliana
  misc_feature (1)..(412): useful for making plants with increased heat tolerance as described in USSN 12/515,707
  misc_feature (1)..(412): Public GI ID no.22326589
  misc_feature (1)..(412): Score of 223.1 for HMM of FIGURE 1 of USSN 12/515,707.
  misc_feature (54)..(153): Pfam Name: HSF_DNA-bind Pfam Description: HSF-type DNA-binding
  misc_feature (1)..(412): Functional Homolog Of Ceres SEEDLINE ID no. ME17524
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 2494 - DNA, 1080 bp, Populus balsamifera subsp. trichocarpa
  misc_feature (1)..(1080): useful for making plants with increased heat tolerance as described in USSN 12/515,707
  misc_feature (1)..(1080): Ceres ANNOT ID no.1442880
atgaatccatatctaacagtgaagcaagagtacgcaggatcaagtttattgcctctgtccggcggtgatgagccgccaacaatgatgctcccaccacagccgatggaaggtttacatgatacaggaccaccgccattcctgaccaagacttttgacatggtggatgacccaatgactaatcacatagtttcttggagcagaggagggtttagctttgttgtttgggatccttattctttctccgcaaatctccttcctagatacttcaagcataataatttctccagctttgtcaggcagctcaatacttatggctttagaaagattgatccagatagatgggagtttgccaatgaaggatttctgaggggtcaaaagcagcttctaaggaatataaagagaagaaaggcagcttctcagcctctttctcaacagcaagctccagatgcctgtgttgaagttagccgttttggattagatggagaaatcgatctcttgaaacgtgacaggcacgttttgatgatggaattagcgaagcttagacagcagcaacagaaagctagatcttatatacaagctatggagcaaaggctacaagggacagaacaaaagcagcagcagatgatgcaattcttagctcgagcaatgcaaaatcctgcctttctactgcagttagtccaacagaaagggaaaaggaaagaacttgaggaagcaatgactaaaaagagaagaattcctgttgatcaaagacctagtcgaagtggtggtggtgaatcaaaccgtattgatgaaagtgcaaaccccatcaaggcagaggctttagaatatggagactacggatttgaagtgtcagagctggaggcacttgcattggaaatgcaagggtatggcagggcaaggagagagcaagaggatggagtagaagagctagagccactagaaagcggagatagagaacttgacgagggattttgggaagaactgttaaatgagagtgctggaggaggtgaagatgaggatgtgaatacattagctgagcgcttgggttatttgcgttcaagtcctaagtacagaaattga

SEQ ID NO: 2495 - protein, 331 aa, Populus balsamifera subsp. trichocarpa
  misc_feature (1)..(331): useful for making plants with increased heat tolerance as described in USSN 12/515,707
  misc_feature (1)..(331): Ceres ANNOT ID no.1442880
  misc_feature (1)..(331): Score of 437.0 for HMM of FIGURE 1 of USSN 12/515,707.
  misc_feature (16)..(184): Pfam Name: HSF_DNA-bind Pfam Description: HSF-type DNA-binding
  misc_feature (1)..(331): Functional Homolog Of Ceres SEEDLINE ID no. ME17524
MLPPQPMEGLHDTGPPPFLTKTFDMVDDPMTNHIVSWSRGGFSFVVWDPYSFSANLLPRYFKHNNFSSFVRQLNTYGFRKIDPDRWEFANEGFLRGQKQLLRNIKRRKAASQPLSQQQAPDACVEVSRFGLDGEIDLLKRDRHVLMMELAKLRQQQQKARSYIQAMEQRLQGTEQKQQQMMQFLARAMQNPAFLLQLVQQKGKRKELEEAMTKKRRIPVDQRPSRSGGGESNRIDESANPIKAEALEYGDYGFEVSELEALALEMQGYGRARREQEDGVEELEPLESGDRELDEGFWEELLNESAGGGEDEDVNTLAERLGYLRSSPKYRN

SEQ ID NO: 2496 - protein, 337 aa, Beta vulgaris
  misc_feature (1)..(337): useful for making plants with increased heat tolerance as described in USSN 12/515,707
  misc_feature (1)..(337): Public GI ID no.111184724
  misc_feature (1)..(337): Score of 209.6 for HMM of FIGURE 1 of USSN 12/515,707.
  misc_feature (47)..(175): Pfam Name: HSF_DNA-bind Pfam Description: HSF-type DNA-binding
  misc_feature (1)..(337): Functional Homolog Of Ceres SEEDLINE ID no. ME17524
MEPKTELSLGGGIRSSGFVTTKMEDTEEKEVIELPKPLENLHEIGPPPFLSKTFEIVEDPETDTIVSWGVTFDSFIVWDISKFSDLLSKYFKHRNFNSFVRQLNTYGFRKVHLDRLEYANSGFQKGKKHLLKTIKRRNHGANNNTALLLQRETAIENIKKEQEALKLEILDLKKEQQNSNTCLAALGERVKFVEWKQREFIMLIAKAMKRTSSFQQVLQNYRHNKVLSSGEFYKKRRLASTSDSLALADQFLANSPTTTQNKEDVSTFQYEANSFVGSAGQKSNLASETSSPDLSSGSYIMWEKLMADDVICKDDREEKYVHELENLITKPSSLICK

SEQ ID NO: 2497 - DNA, 2446 bp, Panicum virgatum
  misc_feature (1)..(2446): useful for making plants with increased heat tolerance as described in USSN 12/515,707
  misc_feature (1)..(2446): Ceres CLONE ID no.1794674
gcactccgcccactcgagcctggcgcgtgtcgccgcgtcgtcgtcttcgttctgagctcttctgtctccccaaccaaatctctcccaggtgctgctgcgcagctgaagaattccatccccaattgcgtctccacttccaccaccgcttaccgaatcccttagtccgccgcccttattctctgtcccaaagcagccgccgcttcccgccacttggacgcgcgccctcgtgatcccgaccgaccgagcgagggaggcgagctcgccgtctcggtctcaggttgcgccgtgcggcgtgcggccgtgctgcttgtttcgctctctaggagcgaggggtggagagagagggggtcttcgcgctttcttgcggggctgtccggctgtgggtcaaaagcgcggcgctttccgctccaccttcccacagcggaatcaaatctctcaactcccttcgatggcccctgattcggttcgtggtatcggggcatgagcttgctcagagagatcccccttttggtttggcgtcagggcgctgggtggtagcgcggtgtctttcttggtgcgtttcacatgtctgagacctttgatttctctccacttcgtgagtgattctgcagctgccgctgctgctgttaggtgtccgcggcccgcgggtcgtgatggggtgaacggaagcgttcgtcgcagggctgggttattacgcctgtgagcctgtctgcttccccgcaccttgttcttgtgcccatacttcttgcttttgtcacgcctgaaccgtgtcttcttgcagtacctgaggcttgacaattggcaagtaccaagtagctacctgtgtttacataagataaaccatttctggttccaaagcacaaggtgtactgtgtgccaatatttgatacacagtttctgcttcttgctgaggtgatactcttggcttgctctgttgatgcggctgccatgaaccacgggatgttgaattctgtcaaggtggagagccgatcatcggcagtcactgccaatggccagcctaagccaatggatgcgctccatgatggcggcccacctccgttcctcaccaagacatacgacatggttgatgacccaaccacagatgctgttgtgtcgtggagcgccaccaacaatagcttcatagtttgggatcctcatatctttgggacagtgctgctgccaaggtacttcaagcacaacaacttctccagcttcgttcggcagctgaacacttatggcttcagaaaggtggatcctgacagatgggaatttgctaatgagggctttctgaggggtcagaggcacctgctcaaaaacattaggcgtcggaaacctccacactcatctccaaatcagcaatctcttggctcttatcttgaggtagggcactttggatatgatgaagagattgatcagctgaagagggacaagcagctgttgatggctgaagtagtgaaactgaggcaggagcagcaaaatacaaagtcggatctacaggccatggaagagaaattaaaagatacggagcagaagcaacagcagatgatggcattcatggcacgagtaatgcagaaccctgagttcatgcatcaactgatatcccagcgcgagatgaggaaggggctggaggatgccatctcaaagaaaagaaggcgccgcattgatcagggacctgaagctgatagcatgggcaatggttctagtctggaacaagggtcgcaggcagtgtttgaaccacaggagccggtggaatcacatgccaacggtgttccatctgatctggaaagttcatctgttgaggcaaagggatttgaggttcaacaaggtgtttcttccggtggctctgagcatctgaaacgcaggccaagtggtgagttaaatgatgatttctgggaggaccttttgcatgaggggggacttggtgcagaggctggtaatgcagttggtcaggatgacatgaacatgtagcctcggaaggtagcatacctcaaagaaaacagcataaacacagacattagcagctcttgttttatcacaatggctcggggtatattaccatccattatgcatgttatatcagtgttctagacctgattggatctccttcggtctatgaaatgctatatcgatcacaattggtaatacctggatgcagaatggaagtacctggattaatatgttgctatggtcttttctcaagggtcctggctgaccctgttgccgtcactgtttgaacagagaccatggtcatgttgctgtcaggctagtgtttcggttttaactaatggtagggtacaaccgagtggcctggcttgtatagcttgtatatgtaaagtgttccttctatttctgctgatctgtagtgacctgttatgtaagaaactattacacctcggaatttatcatttcactgtacattgcatcataaaaaaaaaaaaaaaaaaaa

SEQ ID NO: 2498 - protein, 339 aa, Panicum virgatum
  misc_feature (1)..(339): useful for making plants with increased heat tolerance as described in USSN 12/515,707
  misc_feature (1)..(339): Ceres CLONE ID no.1794674
  misc_feature (1)..(339): Score of 653.8 for HMM of FIGURE 1 of USSN 12/515,707.
  misc_feature (36)..(203): Pfam Name: HSF_DNA-bind Pfam Description: HSF-type DNA-binding
  misc_feature (1)..(339): Functional Homolog Of Ceres SEEDLINE ID no. ME17524
MNHGMLNSVKVESRSSAVTANGQPKPMDALHDGGPPPFLTKTYDMVDDPTTDAVVSWSATNNSFIVWDPHIFGTVLLPRYFKHNNFSSFVRQLNTYGFRKVDPDRWEFANEGFLRGQRHLLKNIRRRKPPHSSPNQQSLGSYLEVGHFGYDEEIDQLKRDKQLLMAEVVKLRQEQQNTKSDLQAMEEKLKDTEQKQQQMMAFMARVMQNPEFMHQLISQREMRKGLEDAISKKRRRRIDQGPEADSMGNGSSLEQGSQAVFEPQEPVESHANGVPSDLESSSVEAKGFEVQQGVSSGGSEHLKRRPSGELNDDFWEDLLHEGGLGAEAGNAVGQDDMNM

SEQ ID NO: 2499 - DNA, 1080 bp, Populus balsamifera subsp. trichocarpa
  misc_feature (1)..(1080): useful for making plants with increased heat tolerance as described in USSN 12/515,707
  misc_feature (1)..(1080): Ceres ANNOT ID no.1452564
atgaatccatttttcactgtgaagcaagagtatgcaggatcaagttcatcgccaccgtccggcggtgatgagcccccaccagttatgctgccgccgcagccaagggaaggtttacatgatacaggaccaccaccattcctgactaagacttttgacatggtagatgacccaacgaccaatcacatagtttcttggaacagaggaggttctagctttgttgcctgggatcctcattcgttctccacaaatctccttcctagatacttcaaacataataatttttccagctttgtcaggcagctcaatacttatggttttagaaagattgatccagatagatgggagtttgccaatgaaggatttctgagcggtcaaaagcatctcttaaggaatataaagagaagaaaggcaccctctcagcctcttactcaacagcaagctccagatgcttgcgttgaagttggccgttttggattagatggagaaatcgatcgcttgagacgtgacaagcaggttttaatgatggaattagtgaaacttagacagcagcaacagaatgctagatcttatatacaagctatggaccaaaggctacaagcgatagagcaaaagcagcagcaaatgatgcaattcttagctagagcaatgcaaaatccagcctttttacagcagttagttcagcagaaggagaaaaggaaagagcttgaggaagcaatgactaaaaagagaaggcggcctattgatcaaggatctagtagaggtggtggtggtcgtcgtggtggtgaatcgagccatattggtggaagtgcaaaccccatcaaggcagagcctttagagtctggagaccttgaatttgaagtgtcagagctggaagcacttgcgttggaaatgcaagggtatggtagggcaaggagagagcaagaggatggagtagaagagctagagacaccagaaagtaaagatagagaacttgatgagggattttgggaagaactgttaaatgagagtgctggaggagatgaagatgatgtcaatacattagccgagcgcttgggttatctgggttcaagtcctaagtag

SEQ ID NO: 2500 - protein, 331 aa, Populus balsamifera subsp. trichocarpa
  misc_feature (1)..(331): useful for making plants with increased heat tolerance as described in USSN 12/515,707
  misc_feature (1)..(331): Ceres ANNOT ID no.1452564
  misc_feature (1)..(331): Score of 440.3 for HMM of FIGURE 1 of USSN 12/515,707.
  misc_feature (16)..(184): Pfam Name: HSF_DNA-bind Pfam Description: HSF-type DNA-binding
  misc_feature (1)..(331): Functional Homolog Of Ceres SEEDLINE ID no. ME17524
MLPPQPREGLHDTGPPPFLTKTFDMVDDPTTNHIVSWNRGGSSFVAWDPHSFSTNLLPRYFKHNNFSSFVRQLNTYGFRKIDPDRWEFANEGFLSGQKHLLRNIKRRKAPSQPLTQQQAPDACVEVGRFGLDGEIDRLRRDKQVLMMELVKLRQQQQNARSYIQAMDQRLQAIEQKQQQMMQFLARAMQNPAFLQQLVQQKEKRKELEEAMTKKRRRPIDQGSSRGGGGRRGGESSHIGGSANPIKAEPLESGDLEFEVSELEALALEMQGYGRARREQEDGVEELETPESKDRELDEGFWEELLNESAGGDEDDVNTLAERLGYLGSSPK

SEQ ID NO: 2501 - DNA, 1047 bp, Populus balsamifera subsp. trichocarpa
  misc_feature (1)..(1047): useful for making plants with increased heat tolerance as described in USSN 12/515,707
  misc_feature (1)..(1047): Ceres ANNOT ID no.1459422
atggcatctacagctattccacaaccaatggagggactccgtgactcggttcctccaccatttctcaccaaaacttatgatataatagaagatgcaagcacaaaccatattgtttcttggagtagaggtaacaacagctttattatttgggatccccaagccttttccacgagtctcctccctagatacttcaagcacaacaatttctctagctttgttaggcagcttaacacatatgggtttagaaaggttgatccagatagatgggagtttgctaatgaagggtttctcagagggaaaaaacatcttctcaagagtattaggaggagaaaagctcctcaaacactaacttctcaggcttgtgttgaagttggaacatttggactggatggggaagtgaatcgattaaggcgagacaagcaagtactaatggtggaactggtgaagcttagacaacaacaacagactactaaagcttgcattcaacttattgaacgaaaacttaaaaggactgagaataaacagcaacagatgatgagtttcttggctagagcaatgcaaaatcccaactttgtgcagcaactagcccaacaaaaggaaatgaggaaagaacttgaagaggcgattagtaaaaagagaaggcgaccgattgatcaagggcgtagtaattttgaggttgcagaattcggccatggcgagggagtaggaacatttgttaagattgaacatcaggagtttggtgatctttctgagtttgacgatctttctgagtttgacgttccagaatttcacaatccggcaatgaacatgcaaggactaagtgaaaaccaactgatcaacttggtggaagaacgtattgagaaaggagaagaacatggaaataaaggtaacgaaattgatgagggtttctgggaagatttattgaacgaggatattattgacgaagaaatagcagtattgggtagcgaaggtgaagacgaggaagatgtaagcgtgttggttgaacagcttggttacttgggttccagtacagagttgaggacttga

SEQ ID NO: 2502 - protein, 348 aa, Populus balsamifera subsp. trichocarpa
  misc_feature (1)..(348): useful for making plants with increased heat tolerance as described in USSN 12/515,707
  misc_feature (1)..(348): Ceres ANNOT ID no.1459422
  misc_feature (1)..(348): Score of 424.2 for HMM of FIGURE 1 of USSN 12/515,707.
  misc_feature (19)..(182): Pfam Name: HSF_DNA-bind Pfam Description: HSF-type DNA-binding
  misc_feature (1)..(348): Functional Homolog Of Ceres SEEDLINE ID no. ME17524
MASTAIPQPMEGLRDSVPPPFLTKTYDIIEDASTNHIVSWSRGNNSFIIWDPQAFSTSLLPRYFKHNNFSSFVRQLNTYGFRKVDPDRWEFANEGFLRGKKHLLKSIRRRKAPQTLTSQACVEVGTFGLDGEVNRLRRDKQVLMVELVKLRQQQQTTKACIQLIERKLKRTENKQQQMMSFLARAMQNPNFVQQLAQQKEMRKELEEAISKKRRRPIDQGRSNFEVAEFGHGEGVGTFVKIEHQEFGDLSEFDDLSEFDVPEFHNPAMNMQGLSENQLINLVEERIEKGEEHGNKGNEIDEGFWEDLLNEDIIDEEIAVLGSEGEDEEDVSVLVEQLGYLGSSTELRT

SEQ ID NO: 2503 - DNA, 1020 bp, Sorghum bicolor
  misc_feature (1)..(1020): useful for making plants with increased heat tolerance as described in USSN 12/515,707
  misc_feature (1)..(1020): Ceres ANNOT ID no.6034999
atgaaccacgggaacgggatgttgaactctgtcaaggtggagagccggccatcagtggttgctaccaatggccagcctaggccgatggatgtgctccatgacggcggcccaccaccgttccttaccaagacgtacgacatggttgatgacccaaccacggacgccgttgtgtcatggagcgccactagcaatagcttcatagtttgggatcctcatatctttgggacggtgctgctgccaaggtatttcaagcacaacaacttctccagcttcgttcggcagctcaatacttatggcttcagaaaggtggatcctgacagatgggaatttgctaatgaagagtttctgagaggtcagaggcaccttctcaaaaacattaggcggcggaaacctccacactcatctccaaatcagcaatctcttggctcttaccttgaggtagggcactttgggtatgaagaagagattgatcagctgaagagggacaaacagctcttgatgactgaagtagtgaagctaaggcaggagcagcaaaatacaaagtcagacctacaggccatggaagagaaattacaagatactgagcagaagcaacagcagatgatggcattcatggctcgagtcatgcagaaccctgattttatgcgtcaactgatctcccagcgcgagatgaggaaggagcttgaggatgccatctcaaagaaaagaaggcgccgcattgttcagggacctgaagctgatagcatgggcactggttctagcctggagcaagggtctcaggtagtgtttgaaccactggagccggtggaatcacttgccaatggtgtgccatctgatctgggaagttcatctgtggaggcaaagggtttcgaggtccaacaaggtgtttcttcatgtggctctgagcgtcttaatggcaagccaactgcagagttaaatgatgatttctgggaggaccttctgcatgaggggggactcggtgcaggtaatgcagttggtcaggatgatatgaagatgtag

SEQ ID NO: 2504 - protein, 339 aa, Sorghum bicolor
  misc_feature (1)..(339): useful for making plants with increased heat tolerance as described in USSN 12/515,707
  misc_feature (1)..(339): Ceres ANNOT ID no.6034999
  misc_feature (1)..(339): Score of 637.4 for HMM of FIGURE 1 of USSN 12/515,707.
  misc_feature (38)..(205): Pfam Name: HSF_DNA-bind Pfam Description: HSF-type DNA-binding
  misc_feature (1)..(339): Functional Homolog Of Ceres SEEDLINE ID no. ME17524
MNHGNGMLNSVKVESRPSVVATNGQPRPMDVLHDGGPPPFLTKTYDMVDDPTTDAVVSWSATSNSFIVWDPHIFGTVLLPRYFKHNNFSSFVRQLNTYGFRKVDPDRWEFANEEFLRGQRHLLKNIRRRKPPHSSPNQQSLGSYLEVGHFGYEEEIDQLKRDKQLLMTEVVKLRQEQQNTKSDLQAMEEKLQDTEQKQQQMMAFMARVMQNPDFMRQLISQREMRKELEDAISKKRRRRIVQGPEADSMGTGSSLEQGSQVVFEPLEPVESLANGVPSDLGSSSVEAKGFEVQQGVSSCGSERLNGKPTAELNDDFWEDLLHEGGLGAGNAVGQDDMKM

SEQ ID NO: 2505 - DNA, 1077 bp, Populus balsamifera subsp. trichocarpa
  misc_feature (1)..(1077): useful for making plants with increased heat tolerance as described in USSN 12/515,707
  misc_feature (1)..(1077): Ceres ANNOT ID no.1463437
atgaatcgtcggggccgagcgatcaaggaggagtatgcaggtggtagttcaagcacatactcatcaggcatggcatctacagctattccacaaccaatggagggactccatgacccaggtcctcctccatttctcactaaaacttatgatataatagaagattcaagcacaaaccatattatctcttggagtagaggtaacaacagctttgttgtttgggatccccaagccttttccattagtctcctccctagatacttcaagcacaacaatttctcaagctttgttaggcagctaaacacatatgggtttagaaaggttgatccagatagatgggagtttgctaatgaaggatttctcagggggaaaaaacatcttctcaagactgttaggaggagaaaagctcctcaaactcagacttctcagcaagctctagaggcttgtgttgaagttggaacatttagactggatggggaagttgatcgattaagccgagacaaacaagtactaatggtggaactagtgaagcttagacagcaacaacagactactagagcttgccttcaacttatggaacaaagagttaaaaggaatgagaataaacagcaacatatgatgagtttcttggctagagcaatgcaaaatcccacctttgtgcagcaactagtccaacaaaaggacatgatgaaagagcttgaagaggagattagtaaaaagaaaaggcgaccgattgatcaagggcgtaataatgttgaggttggagaatttggccatggtgagggagtaggaacatttgttaaaattgaacctcgggagttcggtggtttttctgagtttgaagttccagaatttgtcaatctggctatgaacatgcaagaactaaatgaaaaccaactgatcaacttggatgaagaatgtattgaaaaaggagaagaatatgaaaataatggtaaagactttgatgaggctttctgggaagatttattgaatgaggatattggcgaacagggtgaagatgaggaagatgtaaacgtgttggttgagcagcttggttacttgggttatagtccaaagtag

SEQ ID NO: 2506 - protein, 358 aa, Populus balsamifera subsp. trichocarpa
  misc_feature (1)..(358): useful for making plants with increased heat tolerance as described in USSN 12/515,707
  misc_feature (1)..(358): Ceres ANNOT ID no.1463437
  misc_feature (1)..(358): Score of 477.1 for HMM of FIGURE 1 of USSN 12/515,707.
  misc_feature (42)..(209): Pfam Name: HSF_DNA-bind Pfam Description: HSF-type DNA-binding
  misc_feature (1)..(358): Functional Homolog Of Ceres SEEDLINE ID no. ME17524
MNRRGRAIKEEYAGGSSSTYSSGMASTAIPQPMEGLHDPGPPPFLTKTYDIIEDSSTNHIISWSRGNNSFVVWDPQAFSISLLPRYFKHNNFSSFVRQLNTYGFRKVDPDRWEFANEGFLRGKKHLLKTVRRRKAPQTQTSQQALEACVEVGTFRLDGEVDRLSRDKQVLMVELVKLRQQQQTTRACLQLMEQRVKRNENKQQHMMSFLARAMQNPTFVQQLVQQKDMMKELEEEISKKKRRPIDQGRNNVEVGEFGHGEGVGTFVKIEPREFGGFSEFEVPEFVNLAMNMQELNENQLINLDEECIEKGEEYENNGKDFDEAFWEDLLNEDIGEQGEDEEDVNVLVEQLGYLGYSPK

SEQ ID NO: 2507 - DNA, 1119 bp, Sorghum bicolor
  misc_feature (1)..(1119): useful for making plants with increased heat tolerance as described in USSN 12/515,707
  misc_feature (1)..(1119): Ceres ANNOT ID no.6011400
atggatccaatgctgaacccggtgaaggaggagagccatggggatggaggagatttgctggcagcaggcacggaggagaccggggacgggccgtccgctgcggtcgccgcggcgccaaggccgatggagggtctgcatgaccctgggccgccgccgttcctcaccaagacgtatgacatggttgacgacccgtccaccgacccggttgtgtcgtggagcgccaccaacaacagcttcgtggtctgggatccacacgccttcgcaaccgtgctgctgcccaggcacttcaagcacaacaacttctccagcttcgtccgccagctcaacacctatggtttcaggaaggtggatcctgatcggtgggaatttgcgaacgagggttttttacggggacagagacagctcctgaagaacatcaggcgtcgaaaacctcctgctcagaatgccacaaaccagcagtcccttgggccataccttgaggtggggcattttggatttgatgcagagattgacaggctgaagagagacaagcagttattgatggcagaagtggtgaagctaaggcaggagcagcagaacacaaaggcaaatctcaaagccatggaggataggctacaagggactgaacagaagcagcagcagatgatggcattcttggcacgtgtcatgcggaatcctgaattcctgaagcacctgatttcccagaatgagatgagaaaggagctccaagatgctatttcaaagaaaagaagacgccgcatcgatcaaggccctgaacttgatgacttgggagctggtagcagcctagagcaaggttcaccggtcctgtttaacccccaggatccggttgaattccttgtcgacggaatcccaactgaccttgagagtccagcttttgatggccaaagcctgatcgagccacaggacattgatattggcagtacctctgagcagcagcaggatatgccccaggaggatttgaatgacaacttctgggagcaattgctgaatgaaggccttggtgaagagaacggtagccctgttatcgaggatgatatgaatgtgctgtccgagaagatgggatttctcaactcagatggcccaacatctaccatttag

SEQ ID NO: 2508 - protein, 372 aa, Sorghum bicolor
  misc_feature (1)..(372): useful for making plants with increased heat tolerance as described in USSN 12/515,707
  misc_feature (1)..(372): Ceres ANNOT ID no.6011400
  misc_feature (1)..(372): Score of 840.7 for HMM of FIGURE 1 of USSN 12/515,707.
  misc_feature (51)..(219): Pfam Name: HSF_DNA-bind Pfam Description: HSF-type DNA-binding
  misc_feature (1)..(372): Functional Homolog Of Ceres SEEDLINE ID no. ME17524
MDPMLNPVKEESHGDGGDLLAAGTEETGDGPSAAVAAAPRPMEGLHDPGPPPFLTKTYDMVDDPSTDPVVSWSATNNSFVVWDPHAFATVLLPRHFKHNNFSSFVRQLNTYGFRKVDPDRWEFANEGFLRGQRQLLKNIRRRKPPAQNATNQQSLGPYLEVGHFGFDAEIDRLKRDKQLLMAEVVKLRQEQQNTKANLKAMEDRLQGTEQKQQQMMAFLARVMRNPEFLKHLISQNEMRKELQDAISKKRRRRIDQGPELDDLGAGSSLEQGSPVLFNPQDPVEFLVDGIPTDLESPAFDGQSLIEPQDIDIGSTSEQQQDMPQEDLNDNFWEQLLNEGLGEENGSPVIEDDMNVLSEKMGFLNSDGPTSTI

SEQ ID NO: 2509 - protein, 372 aa, Oryza sativa subsp. japonica
  misc_feature (1)..(372): useful for making plants with increased heat tolerance as described in USSN 12/515,707
  misc_feature (1)..(372): Public GI ID no.115470859
  misc_feature (1)..(372): Score of 786.8 for HMM of FIGURE 1 of USSN 12/515,707.
  misc_feature (51)..(219): Pfam Name: HSF_DNA-bind Pfam Description: HSF-type DNA-binding
  misc_feature (1)..(372): Functional Homolog Of Ceres SEEDLINE ID no. ME17524
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASEQQQIGPQGELNDNFWEELLNEGLVGEENDNPVVEDDMNVLSEKMGYLNSNGPTAGE

SEQ ID NO: 2510 - protein, 372 aa, Oryza sativa subsp. indica
  misc_feature (1)..(372): useful for making plants with increased heat tolerance as described in USSN 12/515,707
  misc_feature (1)..(372): Public GI ID no.125557431
  misc_feature (1)..(372): Score of 788.8 for HMM of FIGURE 1 of USSN 12/515,707.
  misc_feature (51)..(219): Pfam Name: HSF_DNA-bind Pfam Description: HSF-type DNA-binding
  misc_feature (1)..(372): Functional Homolog Of Ceres SEEDLINE ID no. ME17524
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGTSEQQQIGPQGELNDNFWEELLNEGLVGEENDNPVVEDDMNVLSEKMGYLNSNGPTAGE

SEQ ID NO: 2511 - protein, 372 aa, Oryza sativa subsp. japonica
  misc_feature (1)..(372): useful for making plants with increased heat tolerance as described in USSN 12/515,707
  misc_feature (1)..(372): Public GI ID no.33087081
  misc_feature (1)..(372): Score of 765.9 for HMM of FIGURE 1 of USSN 12/515,707.
  misc_feature (51)..(219): Pfam Name: HSF_DNA-bind Pfam Description: HSF-type DNA-binding
  misc_feature (1)..(372): Functional Homolog Of Ceres SEEDLINE ID no. ME17524
MDDPMLNAVKEEESHGDGGGLEVVAGEDGAAAVAAGLAPGPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLFKNIKRRKPPSHTASNQQSFGPYLEVGHFGYDAEIDRLKRDKQLLMAEVVKLRQEQQNTKANLKAMEDRLQGTEQRQKQMIAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASQQQQIGPQGELNDNFWEELLNEGLVGEENDNPVVEDDMNVLSEKMGYLNSNGPTAGE

SEQ ID NO: 2512 - protein, 374 aa, Arabidopsis thaliana
  misc_feature (1)..(374): useful for making plants with increased heat tolerance as described in USSN 12/515,707
  misc_feature (1)..(374): Public GI ID no.15220611
  misc_feature (1)..(374): Score of 180.6 for HMM of FIGURE 1 of USSN 12/515,707.
  misc_feature (18)..(188): Pfam Name: HSF_DNA-bind Pfam Description: HSF-type DNA-binding
  misc_feature (1)..(374): Functional Homolog Of Ceres SEEDLINE ID no. ME17524
MVKSTDGGGGSSSSSSVAPFLRKCYDMVDDSTTDSIISWSPSADNSFVILDTTVFSVQLLPKYFKHSNFSSFIRQLNIYGFRKVDADRWEFANDGFVRGQKDLLKNVIRRKNVQSSEQSKHESTSTTYAQEKSGLWKEVDILKGDKQVLAQELIKVRQYQEVTDTKMLHLEDRVQGMEESQQEMLSFLVMVMKNPSLLVQLLQPKEKNTWRKAGEGAKIVEEVTDEGESNSYGLPLVTYQPPSDNNGTAKSNSNDVNDFLRNADMLKFCLDENHVPLIIPDLYDDGAWEKLLLLSPSRKKTKKQENIVKKGKDDLTLEEEEEDGTMELDKSYMLKLISEEMEKPDDFEFGQLTPERSRNLEILTEQMELLASNE

SEQ ID NO: 2513 - DNA, 1233 bp, Arabidopsis thaliana
  misc_feature (1)..(1233): useful for making plants with increased heat tolerance as described in USSN 12/515,707
  misc_feature (1)..(1233): Ceres CLONE ID no.125228
tctaaagtttagagatttttcgattatggtgaaatcgacggacggtggtggtgggtcttcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagctttattcgtcagctcaatatctacggttttagaaaagttgatgcagatcgatgggagtatgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcggcggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaatgaatagttgattttttgaacatatcagcctcaaaacttttgttatgtaactctataacgaacaacgaagtatgcaccggatatatc

SEQ ID NO: 2514 - protein, 375 aa, Arabidopsis thaliana
  misc_feature (1)..(375): useful for making plants with increased heat tolerance as described in USSN 12/515,707
  misc_feature (1)..(375): Ceres CLONE ID no.125228
  misc_feature (1)..(375): Score of 178.3 for HMM of FIGURE 1 of USSN 12/515,707.
  misc_feature (19)..(189): Pfam Name: HSF_DNA-bind Pfam Description: HSF-type DNA-binding
  misc_feature (1)..(375): Functional Homolog Of Ceres SEEDLINE ID no. ME17524
MVKSTDGGGGSSSSSSSVAPFLRKCYDMVDDSTTDSIISWSPSADNSFVILDTTVFSVQLLPKYFKHSNFSSFIRQLNIYGFRKVDADRWEYANDGFVRGQKDLLKNVIRRKNVQSSEQSKHESTSTTYAQEKSGLWKEVDILKGDKQVLAQELIKVRQYQEVTDTKMLHLEDRVQGMEESQQEMLSFLVMVMKNPSLLVQLLQPKEKNTWRKAAEGAKIVEEVTDEGESNSYGLPLVTYQPPSDNNGTAKSNSNDVNDFLRNADMLKFCLDENHVPLIIPDLYDDGAWEKLLLLSPSRKKTKKQENIVKKGKDDLTLEEEEEDGTMELDKSYMLKLISEEMEKPDDFEFGQLTPERSRNLEILTEQMELLASNE

(The sequence listing continues in the following parts.)

What is claimed is:

1. A method of increasing level of low-nitrogen tolerance in a plant, said method comprising
   growing plant cells transformed with an exogenous nucleic acid molecule, said exogenous nucleic acid molecule comprising a heterologous promoter operably linked to a polynucleotide sequence encoding a polypeptide having 95 percent or greater amino acid sequence identity to the amino acid sequence of SEQ ID NO: 769; and
   producing plants from said transformed plant cells; and
   selecting for a transformed plant from said transformed plants that overexpresses said polypeptide and exhibits an increased level of low-nitrogen tolerance as compared to the corresponding level of low-nitrogen tolerance of a control plant of the same species that does not comprise said exogenous nucleic acid molecule.

2. The method of claim 1, wherein the polynucleotide sequence has 95 percent or greater nucleotide sequence identity to the nucleotide sequence of SEQ ID NO: 768.

3. The method of claim 1, wherein said polypeptide comprises the amino acid sequence of SEQ ID NO: 769.

4. A transgenic plant cell transformed with an exogenous nucleic acid molecule, said exogenous nucleic acid molecule comprising a heterologous promoter operably linked to a polynucleotide sequence encoding a polypeptide having 95 percent or greater amino acid sequence identity to the amino acid sequence of SEQ ID NO: 769, wherein a transformed plant comprising said transformed plant cell has been obtained and selected for having an increased level of low-nitrogen tolerance as compared to the corresponding level of low-nitrogen tolerance of a control plant of the same species that does not comprise said nucleic acid molecule.

5. The plant cell of claim 4, wherein the polynucleotide sequence has 95 percent or greater nucleotide sequence identity to the nucleotide sequence of SEQ ID NO: 768.

6. A transgenic plant comprising the transformed plant cell of claim 4.

7. The transgenic plant of claim 6, wherein said plant is a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), and *Pennisetum glaucum* (pearl millet).

8. A product comprising a transgenic plant tissue from the transgenic plant according to claim 7, and wherein said product comprises said exogenous nucleic acid molecule.

9. A transgenic seed produced by the transgenic plant of claim 6, and wherein said transgenic seed comprises said exogenous nucleic acid molecule.

\* \* \* \* \*